United States Patent 12,290,554 (COMPOSITIONS FOR OPTIMIZED BCR-ABL PEPTIDE VACCINES) - sequence listing, part 3

SEQ ID NO: 44172 - protein, 25 aa, synthetic construct
  source 1..25: note = Seed: NSCVKLQTVHSIPLTINKEEALQRP
NSCVKLQTVHSIPYTIFKMEAYQRP

SEQ ID NO: 44173 - protein, 25 aa, synthetic construct
  source 1..25: note = Seed: NSCVKLQTVHSIPLTINKEEALQRP
NSCVKLQTVHSIPYTIFKNEAAQRP

SEQ ID NO: 44174 - protein, 25 aa, synthetic construct
  source 1..25: note = Seed: NSCVKLQTVHSIPLTINKEEALQRP
NSCVKLQTVHSIPYTIFKNEADQRP

SEQ ID NO: 44175 - protein, 25 aa, synthetic construct
  source 1..25: note = Seed: NSCVKLQTVHSIPLTINKEEALQRP
NSCVKLQTVHSIPYTIFKSEAFQRP

SEQ ID NO: 44176 - protein, 25 aa, synthetic construct
  source 1..25: note = Seed: NSCVKLQTVHSIPLTINKEEALQRP
NSCVKLQTVHSIPYTIFKSEALQRP

SEQ ID NO: 44177 - protein, 25 aa, synthetic construct
  source 1..25: note = Seed: NSCVKLQTVHSIPLTINKEEALQRP
NSCVKLQTVHSIPYTIFKTEAAQRP

SEQ ID NO: 44178 - protein, 25 aa, synthetic construct
  source 1..25: note = Seed: NSCVKLQTVHSIPLTINKEEALQRP
NSCVKLQTVHSIPYTIFKTEADQRP

SEQ ID NO: 44179 - protein, 25 aa, synthetic construct
  source 1..25: note = Seed: NSCVKLQTVHSIPLTINKEEALQRP
NSCVKLQTVHSIPYTIFKTEAFQRP

SEQ ID NO: 44180 - protein, 25 aa, synthetic construct
  source 1..25: note = Seed: NSCVKLQTVHSIPLTINKEEALQRP
NSCVKLQTVHSIPYTIFKTEALQRP

SEQ ID NO: 44181 - protein, 25 aa, synthetic construct
  source 1..25: note = Seed: NSCVKLQTVHSIPLTINKEEALQRP
NSCVKLQTVHSIPYTIFKVEAFQRP

SEQ ID NO: 44182 - protein, 25 aa, synthetic construct
  source 1..25: note = Seed: NSCVKLQTVHSIPLTINKEEALQRP
NSCVKLQTVHSIPYTIFKVEAIQRP

SEQ ID NO: 44183 - protein, 25 aa, synthetic construct
  source 1..25: note = Seed: NSCVKLQTVHSIPLTINKEEALQRP
NSCVKLQTVHSIPYTIFKVEALQRP

SEQ ID NO: 44184 - protein, 25 aa, synthetic construct
  source 1..25: note = Seed: NSCVKLQTVHSIPLTINKEEALQRP
NSCVKLQTVHSIPYTIFKVEAMQRP

SEQ ID NO: 44185 - protein, 25 aa, synthetic construct
  source 1..25: note = Seed: NSCVKLQTVHSIPLTINKEEALQRP
NSCVKLQTVHSIPYTIFKVEAVQRP

SEQ ID NO: 44186 - protein, 25 aa, synthetic construct
  source 1..25: note = Seed: NSCVKLQTVHSIPLTINKEEALQRP
NSCVKLQTVHSIPYTIFKVEAYQRP

SEQ ID NO: 44187 - protein, 25 aa, synthetic construct
  source 1..25: note = Seed: NSCVKLQTVHSIPLTINKEEALQRP
NSCVKLQTVHSIPYTIFKWEAFQRP

SEQ ID NO: 44188 - protein, 25 aa, synthetic construct
  source 1..25: note = Seed: NSCVKLQTVHSIPLTINKEEALQRP
NSCVKLQTVHSIPYTIFKWEAIQRP

SEQ ID NO: 44189 - protein, 25 aa, synthetic construct
  source 1..25: note = Seed: NSCVKLQTVHSIPLTINKEEALQRP
NSCVKLQTVHSIPYTIFKWEALQRP

SEQ ID NO: 44190 - protein, 25 aa, synthetic construct
  source 1..25: note = Seed: NSCVKLQTVHSIPLTINKEEALQRP
NSCVKLQTVHSIPYTIFKWEAMQRP

SEQ ID NO: 44191 - protein, 25 aa, synthetic construct
  source 1..25: note = Seed: NSCVKLQTVHSIPLTINKEEALQRP
NSCVKLQTVHSIPYTIFKWEAVQRP

SEQ ID NO: 44192 - protein, 25 aa, synthetic construct
  source 1..25: note = Seed: NSCVKLQTVHSIPLTINKEEALQRP
NSCVKLQTVHSIPYTIFKWEAYQRP

SEQ ID NO: 44193 - protein, 25 aa, synthetic construct
  source 1..25: note = Seed: NSCVKLQTVHSIPLTINKEEALQRP
NSCVKLQTVHSIPYTIFKYEAAQRP

SEQ ID NO: 44194 - protein, 25 aa, synthetic construct
  source 1..25: note = Seed: NSCVKLQTVHSIPLTINKEEALQRP
NSCVKLQTVHSIPYTIFKYEAEQRP

SEQ ID NO: 44195 - protein, 25 aa, synthetic construct
  source 1..25: note = Seed: NSCVKLQTVHSIPLTINKEEALQRP
NSCVKLQTVHSIPYTIFKYEAFQRP

SEQ ID NO: 44196 - protein, 25 aa, synthetic construct
  source 1..25: note = Seed: NSCVKLQTVHSIPLTINKEEALQRP
NSCVKLQTVHSIPYTIFKYEAIQRP

SEQ ID NO: 44197 - protein, 25 aa, synthetic construct
  source 1..25: note = Seed: NSCVKLQTVHSIPLTINKEEALQRP
NSCVKLQTVHSIPYTIFKYEALQRP

SEQ ID NO: 44198 - protein, 25 aa, synthetic construct
  source 1..25: note = Seed: NSCVKLQTVHSIPLTINKEEALQRP
NSCVKLQTVHSIPYTIFKYEAMQRP

SEQ ID NO: 44199 - protein, 25 aa, synthetic construct
  source 1..25: note = Seed: NSCVKLQTVHSIPLTINKEEALQRP
NSCVKLQTVHSIPYTIFKYEARQRP

SEQ ID NO: 44200 - protein, 25 aa, synthetic construct
  source 1..25: note = Seed: NSCVKLQTVHSIPLTINKEEALQRP
NSCVKLQTVHSIPYTIFKYEASQRP

SEQ ID NO: 44201 - protein, 25 aa, synthetic construct
  source 1..25: note = Seed: NSCVKLQTVHSIPLTINKEEALQRP
NSCVKLQTVHSIPYTIFKYEATQRP

SEQ ID NO: 44202 - protein, 25 aa, synthetic construct
  source 1..25: note = Seed: NSCVKLQTVHSIPLTINKEEALQRP
NSCVKLQTVHSIPYTIFKYEAVQRP

SEQ ID NO: 44203 - protein, 25 aa, synthetic construct
  source 1..25: note = Seed: NSCVKLQTVHSIPLTINKEEALQRP
NSCVKLQTVHSIPYTIFKYEAWQRP

SEQ ID NO: 44204 - protein, 25 aa, synthetic construct
  source 1..25: note = Seed: NSCVKLQTVHSIPLTINKEEALQRP
NSCVKLQTVHSIPYTIFKYEAYQRP

SEQ ID NO: 44205 - protein, 25 aa, synthetic construct
  source 1..25: note = Seed: NSCVKLQTVHSIPLTINKEEALQRP
NSCVKLQTVHSIPYTIGKFEAIQRP

SEQ ID NO: 44206 - protein, 25 aa, synthetic construct
  source 1..25: note = Seed: NSCVKLQTVHSIPLTINKEEALQRP
NSCVKLQTVHSIPYTIGKFEALQRP

SEQ ID NO: 44207 - protein, 25 aa, synthetic construct
  source 1..25: note = Seed: NSCVKLQTVHSIPLTINKEEALQRP
NSCVKLQTVHSIPYTIGKFEAVQRP

SEQ ID NO: 44208 - protein, 25 aa, synthetic construct
  source 1..25: note = Seed: NSCVKLQTVHSIPLTINKEEALQRP
NSCVKLQTVHSIPYTIHKFEAAQRP

SEQ ID NO: 44209 - protein, 25 aa, synthetic construct
  source 1..25: note = Seed: NSCVKLQTVHSIPLTINKEEALQRP
NSCVKLQTVHSIPYTIHKFEAFQRP

SEQ ID NO: 44210 - protein, 25 aa, synthetic construct
  source 1..25: note = Seed: NSCVKLQTVHSIPLTINKEEALQRP
NSCVKLQTVHSIPYTIHKFEAIQRP

SEQ ID NO: 44211 - protein, 25 aa, synthetic construct
  source 1..25: note = Seed: NSCVKLQTVHSIPLTINKEEALQRP
NSCVKLQTVHSIPYTIHKFEALQRP

SEQ ID NO: 44212 - protein, 25 aa, synthetic construct
  source 1..25: note = Seed: NSCVKLQTVHSIPLTINKEEALQRP
NSCVKLQTVHSIPYTIHKFEAMQRP

SEQ ID NO: 44213 - protein, 25 aa, synthetic construct
  source 1..25: note = Seed: NSCVKLQTVHSIPLTINKEEALQRP
NSCVKLQTVHSIPYTIHKFEANQRP

SEQ ID NO: 44214 - protein, 25 aa, synthetic construct
  source 1..25: note = Seed: NSCVKLQTVHSIPLTINKEEALQRP
NSCVKLQTVHSIPYTIHKFEASQRP

SEQ ID NO: 44215 - protein, 25 aa, synthetic construct
  source 1..25: note = Seed: NSCVKLQTVHSIPLTINKEEALQRP
NSCVKLQTVHSIPYTIHKFEATQRP

SEQ ID NO: 44216 - protein, 25 aa, synthetic construct
  source 1..25: note = Seed: NSCVKLQTVHSIPLTINKEEALQRP
NSCVKLQTVHSIPYTIHKFEAVQRP

SEQ ID NO: 44217 - protein, 25 aa, synthetic construct
  source 1..25: note = Seed: NSCVKLQTVHSIPLTINKEEALQRP
NSCVKLQTVHSIPYTIHKFEAYQRP

SEQ ID NO: 44218 - protein, 25 aa, synthetic construct
  source 1..25: note = Seed: NSCVKLQTVHSIPLTINKEEALQRP
NSCVKLQTVHSIPYTIHKYEALQRP

SEQ ID NO: 44219 - protein, 25 aa, synthetic construct
  source 1..25: note = Seed: NSCVKLQTVHSIPLTINKEEALQRP
NSCVKLQTVHSIPYTIIKAEAFQRP

SEQ ID NO: 44220 - protein, 25 aa, synthetic construct
  source 1..25: note = Seed: NSCVKLQTVHSIPLTINKEEALQRP
NSCVKLQTVHSIPYTIIKFEAAQRP

SEQ ID NO: 44221 - protein, 25 aa, synthetic construct
  source 1..25: note = Seed: NSCVKLQTVHSIPLTINKEEALQRP
NSCVKLQTVHSIPYTIIKFEACQRP

SEQ ID NO: 44222 - protein, 25 aa, synthetic construct
  source 1..25: note = Seed: NSCVKLQTVHSIPLTINKEEALQRP
NSCVKLQTVHSIPYTIIKFEADQRP

SEQ ID NO: 44223 - protein, 25 aa, synthetic construct
  source 1..25: note = Seed: NSCVKLQTVHSIPLTINKEEALQRP
NSCVKLQTVHSIPYTIIKFEAEQRP

SEQ ID NO: 44224 - protein, 25 aa, synthetic construct
  source 1..25: note = Seed: NSCVKLQTVHSIPLTINKEEALQRP
NSCVKLQTVHSIPYTIIKFEAFQRP

SEQ ID NO: 44225 - protein, 25 aa, synthetic construct
  source 1..25: note = Seed: NSCVKLQTVHSIPLTINKEEALQRP
NSCVKLQTVHSIPYTIIKFEAGQRP

SEQ ID NO: 44226 - protein, 25 aa, synthetic construct
  source 1..25: note = Seed: NSCVKLQTVHSIPLTINKEEALQRP
NSCVKLQTVHSIPYTIIKFEAHQRP

SEQ ID NO: 44227 - protein, 25 aa, synthetic construct
  source 1..25: note = Seed: NSCVKLQTVHSIPLTINKEEALQRP
NSCVKLQTVHSIPYTIIKFEAIQRP

SEQ ID NO: 44228 - protein, 25 aa, synthetic construct
  source 1..25: note = Seed: NSCVKLQTVHSIPLTINKEEALQRP
NSCVKLQTVHSIPYTIIKFEAKQRP

SEQ ID NO: 44229 - protein, 25 aa, synthetic construct
  source 1..25: note = Seed: NSCVKLQTVHSIPLTINKEEALQRP
NSCVKLQTVHSIPYTIIKFEALQRP

SEQ ID NO: 44230 - protein, 25 aa, synthetic construct
  source 1..25: note = Seed: NSCVKLQTVHSIPLTINKEEALQRP
NSCVKLQTVHSIPYTIIKFEAMQRP

SEQ ID NO: 44231 - protein, 25 aa, synthetic construct
  source 1..25: note = Seed: NSCVKLQTVHSIPLTINKEEALQRP
NSCVKLQTVHSIPYTIIKFEANQRP

SEQ ID NO: 44232 - protein, 25 aa, synthetic construct
  source 1..25: note = Seed: NSCVKLQTVHSIPLTINKEEALQRP
NSCVKLQTVHSIPYTIIKFEAPQRP

SEQ ID NO: 44233 - protein, 25 aa, synthetic construct
  source 1..25: note = Seed: NSCVKLQTVHSIPLTINKEEALQRP
NSCVKLQTVHSIPYTIIKFEAQQRP

SEQ ID NO: 44234 - protein, 25 aa, synthetic construct
  source 1..25: note = Seed: NSCVKLQTVHSIPLTINKEEALQRP
NSCVKLQTVHSIPYTIIKFEARQRP

SEQ ID NO: 44235 - protein, 25 aa, synthetic construct
  source 1..25: note = Seed: NSCVKLQTVHSIPLTINKEEALQRP
NSCVKLQTVHSIPYTIIKFEASQRP

SEQ ID NO: 44236 - protein, 25 aa, synthetic construct
  source 1..25: note = Seed: NSCVKLQTVHSIPLTINKEEALQRP
NSCVKLQTVHSIPYTIIKFEATQRP

SEQ ID NO: 44237 - protein, 25 aa, synthetic construct
  source 1..25: note = Seed: NSCVKLQTVHSIPLTINKEEALQRP
NSCVKLQTVHSIPYTIIKFEAVQRP

SEQ ID NO: 44238 - protein, 25 aa, synthetic construct
  source 1..25: note = Seed: NSCVKLQTVHSIPLTINKEEALQRP
NSCVKLQTVHSIPYTIIKFEAWQRP

SEQ ID NO: 44239 - protein, 25 aa, synthetic construct
  source 1..25: note = Seed: NSCVKLQTVHSIPLTINKEEALQRP
NSCVKLQTVHSIPYTIIKFEAYQRP

SEQ ID NO: 44240 - protein, 25 aa, synthetic construct
  source 1..25: note = Seed: NSCVKLQTVHSIPLTINKEEALQRP
NSCVKLQTVHSIPYTIIKIEAFQRP

SEQ ID NO: 44241 - protein, 25 aa, synthetic construct
  source 1..25: note = Seed: NSCVKLQTVHSIPLTINKEEALQRP
NSCVKLQTVHSIPYTIIKIEAIQRP

SEQ ID NO: 44242 - protein, 25 aa, synthetic construct
  source 1..25: note = Seed: NSCVKLQTVHSIPLTINKEEALQRP
NSCVKLQTVHSIPYTIIKIEALQRP

SEQ ID NO: 44243 - protein, 25 aa, synthetic construct
  source 1..25: note = Seed: NSCVKLQTVHSIPLTINKEEALQRP
NSCVKLQTVHSIPYTIIKIEAMQRP

SEQ ID NO: 44244 - protein, 25 aa, synthetic construct
  source 1..25: note = Seed: NSCVKLQTVHSIPLTINKEEALQRP
NSCVKLQTVHSIPYTIIKIEARQRP

SEQ ID NO: 44245 - protein, 25 aa, synthetic construct
  source 1..25: note = Seed: NSCVKLQTVHSIPLTINKEEALQRP
NSCVKLQTVHSIPYTIIKIEAVQRP

SEQ ID NO: 44246 - protein, 25 aa, synthetic construct
  source 1..25: note = Seed: NSCVKLQTVHSIPLTINKEEALQRP
NSCVKLQTVHSIPYTIIKIEAYQRP

SEQ ID NO: 44247 - protein, 25 aa, synthetic construct
  source 1..25: note = Seed: NSCVKLQTVHSIPLTINKEEALQRP
NSCVKLQTVHSIPYTIIKLEAAQRP

SEQ ID NO: 44248 - protein, 25 aa, synthetic construct
  source 1..25: note = Seed: NSCVKLQTVHSIPLTINKEEALQRP
NSCVKLQTVHSIPYTIIKLEADQRP

SEQ ID NO: 44249 - protein, 25 aa, synthetic construct
  source 1..25: note = Seed: NSCVKLQTVHSIPLTINKEEALQRP
NSCVKLQTVHSIPYTIIKLEAFQRP

SEQ ID NO: 44250 - protein, 25 aa, synthetic construct
  source 1..25: note = Seed: NSCVKLQTVHSIPLTINKEEALQRP
NSCVKLQTVHSIPYTIIKLEAIQRP

SEQ ID NO: 44251 - protein, 25 aa, synthetic construct
  source 1..25: note = Seed: NSCVKLQTVHSIPLTINKEEALQRP
NSCVKLQTVHSIPYTIIKLEALQRP

SEQ ID NO: 44252 - protein, 25 aa, synthetic construct
  source 1..25: note = Seed: NSCVKLQTVHSIPLTINKEEALQRP
NSCVKLQTVHSIPYTIIKLEAMQRP

SEQ ID NO: 44253 - protein, 25 aa, synthetic construct
  source 1..25: note = Seed: NSCVKLQTVHSIPLTINKEEALQRP
NSCVKLQTVHSIPYTIIKLEANQRP

SEQ ID NO: 44254 - protein, 25 aa, synthetic construct
  source 1..25: note = Seed: NSCVKLQTVHSIPLTINKEEALQRP
NSCVKLQTVHSIPYTIIKLEATQRP

SEQ ID NO: 44255 - protein, 25 aa, synthetic construct
  source 1..25: note = Seed: NSCVKLQTVHSIPLTINKEEALQRP
NSCVKLQTVHSIPYTIIKLEAVQRP

SEQ ID NO: 44256 - protein, 25 aa, synthetic construct
  source 1..25: note = Seed: NSCVKLQTVHSIPLTINKEEALQRP
NSCVKLQTVHSIPYTIIKLEAYQRP

SEQ ID NO: 44257 - protein, 25 aa, synthetic construct
  source 1..25: note = Seed: NSCVKLQTVHSIPLTINKEEALQRP
NSCVKLQTVHSIPYTIIKMEAFQRP

SEQ ID NO: 44258 - protein, 25 aa, synthetic construct
  source 1..25: note = Seed: NSCVKLQTVHSIPLTINKEEALQRP
NSCVKLQTVHSIPYTIIKMEAIQRP

SEQ ID NO: 44259 - protein, 25 aa, synthetic construct
  source 1..25: note = Seed: NSCVKLQTVHSIPLTINKEEALQRP
NSCVKLQTVHSIPYTIIKMEALQRP

SEQ ID NO: 44260 - protein, 25 aa, synthetic construct
  source 1..25: note = Seed: NSCVKLQTVHSIPLTINKEEALQRP
NSCVKLQTVHSIPYTIIKMEAMQRP

SEQ ID NO: 44261 - protein, 25 aa, synthetic construct
  source 1..25: note = Seed: NSCVKLQTVHSIPLTINKEEALQRP
NSCVKLQTVHSIPYTIIKMEAVQRP

SEQ ID NO: 44262 - protein, 25 aa, synthetic construct
  source 1..25: note = Seed: NSCVKLQTVHSIPLTINKEEALQRP
NSCVKLQTVHSIPYTIIKNEAAQRP

SEQ ID NO: 44263 - protein, 25 aa, synthetic construct
  source 1..25: note = Seed: NSCVKLQTVHSIPLTINKEEALQRP
NSCVKLQTVHSIPYTIIKNEADQRP

SEQ ID NO: 44264 - protein, 25 aa, synthetic construct
  source 1..25: note = Seed: NSCVKLQTVHSIPLTINKEEALQRP
NSCVKLQTVHSIPYTIIKNEAEQRP

SEQ ID NO: 44265 - protein, 25 aa, synthetic construct
  source 1..25: note = Seed: NSCVKLQTVHSIPLTINKEEALQRP
NSCVKLQTVHSIPYTIIKNEAIQRP

SEQ ID NO: 44266 - protein, 25 aa, synthetic construct
  source 1..25: note = Seed: NSCVKLQTVHSIPLTINKEEALQRP
NSCVKLQTVHSIPYTIIKNEASQRP

SEQ ID NO: 44267 - protein, 25 aa, synthetic construct
  source 1..25: note = Seed: NSCVKLQTVHSIPLTINKEEALQRP
NSCVKLQTVHSIPYTIIKNEATQRP

SEQ ID NO: 44268 - protein, 25 aa, synthetic construct
  source 1..25: note = Seed: NSCVKLQTVHSIPLTINKEEALQRP
NSCVKLQTVHSIPYTIIKNEAVQRP

SEQ ID NO: 44269 - protein, 25 aa, synthetic construct
  source 1..25: note = Seed: NSCVKLQTVHSIPLTINKEEALQRP
NSCVKLQTVHSIPYTIIKSEAAQRP

SEQ ID NO: 44270 - protein, 25 aa, synthetic construct
  source 1..25: note = Seed: NSCVKLQTVHSIPLTINKEEALQRP
NSCVKLQTVHSIPYTIIKSEADQRP

SEQ ID NO: 44271 - protein, 25 aa, synthetic construct
  source 1..25: note = Seed: NSCVKLQTVHSIPLTINKEEALQRP
NSCVKLQTVHSIPYTIIKSEAEQRP

SEQ ID NO: 44272 - protein, 25 aa, synthetic construct
  source 1..25: note = Seed: NSCVKLQTVHSIPLTINKEEALQRP
NSCVKLQTVHSIPYTIIKSEASQRP

SEQ ID NO: 44273 - protein, 25 aa, synthetic construct
  source 1..25: note = Seed: NSCVKLQTVHSIPLTINKEEALQRP
NSCVKLQTVHSIPYTIIKTEAAQRP

SEQ ID NO: 44274 - protein, 25 aa, synthetic construct
  source 1..25: note = Seed: NSCVKLQTVHSIPLTINKEEALQRP
NSCVKLQTVHSIPYTIIKTEADQRP

SEQ ID NO: 44275 - protein, 25 aa, synthetic construct
  source 1..25: note = Seed: NSCVKLQTVHSIPLTINKEEALQRP
NSCVKLQTVHSIPYTIIKTEAEQRP

SEQ ID NO: 44276 - protein, 25 aa, synthetic construct
  source 1..25: note = Seed: NSCVKLQTVHSIPLTINKEEALQRP
NSCVKLQTVHSIPYTIIKTEASQRP

SEQ ID NO: 44277 - protein, 25 aa, synthetic construct
  source 1..25: note = Seed: NSCVKLQTVHSIPLTINKEEALQRP
NSCVKLQTVHSIPYTIIKTEATQRP

SEQ ID NO: 44278 - protein, 25 aa, synthetic construct
  source 1..25: note = Seed: NSCVKLQTVHSIPLTINKEEALQRP
NSCVKLQTVHSIPYTIIKVEAFQRP

SEQ ID NO: 44279 - protein, 25 aa, synthetic construct
  source 1..25: note = Seed: NSCVKLQTVHSIPLTINKEEALQRP
NSCVKLQTVHSIPYTIIKVEAIQRP

SEQ ID NO: 44280 - protein, 25 aa, synthetic construct
  source 1..25: note = Seed: NSCVKLQTVHSIPLTINKEEALQRP
NSCVKLQTVHSIPYTIIKVEALQRP

SEQ ID NO: 44281 - protein, 25 aa, synthetic construct
  source 1..25: note = Seed: NSCVKLQTVHSIPLTINKEEALQRP
NSCVKLQTVHSIPYTIIKVEAVQRP

SEQ ID NO: 44282 - protein, 25 aa, synthetic construct
  source 1..25: note = Seed: NSCVKLQTVHSIPLTINKEEALQRP
NSCVKLQTVHSIPYTIIKWEAFQRP

SEQ ID NO: 44283 - protein, 25 aa, synthetic construct
  source 1..25: note = Seed: NSCVKLQTVHSIPLTINKEEALQRP
NSCVKLQTVHSIPYTIIKWEAIQRP

SEQ ID NO: 44284 - protein, 25 aa, synthetic construct
  source 1..25: note = Seed: NSCVKLQTVHSIPLTINKEEALQRP
NSCVKLQTVHSIPYTIIKWEALQRP

SEQ ID NO: 44285 - protein, 25 aa, synthetic construct
  source 1..25: note = Seed: NSCVKLQTVHSIPLTINKEEALQRP
NSCVKLQTVHSIPYTIIKWEAMQRP

SEQ ID NO: 44286 - protein, 25 aa, synthetic construct
  source 1..25: note = Seed: NSCVKLQTVHSIPLTINKEEALQRP
NSCVKLQTVHSIPYTIIKWEAVQRP

SEQ ID NO: 44287 - protein, 25 aa, synthetic construct
  source 1..25: note = Seed: NSCVKLQTVHSIPLTINKEEALQRP
NSCVKLQTVHSIPYTIIKWEAYQRP

SEQ ID NO: 44288 - protein, 25 aa, synthetic construct
  source 1..25: note = Seed: NSCVKLQTVHSIPLTINKEEALQRP
NSCVKLQTVHSIPYTIIKYEAAQRP

SEQ ID NO: 44289 - protein, 25 aa, synthetic construct
  source 1..25: note = Seed: NSCVKLQTVHSIPLTINKEEALQRP
NSCVKLQTVHSIPYTIIKYEAEQRP

SEQ ID NO: 44290 - protein, 25 aa, synthetic construct
  source 1..25: note = Seed: NSCVKLQTVHSIPLTINKEEALQRP
NSCVKLQTVHSIPYTIIKYEAFQRP

SEQ ID NO: 44291 - protein, 25 aa, synthetic construct
  source 1..25: note = Seed: NSCVKLQTVHSIPLTINKEEALQRP
NSCVKLQTVHSIPYTIIKYEAIQRP

SEQ ID NO: 44292 - protein, 25 aa, synthetic construct
  source 1..25: note = Seed: NSCVKLQTVHSIPLTINKEEALQRP
NSCVKLQTVHSIPYTIIKYEALQRP

SEQ ID NO: 44293 - protein, 25 aa, synthetic construct
  source 1..25: note = Seed: NSCVKLQTVHSIPLTINKEEALQRP
NSCVKLQTVHSIPYTIIKYEAMQRP

SEQ ID NO: 44294 - protein, 25 aa, synthetic construct
  source 1..25: note = Seed: NSCVKLQTVHSIPLTINKEEALQRP
NSCVKLQTVHSIPYTIIKYEATQRP

SEQ ID NO: 44295 - protein, 25 aa, synthetic construct
  source 1..25: note = Seed: NSCVKLQTVHSIPLTINKEEALQRP
NSCVKLQTVHSIPYTIIKYEAVQRP

SEQ ID NO: 44296 - protein, 25 aa, synthetic construct
  source 1..25: note = Seed: NSCVKLQTVHSIPLTINKEEALQRP
NSCVKLQTVHSIPYTIIKYEAYQRP

SEQ ID NO: 44297 - protein, 25 aa, synthetic construct
  source 1..25: note = Seed: NSCVKLQTVHSIPLTINKEEALQRP
NSCVKLQTVHSIPYTIKKFEAFQRP

SEQ ID NO: 44298 - protein, 25 aa, synthetic construct
  source 1..25: note = Seed: NSCVKLQTVHSIPLTINKEEALQRP
NSCVKLQTVHSIPYTIKKFEAIQRP

SEQ ID NO: 44299 - protein, 25 aa, synthetic construct
  source 1..25: note = Seed: NSCVKLQTVHSIPLTINKEEALQRP
NSCVKLQTVHSIPYTIKKFEALQRP

SEQ ID NO: 44300 - protein, 25 aa, synthetic construct
  source 1..25: note = Seed: NSCVKLQTVHSIPLTINKEEALQRP
NSCVKLQTVHSIPYTIKKFEAMQRP

SEQ ID NO: 44301 - protein, 25 aa, synthetic construct
  source 1..25: note = Seed: NSCVKLQTVHSIPLTINKEEALQRP
NSCVKLQTVHSIPYTIKKFEAVQRP

SEQ ID NO: 44302 - protein, 25 aa, synthetic construct
  source 1..25: note = Seed: NSCVKLQTVHSIPLTINKEEALQRP
NSCVKLQTVHSIPYTILKFEAAQRP

SEQ ID NO: 44303 - protein, 25 aa, synthetic construct
  source 1..25: note = Seed: NSCVKLQTVHSIPLTINKEEALQRP
NSCVKLQTVHSIPYTILKFEACQRP

SEQ ID NO: 44304 - protein, 25 aa, synthetic construct
  source 1..25: note = Seed: NSCVKLQTVHSIPLTINKEEALQRP
NSCVKLQTVHSIPYTILKFEADQRP

SEQ ID NO: 44305 - protein, 25 aa, synthetic construct
  source 1..25: note = Seed: NSCVKLQTVHSIPLTINKEEALQRP
NSCVKLQTVHSIPYTILKFEAEQRP

SEQ ID NO: 44306 - protein, 25 aa, synthetic construct
  source 1..25: note = Seed: NSCVKLQTVHSIPLTINKEEALQRP
NSCVKLQTVHSIPYTILKFEAFQRP

SEQ ID NO: 44307 - protein, 25 aa, synthetic construct
  source 1..25: note = Seed: NSCVKLQTVHSIPLTINKEEALQRP
NSCVKLQTVHSIPYTILKFEAGQRP

SEQ ID NO: 44308 - protein, 25 aa, synthetic construct
  source 1..25: note = Seed: NSCVKLQTVHSIPLTINKEEALQRP
NSCVKLQTVHSIPYTILKFEAHQRP

SEQ ID NO: 44309 - protein, 25 aa, synthetic construct
  source 1..25: note = Seed: NSCVKLQTVHSIPLTINKEEALQRP
NSCVKLQTVHSIPYTILKFEAIQRP

SEQ ID NO: 44310 - protein, 25 aa, synthetic construct
  source 1..25: note = Seed: NSCVKLQTVHSIPLTINKEEALQRP
NSCVKLQTVHSIPYTILKFEALQRP

SEQ ID NO: 44311 - protein, 25 aa, synthetic construct
  source 1..25: note = Seed: NSCVKLQTVHSIPLTINKEEALQRP
NSCVKLQTVHSIPYTILKFEAMQRP

SEQ ID NO: 44312 - protein, 25 aa, synthetic construct
  source 1..25: note = Seed: NSCVKLQTVHSIPLTINKEEALQRP
NSCVKLQTVHSIPYTILKFEANQRP

SEQ ID NO: 44313 - protein, 25 aa, synthetic construct
  source 1..25: note = Seed: NSCVKLQTVHSIPLTINKEEALQRP
NSCVKLQTVHSIPYTILKFEAPQRP

SEQ ID NO: 44314 - protein, 25 aa, synthetic construct
  source 1..25: note = Seed: NSCVKLQTVHSIPLTINKEEALQRP
NSCVKLQTVHSIPYTILKFEAQQRP

SEQ ID NO: 44315 - protein, 25 aa, synthetic construct
  source 1..25: note = Seed: NSCVKLQTVHSIPLTINKEEALQRP
NSCVKLQTVHSIPYTILKFEARQRP

SEQ ID NO: 44316 - protein, 25 aa, synthetic construct
  source 1..25: note = Seed: NSCVKLQTVHSIPLTINKEEALQRP
NSCVKLQTVHSIPYTILKFEASQRP

SEQ ID NO: 44317 - protein, 25 aa, synthetic construct
  source 1..25: note = Seed: NSCVKLQTVHSIPLTINKEEALQRP
NSCVKLQTVHSIPYTILKFEATQRP

SEQ ID NO: 44318 - protein, 25 aa, synthetic construct
  source 1..25: note = Seed: NSCVKLQTVHSIPLTINKEEALQRP
NSCVKLQTVHSIPYTILKFEAVQRP

SEQ ID NO: 44319 - protein, 25 aa, synthetic construct
  source 1..25: note = Seed: NSCVKLQTVHSIPLTINKEEALQRP
NSCVKLQTVHSIPYTILKFEAYQRP

SEQ ID NO: 44320 - protein, 25 aa, synthetic construct
  source 1..25: note = Seed: NSCVKLQTVHSIPLTINKEEALQRP
NSCVKLQTVHSIPYTILKIEAFQRP

SEQ ID NO: 44321 - protein, 25 aa, synthetic construct
  source 1..25: note = Seed: NSCVKLQTVHSIPLTINKEEALQRP
NSCVKLQTVHSIPYTILKIEAIQRP

SEQ ID NO: 44322 - protein, 25 aa, synthetic construct
  source 1..25: note = Seed: NSCVKLQTVHSIPLTINKEEALQRP
NSCVKLQTVHSIPYTILKIEALQRP

SEQ ID NO: 44323 - protein, 25 aa, synthetic construct
  source 1..25: note = Seed: NSCVKLQTVHSIPLTINKEEALQRP
NSCVKLQTVHSIPYTILKIEAMQRP

SEQ ID NO: 44324 - protein, 25 aa, synthetic construct
  source 1..25: note = Seed: NSCVKLQTVHSIPLTINKEEALQRP
NSCVKLQTVHSIPYTILKIEAVQRP

SEQ ID NO: 44325 - protein, 25 aa, synthetic construct
  source 1..25: note = Seed: NSCVKLQTVHSIPLTINKEEALQRP
NSCVKLQTVHSIPYTILKIEAYQRP

SEQ ID NO: 44326 - protein, 25 aa, synthetic construct
  source 1..25: note = Seed: NSCVKLQTVHSIPLTINKEEALQRP
NSCVKLQTVHSIPYTILKLEAAQRP

SEQ ID NO: 44327 - protein, 25 aa, synthetic construct
  source 1..25: note = Seed: NSCVKLQTVHSIPLTINKEEALQRP
NSCVKLQTVHSIPYTILKLEAEQRP

SEQ ID NO: 44328 - protein, 25 aa, synthetic construct
  source 1..25: note = Seed: NSCVKLQTVHSIPLTINKEEALQRP
NSCVKLQTVHSIPYTILKLEAFQRP

SEQ ID NO: 44329 - protein, 25 aa, synthetic construct
  source 1..25: note = Seed: NSCVKLQTVHSIPLTINKEEALQRP
NSCVKLQTVHSIPYTILKLEAIQRP

SEQ ID NO: 44330 - protein, 25 aa, synthetic construct
  source 1..25: note = Seed: NSCVKLQTVHSIPLTINKEEALQRP
NSCVKLQTVHSIPYTILKLEALQRP

SEQ ID NO: 44331 - protein, 25 aa, synthetic construct
  source 1..25: note = Seed: NSCVKLQTVHSIPLTINKEEALQRP
NSCVKLQTVHSIPYTILKLEAMQRP

SEQ ID NO: 44332 - protein, 25 aa, synthetic construct
  source 1..25: note = Seed: NSCVKLQTVHSIPLTINKEEALQRP
NSCVKLQTVHSIPYTILKLEAVQRP

SEQ ID NO: 44333 - protein, 25 aa, synthetic construct
  source 1..25: note = Seed: NSCVKLQTVHSIPLTINKEEALQRP
NSCVKLQTVHSIPYTILKLEAYQRP

SEQ ID NO: 44334 - protein, 25 aa, synthetic construct
  source 1..25: note = Seed: NSCVKLQTVHSIPLTINKEEALQRP
NSCVKLQTVHSIPYTILKMEAIQRP

SEQ ID NO: 44335 - protein, 25 aa, synthetic construct
  source 1..25: note = Seed: NSCVKLQTVHSIPLTINKEEALQRP
NSCVKLQTVHSIPYTILKMEALQRP

SEQ ID NO: 44336 - protein, 25 aa, synthetic construct
  source 1..25: note = Seed: NSCVKLQTVHSIPLTINKEEALQRP
NSCVKLQTVHSIPYTILKMEAVQRP

SEQ ID NO: 44337 - protein, 25 aa, synthetic construct
  source 1..25: note = Seed: NSCVKLQTVHSIPLTINKEEALQRP
NSCVKLQTVHSIPYTILKNEAAQRP

SEQ ID NO: 44338 - protein, 25 aa, synthetic construct
  source 1..25: note = Seed: NSCVKLQTVHSIPLTINKEEALQRP
NSCVKLQTVHSIPYTILKNEADQRP

SEQ ID NO: 44339 - protein, 25 aa, synthetic construct
  source 1..25: note = Seed: NSCVKLQTVHSIPLTINKEEALQRP
NSCVKLQTVHSIPYTILKNEAEQRP

SEQ ID NO: 44340 - protein, 25 aa, synthetic construct
  source 1..25: note = Seed: NSCVKLQTVHSIPLTINKEEALQRP
NSCVKLQTVHSIPYTILKNEASQRP

SEQ ID NO: 44341 - protein, 25 aa, synthetic construct
  source 1..25: note = Seed: NSCVKLQTVHSIPLTINKEEALQRP
NSCVKLQTVHSIPYTILKSEAAQRP

SEQ ID NO: 44342 - protein, 25 aa, synthetic construct
  source 1..25: note = Seed: NSCVKLQTVHSIPLTINKEEALQRP
NSCVKLQTVHSIPYTILKSEADQRP

SEQ ID NO: 44343 - protein, 25 aa, synthetic construct
  source 1..25: note = Seed: NSCVKLQTVHSIPLTINKEEALQRP
NSCVKLQTVHSIPYTILKSEASQRP

SEQ ID NO: 44344 - protein, 25 aa, synthetic construct
  source 1..25: note = Seed: NSCVKLQTVHSIPLTINKEEALQRP
NSCVKLQTVHSIPYTILKTEAAQRP

SEQ ID NO: 44345 - protein, 25 aa, synthetic construct
  source 1..25: note = Seed: NSCVKLQTVHSIPLTINKEEALQRP
NSCVKLQTVHSIPYTILKTEADQRP

SEQ ID NO: 44346 - protein, 25 aa, synthetic construct
  source 1..25: note = Seed: NSCVKLQTVHSIPLTINKEEALQRP
NSCVKLQTVHSIPYTILKTEAEQRP

SEQ ID NO: 44347 - protein, 25 aa, synthetic construct
  source 1..25: note = Seed: NSCVKLQTVHSIPLTINKEEALQRP
NSCVKLQTVHSIPYTILKTEASQRP

SEQ ID NO: 44348 - protein, 25 aa, synthetic construct
  source 1..25: note = Seed: NSCVKLQTVHSIPLTINKEEALQRP
NSCVKLQTVHSIPYTILKVEAFQRP

SEQ ID NO: 44349 - protein, 25 aa, synthetic construct
  source 1..25: note = Seed: NSCVKLQTVHSIPLTINKEEALQRP
NSCVKLQTVHSIPYTILKVEAIQRP

SEQ ID NO: 44350 - protein, 25 aa, synthetic construct
  source 1..25: note = Seed: NSCVKLQTVHSIPLTINKEEALQRP
NSCVKLQTVHSIPYTILKVEALQRP

SEQ ID NO: 44351 - protein, 25 aa, synthetic construct
  source 1..25: note = Seed: NSCVKLQTVHSIPLTINKEEALQRP
NSCVKLQTVHSIPYTILKVEAVQRP

SEQ ID NO: 44352 - protein, 25 aa, synthetic construct
  source 1..25: note = Seed: NSCVKLQTVHSIPLTINKEEALQRP
NSCVKLQTVHSIPYTILKWEAFQRP

SEQ ID NO: 44353 - protein, 25 aa, synthetic construct
  source 1..25: note = Seed: NSCVKLQTVHSIPLTINKEEALQRP
NSCVKLQTVHSIPYTILKWEAIQRP

SEQ ID NO: 44354 - protein, 25 aa, synthetic construct
  source 1..25: note = Seed: NSCVKLQTVHSIPLTINKEEALQRP
NSCVKLQTVHSIPYTILKWEALQRP

SEQ ID NO: 44355 - protein, 25 aa, synthetic construct
  source 1..25: note = Seed: NSCVKLQTVHSIPLTINKEEALQRP
NSCVKLQTVHSIPYTILKWEAMQRP

SEQ ID NO: 44356 - protein, 25 aa, synthetic construct
  source 1..25: note = Seed: NSCVKLQTVHSIPLTINKEEALQRP
NSCVKLQTVHSIPYTILKWEAVQRP

SEQ ID NO: 44357 - protein, 25 aa, synthetic construct
  source 1..25: note = Seed: NSCVKLQTVHSIPLTINKEEALQRP
NSCVKLQTVHSIPYTILKYEAAQRP

SEQ ID NO: 44358 - protein, 25 aa, synthetic construct
  source 1..25: note = Seed: NSCVKLQTVHSIPLTINKEEALQRP
NSCVKLQTVHSIPYTILKYEAFQRP

SEQ ID NO: 44359 - protein, 25 aa, synthetic construct
  source 1..25: note = Seed: NSCVKLQTVHSIPLTINKEEALQRP
NSCVKLQTVHSIPYTILKYEAIQRP

SEQ ID NO: 44360 - protein, 25 aa, synthetic construct
  source 1..25: note = Seed: NSCVKLQTVHSIPLTINKEEALQRP
NSCVKLQTVHSIPYTILKYEALQRP

SEQ ID NO: 44361 - protein, 25 aa, synthetic construct
  source 1..25: note = Seed: NSCVKLQTVHSIPLTINKEEALQRP
NSCVKLQTVHSIPYTILKYEAMQRP

SEQ ID NO: 44362 - protein, 25 aa, synthetic construct
  source 1..25: note = Seed: NSCVKLQTVHSIPLTINKEEALQRP
NSCVKLQTVHSIPYTILKYEATQRP

SEQ ID NO: 44363 - protein, 25 aa, synthetic construct
  source 1..25: note = Seed: NSCVKLQTVHSIPLTINKEEALQRP
NSCVKLQTVHSIPYTILKYEAVQRP

SEQ ID NO: 44364 - protein, 25 aa, synthetic construct
  source 1..25: note = Seed: NSCVKLQTVHSIPLTINKEEALQRP
NSCVKLQTVHSIPYTILKYEAYQRP

SEQ ID NO: 44365 - protein, 25 aa, synthetic construct
  source 1..25: note = Seed: NSCVKLQTVHSIPLTINKEEALQRP
NSCVKLQTVHSIPYTIMKAEALQRP

SEQ ID NO: 44366 - protein, 25 aa, synthetic construct
  source 1..25: note = Seed: NSCVKLQTVHSIPLTINKEEALQRP
NSCVKLQTVHSIPYTIMKFEAAQRP

SEQ ID NO: 44367 - protein, 25 aa, synthetic construct
  source 1..25: note = Seed: NSCVKLQTVHSIPLTINKEEALQRP
NSCVKLQTVHSIPYTIMKFEADQRP

SEQ ID NO: 44368 - protein, 25 aa, synthetic construct
  source 1..25: note = Seed: NSCVKLQTVHSIPLTINKEEALQRP
NSCVKLQTVHSIPYTIMKFEAEQRP

SEQ ID NO: 44369 - protein, 25 aa, synthetic construct
  source 1..25: note = Seed: NSCVKLQTVHSIPLTINKEEALQRP
NSCVKLQTVHSIPYTIMKFEAFQRP

SEQ ID NO: 44370 - protein, 25 aa, synthetic construct
  source 1..25: note = Seed: NSCVKLQTVHSIPLTINKEEALQRP
NSCVKLQTVHSIPYTIMKFEAIQRP

SEQ ID NO: 44371 - protein, 25 aa, synthetic construct
  source 1..25: note = Seed: NSCVKLQTVHSIPLTINKEEALQRP
NSCVKLQTVHSIPYTIMKFEALQRP

SEQ ID NO: 44372 - protein, 25 aa, synthetic construct
  source 1..25: note = Seed: NSCVKLQTVHSIPLTINKEEALQRP
NSCVKLQTVHSIPYTIMKFEAMQRP

SEQ ID NO: 44373 - protein, 25 aa, synthetic construct
  source 1..25: note = Seed: NSCVKLQTVHSIPLTINKEEALQRP
NSCVKLQTVHSIPYTIMKFEANQRP

SEQ ID NO: 44374 - protein, 25 aa, synthetic construct
  source 1..25: note = Seed: NSCVKLQTVHSIPLTINKEEALQRP
NSCVKLQTVHSIPYTIMKFEARQRP

SEQ ID NO: 44375 - protein, 25 aa, synthetic construct
  source 1..25: note = Seed: NSCVKLQTVHSIPLTINKEEALQRP
NSCVKLQTVHSIPYTIMKFEASQRP

SEQ ID NO: 44376 - protein, 25 aa, synthetic construct
  source 1..25: note = Seed: NSCVKLQTVHSIPLTINKEEALQRP
NSCVKLQTVHSIPYTIMKFEATQRP

SEQ ID NO: 44377 - protein, 25 aa, synthetic construct
  source 1..25: note = Seed: NSCVKLQTVHSIPLTINKEEALQRP
NSCVKLQTVHSIPYTIMKFEAVQRP

SEQ ID NO: 44378 - protein, 25 aa, synthetic construct
  source 1..25: note = Seed: NSCVKLQTVHSIPLTINKEEALQRP
NSCVKLQTVHSIPYTIMKFEAYQRP

SEQ ID NO: 44379 - protein, 25 aa, synthetic construct
  source 1..25: note = Seed: NSCVKLQTVHSIPLTINKEEALQRP
NSCVKLQTVHSIPYTIMKIEAFQRP

SEQ ID NO: 44380 - protein, 25 aa, synthetic construct
  source 1..25: note = Seed: NSCVKLQTVHSIPLTINKEEALQRP
NSCVKLQTVHSIPYTIMKIEAIQRP

SEQ ID NO: 44381 - protein, 25 aa, synthetic construct
  source 1..25: note = Seed: NSCVKLQTVHSIPLTINKEEALQRP
NSCVKLQTVHSIPYTIMKIEALQRP

SEQ ID NO: 44382 - protein, 25 aa, synthetic construct
  source 1..25: note = Seed: NSCVKLQTVHSIPLTINKEEALQRP
NSCVKLQTVHSIPYTIMKIEAVQRP

SEQ ID NO: 44383 - protein, 25 aa, synthetic construct
  source 1..25: note = Seed: NSCVKLQTVHSIPLTINKEEALQRP
NSCVKLQTVHSIPYTIMKLEAFQRP

SEQ ID NO: 44384 - protein, 25 aa, synthetic construct
  source 1..25: note = Seed: NSCVKLQTVHSIPLTINKEEALQRP
NSCVKLQTVHSIPYTIMKLEAIQRP

SEQ ID NO: 44385 - protein, 25 aa, synthetic construct
  source 1..25: note = Seed: NSCVKLQTVHSIPLTINKEEALQRP
NSCVKLQTVHSIPYTIMKLEALQRP

SEQ ID NO: 44386 - protein, 25 aa, synthetic construct
  source 1..25: note = Seed: NSCVKLQTVHSIPLTINKEEALQRP
NSCVKLQTVHSIPYTIMKLEAVQRP

SEQ ID NO: 44387 - protein, 25 aa, synthetic construct
  source 1..25: note = Seed: NSCVKLQTVHSIPLTINKEEALQRP
NSCVKLQTVHSIPYTIMKNEAAQRP

SEQ ID NO: 44388 - protein, 25 aa, synthetic construct
  source 1..25: note = Seed: NSCVKLQTVHSIPLTINKEEALQRP
NSCVKLQTVHSIPYTIMKNEADQRP

SEQ ID NO: 44389 - protein, 25 aa, synthetic construct
  source 1..25: note = Seed: NSCVKLQTVHSIPLTINKEEALQRP
NSCVKLQTVHSIPYTIMKNEAEQRP

SEQ ID NO: 44390 - protein, 25 aa, synthetic construct
  source 1..25: note = Seed: NSCVKLQTVHSIPLTINKEEALQRP
NSCVKLQTVHSIPYTIMKNEALQRP

SEQ ID NO: 44391 - protein, 25 aa, synthetic construct
  source 1..25: note = Seed: NSCVKLQTVHSIPLTINKEEALQRP
NSCVKLQTVHSIPYTIMKNEAMQRP

SEQ ID NO: 44392 - protein, 25 aa, synthetic construct
  source 1..25: note = Seed: NSCVKLQTVHSIPLTINKEEALQRP
NSCVKLQTVHSIPYTIMKNEASQRP

SEQ ID NO: 44393 - protein, 25 aa, synthetic construct
  source 1..25: note = Seed: NSCVKLQTVHSIPLTINKEEALQRP
NSCVKLQTVHSIPYTIMKNEATQRP

SEQ ID NO: 44394 - protein, 25 aa, synthetic construct
  source 1..25: note = Seed: NSCVKLQTVHSIPLTINKEEALQRP
NSCVKLQTVHSIPYTIMKNEAVQRP

SEQ ID NO: 44395 - protein, 25 aa, synthetic construct
  source 1..25: note = Seed: NSCVKLQTVHSIPLTINKEEALQRP
NSCVKLQTVHSIPYTIMKSEAAQRP

SEQ ID NO: 44396 - protein, 25 aa, synthetic construct
  source 1..25: note = Seed: NSCVKLQTVHSIPLTINKEEALQRP
NSCVKLQTVHSIPYTIMKSEADQRP

SEQ ID NO: 44397 - protein, 25 aa, synthetic construct
  source 1..25: note = Seed: NSCVKLQTVHSIPLTINKEEALQRP
NSCVKLQTVHSIPYTIMKSEAEQRP

SEQ ID NO: 44398 - protein, 25 aa, synthetic construct
  source 1..25: note = Seed: NSCVKLQTVHSIPLTINKEEALQRP
NSCVKLQTVHSIPYTIMKSEASQRP

SEQ ID NO: 44399 - protein, 25 aa, synthetic construct
  source 1..25: note = Seed: NSCVKLQTVHSIPLTINKEEALQRP
NSCVKLQTVHSIPYTIMKSEATQRP

SEQ ID NO: 44400 - protein, 25 aa, synthetic construct
  source 1..25: note = Seed: NSCVKLQTVHSIPLTINKEEALQRP
NSCVKLQTVHSIPYTIMKTEAAQRP

SEQ ID NO: 44401 - protein, 25 aa, synthetic construct
  source 1..25: note = Seed: NSCVKLQTVHSIPLTINKEEALQRP
NSCVKLQTVHSIPYTIMKTEADQRP

SEQ ID NO: 44402 - protein, 25 aa, synthetic construct
  source 1..25: note = Seed: NSCVKLQTVHSIPLTINKEEALQRP
NSCVKLQTVHSIPYTIMKTEAEQRP

SEQ ID NO: 44403 - protein, 25 aa, synthetic construct
  source 1..25: note = Seed: NSCVKLQTVHSIPLTINKEEALQRP
NSCVKLQTVHSIPYTIMKTEALQRP

SEQ ID NO: 44404 - protein, 25 aa, synthetic construct
  source 1..25: note = Seed: NSCVKLQTVHSIPLTINKEEALQRP
NSCVKLQTVHSIPYTIMKTEAMQRP

SEQ ID NO: 44405 - protein, 25 aa, synthetic construct
  source 1..25: note = Seed: NSCVKLQTVHSIPLTINKEEALQRP
NSCVKLQTVHSIPYTIMKTEASQRP

SEQ ID NO: 44406 - protein, 25 aa, synthetic construct
  source 1..25: note = Seed: NSCVKLQTVHSIPLTINKEEALQRP
NSCVKLQTVHSIPYTIMKTEATQRP

SEQ ID NO: 44407 - protein, 25 aa, synthetic construct
  source 1..25: note = Seed: NSCVKLQTVHSIPLTINKEEALQRP
NSCVKLQTVHSIPYTIMKTEAVQRP

SEQ ID NO: 44408 - protein, 25 aa, synthetic construct
  source 1..25: note = Seed: NSCVKLQTVHSIPLTINKEEALQRP
NSCVKLQTVHSIPYTIMKVEAAQRP

SEQ ID NO: 44409 - protein, 25 aa, synthetic construct
  source 1..25: note = Seed: NSCVKLQTVHSIPLTINKEEALQRP
NSCVKLQTVHSIPYTIMKVEADQRP

SEQ ID NO: 44410 - protein, 25 aa, synthetic construct
  source 1..25: note = Seed: NSCVKLQTVHSIPLTINKEEALQRP
NSCVKLQTVHSIPYTIMKWEAIQRP

SEQ ID NO: 44411 - protein, 25 aa, synthetic construct
  source 1..25: note = Seed: NSCVKLQTVHSIPLTINKEEALQRP
NSCVKLQTVHSIPYTIMKWEALQRP

SEQ ID NO: 44412 - protein, 25 aa, synthetic construct
  source 1..25: note = Seed: NSCVKLQTVHSIPLTINKEEALQRP
NSCVKLQTVHSIPYTIMKWEAVQRP

SEQ ID NO: 44413 - protein, 25 aa, synthetic construct
  source 1..25: note = Seed: NSCVKLQTVHSIPLTINKEEALQRP
NSCVKLQTVHSIPYTIMKYEAFQRP

SEQ ID NO: 44414 - protein, 25 aa, synthetic construct
  source 1..25: note = Seed: NSCVKLQTVHSIPLTINKEEALQRP
NSCVKLQTVHSIPYTIMKYEAIQRP

SEQ ID NO: 44415 - protein, 25 aa, synthetic construct
  source 1..25: note = Seed: NSCVKLQTVHSIPLTINKEEALQRP
NSCVKLQTVHSIPYTIMKYEALQRP

SEQ ID NO: 44416 - protein, 25 aa, synthetic construct
  source 1..25: note = Seed: NSCVKLQTVHSIPLTINKEEALQRP
NSCVKLQTVHSIPYTIMKYEAVQRP

SEQ ID NO: 44417 - protein, 25 aa, synthetic construct
  source 1..25: note = Seed: NSCVKLQTVHSIPLTINKEEALQRP
NSCVKLQTVHSIPYTINKAEAFQRP

SEQ ID NO: 44418 - protein, 25 aa, synthetic construct
  source 1..25: note = Seed: NSCVKLQTVHSIPLTINKEEALQRP
NSCVKLQTVHSIPYTINKAEAIQRP

SEQ ID NO: 44419 - protein, 25 aa, synthetic construct
  source 1..25: note = Seed: NSCVKLQTVHSIPLTINKEEALQRP
NSCVKLQTVHSIPYTINKAEALQRP

SEQ ID NO: 44420 - protein, 25 aa, synthetic construct
  source 1..25: note = Seed: NSCVKLQTVHSIPLTINKEEALQRP
NSCVKLQTVHSIPYTINKAEAMQRP

SEQ ID NO: 44421 - protein, 25 aa, synthetic construct
  source 1..25: note = Seed: NSCVKLQTVHSIPLTINKEEALQRP
NSCVKLQTVHSIPYTINKAEAVQRP

SEQ ID NO: 44422 - protein, 25 aa, synthetic construct
  source 1..25: note = Seed: NSCVKLQTVHSIPLTINKEEALQRP
NSCVKLQTVHSIPYTINKAEAYQRP

SEQ ID NO: 44423 - protein, 25 aa, synthetic construct
  source 1..25: note = Seed: NSCVKLQTVHSIPLTINKEEALQRP
NSCVKLQTVHSIPYTINKFEAFQRP

SEQ ID NO: 44424 - protein, 25 aa, synthetic construct
  source 1..25: note = Seed: NSCVKLQTVHSIPLTINKEEALQRP
NSCVKLQTVHSIPYTINKFEAIQRP

SEQ ID NO: 44425 - protein, 25 aa, synthetic construct
  source 1..25: note = Seed: NSCVKLQTVHSIPLTINKEEALQRP
NSCVKLQTVHSIPYTINKFEALQRP

SEQ ID NO: 44426 - protein, 25 aa, synthetic construct
  source 1..25: note = Seed: NSCVKLQTVHSIPLTINKEEALQRP
NSCVKLQTVHSIPYTINKFEAMQRP

SEQ ID NO: 44427 - protein, 25 aa, synthetic construct
  source 1..25: note = Seed: NSCVKLQTVHSIPLTINKEEALQRP
NSCVKLQTVHSIPYTINKFEAVQRP

SEQ ID NO: 44428 - protein, 25 aa, synthetic construct
  source 1..25: note = Seed: NSCVKLQTVHSIPLTINKEEALQRP
NSCVKLQTVHSIPYTINKGEAIQRP

SEQ ID NO: 44429 - protein, 25 aa, synthetic construct
  source 1..25: note = Seed: NSCVKLQTVHSIPLTINKEEALQRP
NSCVKLQTVHSIPYTINKGEALQRP

SEQ ID NO: 44430 - protein, 25 aa, synthetic construct
  source 1..25: note = Seed: NSCVKLQTVHSIPLTINKEEALQRP
NSCVKLQTVHSIPYTINKGEAVQRP

SEQ ID NO: 44431 - protein, 25 aa, synthetic construct
  source 1..25: note = Seed: NSCVKLQTVHSIPLTINKEEALQRP
NSCVKLQTVHSIPYTINKIEAFQRP

SEQ ID NO: 44432 - protein, 25 aa, synthetic construct
  source 1..25: note = Seed: NSCVKLQTVHSIPLTINKEEALQRP
NSCVKLQTVHSIPYTINKIEAIQRP

SEQ ID NO: 44433 - protein, 25 aa, synthetic construct
  source 1..25: note = Seed: NSCVKLQTVHSIPLTINKEEALQRP
NSCVKLQTVHSIPYTINKIEALQRP

SEQ ID NO: 44434 - protein, 25 aa, synthetic construct
  source 1..25: note = Seed: NSCVKLQTVHSIPLTINKEEALQRP
NSCVKLQTVHSIPYTINKIEAVQRP

SEQ ID NO: 44435 - protein, 25 aa, synthetic construct
  source 1..25: note = Seed: NSCVKLQTVHSIPLTINKEEALQRP
NSCVKLQTVHSIPYTINKIEAYQRP

SEQ ID NO: 44436 - protein, 25 aa, synthetic construct
  source 1..25: note = Seed: NSCVKLQTVHSIPLTINKEEALQRP
NSCVKLQTVHSIPYTINKLEAIQRP

SEQ ID NO: 44437 - protein, 25 aa, synthetic construct
  source 1..25: note = Seed: NSCVKLQTVHSIPLTINKEEALQRP
NSCVKLQTVHSIPYTINKNEAFQRP

SEQ ID NO: 44438 - protein, 25 aa, synthetic construct
  source 1..25: note = Seed: NSCVKLQTVHSIPLTINKEEALQRP
NSCVKLQTVHSIPYTINKNEAIQRP

SEQ ID NO: 44439 - protein, 25 aa, synthetic construct
  source 1..25: note = Seed: NSCVKLQTVHSIPLTINKEEALQRP
NSCVKLQTVHSIPYTINKNEALQRP

SEQ ID NO: 44440 - protein, 25 aa, synthetic construct
  source 1..25: note = Seed: NSCVKLQTVHSIPLTINKEEALQRP
NSCVKLQTVHSIPYTINKNEAMQRP

SEQ ID NO: 44441 - protein, 25 aa, synthetic construct
  source 1..25: note = Seed: NSCVKLQTVHSIPLTINKEEALQRP
NSCVKLQTVHSIPYTINKNEAVQRP

SEQ ID NO: 44442 - protein, 25 aa, synthetic construct
  source 1..25: note = Seed: NSCVKLQTVHSIPLTINKEEALQRP
NSCVKLQTVHSIPYTINKNEAYQRP

SEQ ID NO: 44443 - protein, 25 aa, synthetic construct
  source 1..25: note = Seed: NSCVKLQTVHSIPLTINKEEALQRP
NSCVKLQTVHSIPYTINKPEAIQRP

SEQ ID NO: 44444 - protein, 25 aa, synthetic construct
  source 1..25: note = Seed: NSCVKLQTVHSIPLTINKEEALQRP
NSCVKLQTVHSIPYTINKPEAVQRP

SEQ ID NO: 44445 - protein, 25 aa, synthetic construct
  source 1..25: note = Seed: NSCVKLQTVHSIPLTINKEEALQRP
NSCVKLQTVHSIPYTINKSEAFQRP

SEQ ID NO: 44446 - protein, 25 aa, synthetic construct
  source 1..25: note = Seed: NSCVKLQTVHSIPLTINKEEALQRP
NSCVKLQTVHSIPYTINKSEAIQRP

SEQ ID NO: 44447 - protein, 25 aa, synthetic construct
  source 1..25: note = Seed: NSCVKLQTVHSIPLTINKEEALQRP
NSCVKLQTVHSIPYTINKSEALQRP

SEQ ID NO: 44448 - protein, 25 aa, synthetic construct
  source 1..25: note = Seed: NSCVKLQTVHSIPLTINKEEALQRP
NSCVKLQTVHSIPYTINKSEAMQRP

SEQ ID NO: 44449 - protein, 25 aa, synthetic construct
  source 1..25: note = Seed: NSCVKLQTVHSIPLTINKEEALQRP
NSCVKLQTVHSIPYTINKSEAVQRP

SEQ ID NO: 44450 - protein, 25 aa, synthetic construct
  source 1..25: note = Seed: NSCVKLQTVHSIPLTINKEEALQRP
NSCVKLQTVHSIPYTINKSEAYQRP

SEQ ID NO: 44451 - protein, 25 aa, synthetic construct
  source 1..25: note = Seed: NSCVKLQTVHSIPLTINKEEALQRP
NSCVKLQTVHSIPYTINKTEAFQRP

SEQ ID NO: 44452 - protein, 25 aa, synthetic construct
  source 1..25: note = Seed: NSCVKLQTVHSIPLTINKEEALQRP
NSCVKLQTVHSIPYTINKTEAIQRP

SEQ ID NO: 44453 - protein, 25 aa, synthetic construct
  source 1..25: note = Seed: NSCVKLQTVHSIPLTINKEEALQRP
NSCVKLQTVHSIPYTINKTEALQRP

SEQ ID NO: 44454 - protein, 25 aa, synthetic construct
  source 1..25: note = Seed: NSCVKLQTVHSIPLTINKEEALQRP
NSCVKLQTVHSIPYTINKTEAVQRP

SEQ ID NO: 44455 - protein, 25 aa, synthetic construct
  source 1..25: note = Seed: NSCVKLQTVHSIPLTINKEEALQRP
NSCVKLQTVHSIPYTINKVEAFQRP

SEQ ID NO: 44456 - protein, 25 aa, synthetic construct
  source 1..25: note = Seed: NSCVKLQTVHSIPLTINKEEALQRP
NSCVKLQTVHSIPYTINKVEAIQRP

SEQ ID NO: 44457 - protein, 25 aa, synthetic construct
  source 1..25: note = Seed: NSCVKLQTVHSIPLTINKEEALQRP
NSCVKLQTVHSIPYTINKVEALQRP

SEQ ID NO: 44458 - protein, 25 aa, synthetic construct
  source 1..25: note = Seed: NSCVKLQTVHSIPLTINKEEALQRP
NSCVKLQTVHSIPYTINKVEAVQRP

SEQ ID NO: 44459 - protein, 25 aa, synthetic construct
  source 1..25: note = Seed: NSCVKLQTVHSIPLTINKEEALQRP
NSCVKLQTVHSIPYTIQKFEAFQRP

SEQ ID NO: 44460 - protein, 25 aa, synthetic construct
  source 1..25: note = Seed: NSCVKLQTVHSIPLTINKEEALQRP
NSCVKLQTVHSIPYTIQKFEAIQRP

SEQ ID NO: 44461 - protein, 25 aa, synthetic construct
  source 1..25: note = Seed: NSCVKLQTVHSIPLTINKEEALQRP
NSCVKLQTVHSIPYTIQKFEALQRP

SEQ ID NO: 44462 - protein, 25 aa, synthetic construct
  source 1..25: note = Seed: NSCVKLQTVHSIPLTINKEEALQRP
NSCVKLQTVHSIPYTIQKFEAMQRP

SEQ ID NO: 44463 - protein, 25 aa, synthetic construct
  source 1..25: note = Seed: NSCVKLQTVHSIPLTINKEEALQRP
NSCVKLQTVHSIPYTIQKFEAVQRP

SEQ ID NO: 44464 - protein, 25 aa, synthetic construct
  source 1..25: note = Seed: NSCVKLQTVHSIPLTINKEEALQRP
NSCVKLQTVHSIPYTIQKNEAAQRP

SEQ ID NO: 44465 - protein, 25 aa, synthetic construct
  source 1..25: note = Seed: NSCVKLQTVHSIPLTINKEEALQRP
NSCVKLQTVHSIPYTIQKSEAAQRP

SEQ ID NO: 44466 - protein, 25 aa, synthetic construct
  source 1..25: note = Seed: NSCVKLQTVHSIPLTINKEEALQRP
NSCVKLQTVHSIPYTIQKTEAAQRP

SEQ ID NO: 44467 - protein, 25 aa, synthetic construct
  source 1..25: note = Seed: NSCVKLQTVHSIPLTINKEEALQRP
NSCVKLQTVHSIPYTIRKFEAIQRP

SEQ ID NO: 44468 - protein, 25 aa, synthetic construct
  source 1..25: note = Seed: NSCVKLQTVHSIPLTINKEEALQRP
NSCVKLQTVHSIPYTIRKFEALQRP

SEQ ID NO: 44469 - protein, 25 aa, synthetic construct
  source 1..25: note = Seed: NSCVKLQTVHSIPLTINKEEALQRP
NSCVKLQTVHSIPYTIRKFEAVQRP

SEQ ID NO: 44470 - protein, 25 aa, synthetic construct
  source 1..25: note = Seed: NSCVKLQTVHSIPLTINKEEALQRP
NSCVKLQTVHSIPYTIRKIEARQRP

SEQ ID NO: 44471 - protein, 25 aa, synthetic construct
  source 1..25: note = Seed: NSCVKLQTVHSIPLTINKEEALQRP
NSCVKLQTVHSIPYTIRKREAFQRP

SEQ ID NO: 44472 - protein, 25 aa, synthetic construct
  source 1..25: note = Seed: NSCVKLQTVHSIPLTINKEEALQRP
NSCVKLQTVHSIPYTIRKREALQRP

SEQ ID NO: 44473 - protein, 25 aa, synthetic construct
  source 1..25: note = Seed: NSCVKLQTVHSIPLTINKEEALQRP
NSCVKLQTVHSIPYTIRKVEAFQRP

SEQ ID NO: 44474 - protein, 25 aa, synthetic construct
  source 1..25: note = Seed: NSCVKLQTVHSIPLTINKEEALQRP
NSCVKLQTVHSIPYTISKFEAAQRP

SEQ ID NO: 44475 - protein, 25 aa, synthetic construct
  source 1..25: note = Seed: NSCVKLQTVHSIPLTINKEEALQRP
NSCVKLQTVHSIPYTISKFEAFQRP

SEQ ID NO: 44476 - protein, 25 aa, synthetic construct
  source 1..25: note = Seed: NSCVKLQTVHSIPLTINKEEALQRP
NSCVKLQTVHSIPYTISKFEAIQRP

SEQ ID NO: 44477 - protein, 25 aa, synthetic construct
  source 1..25: note = Seed: NSCVKLQTVHSIPLTINKEEALQRP
NSCVKLQTVHSIPYTISKFEALQRP

SEQ ID NO: 44478 - protein, 25 aa, synthetic construct
  source 1..25: note = Seed: NSCVKLQTVHSIPLTINKEEALQRP
NSCVKLQTVHSIPYTISKFEAMQRP

SEQ ID NO: 44479 - protein, 25 aa, synthetic construct
  source 1..25: note = Seed: NSCVKLQTVHSIPLTINKEEALQRP
NSCVKLQTVHSIPYTISKFEANQRP

SEQ ID NO: 44480 - protein, 25 aa, synthetic construct
  source 1..25: note = Seed: NSCVKLQTVHSIPLTINKEEALQRP
NSCVKLQTVHSIPYTISKFEASQRP

SEQ ID NO: 44481 - protein, 25 aa, synthetic construct
  source 1..25: note = Seed: NSCVKLQTVHSIPLTINKEEALQRP
NSCVKLQTVHSIPYTISKFEATQRP

SEQ ID NO: 44482 - protein, 25 aa, synthetic construct
  source 1..25: note = Seed: NSCVKLQTVHSIPLTINKEEALQRP
NSCVKLQTVHSIPYTISKFEAVQRP

SEQ ID NO: 44483 - protein, 25 aa, synthetic construct
  source 1..25: note = Seed: NSCVKLQTVHSIPLTINKEEALQRP
NSCVKLQTVHSIPYTISKFEAYQRP

SEQ ID NO: 44484 - protein, 25 aa, synthetic construct
  source 1..25: note = Seed: NSCVKLQTVHSIPLTINKEEALQRP
NSCVKLQTVHSIPYTISKNEAAQRP

SEQ ID NO: 44485 - protein, 25 aa, synthetic construct
  source 1..25: note = Seed: NSCVKLQTVHSIPLTINKEEALQRP
NSCVKLQTVHSIPYTISKWEAIQRP

SEQ ID NO: 44486 - protein, 25 aa, synthetic construct
  source 1..25: note = Seed: NSCVKLQTVHSIPLTINKEEALQRP
NSCVKLQTVHSIPYTISKWEALQRP

SEQ ID NO: 44487 - protein, 25 aa, synthetic construct
  source 1..25: note = Seed: NSCVKLQTVHSIPLTINKEEALQRP
NSCVKLQTVHSIPYTISKWEAVQRP

SEQ ID NO: 44488 - protein, 25 aa, synthetic construct
  source 1..25: note = Seed: NSCVKLQTVHSIPLTINKEEALQRP
NSCVKLQTVHSIPYTISKYEAIQRP

SEQ ID NO: 44489 - protein, 25 aa, synthetic construct
  source 1..25: note = Seed: NSCVKLQTVHSIPLTINKEEALQRP
NSCVKLQTVHSIPYTISKYEALQRP

SEQ ID NO: 44490 - protein, 25 aa, synthetic construct
  source 1..25: note = Seed: NSCVKLQTVHSIPLTINKEEALQRP
NSCVKLQTVHSIPYTISKYEAVQRP

SEQ ID NO: 44491 - protein, 25 aa, synthetic construct
  source 1..25: note = Seed: NSCVKLQTVHSIPLTINKEEALQRP
NSCVKLQTVHSIPYTITKFEAAQRP

SEQ ID NO: 44492 - protein, 25 aa, synthetic construct
  source 1..25: note = Seed: NSCVKLQTVHSIPLTINKEEALQRP
NSCVKLQTVHSIPYTITKFEADQRP

SEQ ID NO: 44493 - protein, 25 aa, synthetic construct
  source 1..25: note = Seed: NSCVKLQTVHSIPLTINKEEALQRP
NSCVKLQTVHSIPYTITKFEAEQRP

SEQ ID NO: 44494 - protein, 25 aa, synthetic construct
  source 1..25: note = Seed: NSCVKLQTVHSIPLTINKEEALQRP
NSCVKLQTVHSIPYTITKFEAFQRP

SEQ ID NO: 44495 - protein, 25 aa, synthetic construct
  source 1..25: note = Seed: NSCVKLQTVHSIPLTINKEEALQRP
NSCVKLQTVHSIPYTITKFEAIQRP

SEQ ID NO: 44496 - protein, 25 aa, synthetic construct
  source 1..25: note = Seed: NSCVKLQTVHSIPLTINKEEALQRP
NSCVKLQTVHSIPYTITKFEALQRP

SEQ ID NO: 44497 - protein, 25 aa, synthetic construct
  source 1..25: note = Seed: NSCVKLQTVHSIPLTINKEEALQRP
NSCVKLQTVHSIPYTITKFEAMQRP

SEQ ID NO: 44498 - protein, 25 aa, synthetic construct
  source 1..25: note = Seed: NSCVKLQTVHSIPLTINKEEALQRP
NSCVKLQTVHSIPYTITKFEANQRP

SEQ ID NO: 44499 - protein, 25 aa, synthetic construct
  source 1..25: note = Seed: NSCVKLQTVHSIPLTINKEEALQRP
NSCVKLQTVHSIPYTITKFEASQRP

SEQ ID NO: 44500 - protein, 25 aa, synthetic construct
  source 1..25: note = Seed: NSCVKLQTVHSIPLTINKEEALQRP
NSCVKLQTVHSIPYTITKFEATQRP

SEQ ID NO: 44501 - protein, 25 aa, synthetic construct
  source 1..25: note = Seed: NSCVKLQTVHSIPLTINKEEALQRP
NSCVKLQTVHSIPYTITKFEAVQRP

SEQ ID NO: 44502 - protein, 25 aa, synthetic construct
  source 1..25: note = Seed: NSCVKLQTVHSIPLTINKEEALQRP
NSCVKLQTVHSIPYTITKFEAYQRP

SEQ ID NO: 44503 - protein, 25 aa, synthetic construct
  source 1..25: note = Seed: NSCVKLQTVHSIPLTINKEEALQRP
NSCVKLQTVHSIPYTITKLEAIQRP

SEQ ID NO: 44504 - protein, 25 aa, synthetic construct
  source 1..25: note = Seed: NSCVKLQTVHSIPLTINKEEALQRP
NSCVKLQTVHSIPYTITKLEALQRP

SEQ ID NO: 44505 - protein, 25 aa, synthetic construct
  source 1..25: note = Seed: NSCVKLQTVHSIPLTINKEEALQRP
NSCVKLQTVHSIPYTITKLEAVQRP

SEQ ID NO: 44506 - protein, 25 aa, synthetic construct
  source 1..25: note = Seed: NSCVKLQTVHSIPLTINKEEALQRP
NSCVKLQTVHSIPYTITKWEAIQRP

SEQ ID NO: 44507 - protein, 25 aa, synthetic construct
  source 1..25: note = Seed: NSCVKLQTVHSIPLTINKEEALQRP
NSCVKLQTVHSIPYTITKWEALQRP

SEQ ID NO: 44508 - protein, 25 aa, synthetic construct
  source 1..25: note = Seed: NSCVKLQTVHSIPLTINKEEALQRP
NSCVKLQTVHSIPYTITKWEAVQRP

SEQ ID NO: 44509 - protein, 25 aa, synthetic construct
  source 1..25: note = Seed: NSCVKLQTVHSIPLTINKEEALQRP
NSCVKLQTVHSIPYTITKYEAFQRP

SEQ ID NO: 44510 - protein, 25 aa, synthetic construct
  source 1..25: note = Seed: NSCVKLQTVHSIPLTINKEEALQRP
NSCVKLQTVHSIPYTITKYEAIQRP

SEQ ID NO: 44511 - protein, 25 aa, synthetic construct
  source 1..25: note = Seed: NSCVKLQTVHSIPLTINKEEALQRP
NSCVKLQTVHSIPYTITKYEALQRP

SEQ ID NO: 44512 - protein, 25 aa, synthetic construct
  source 1..25: note = Seed: NSCVKLQTVHSIPLTINKEEALQRP
NSCVKLQTVHSIPYTITKYEAVQRP

SEQ ID NO: 44513 - protein, 25 aa, synthetic construct
  source 1..25: note = Seed: NSCVKLQTVHSIPLTINKEEALQRP
NSCVKLQTVHSIPYTIVKFEAAQRP

SEQ ID NO: 44514 - protein, 25 aa, synthetic construct
  source 1..25: note = Seed: NSCVKLQTVHSIPLTINKEEALQRP
NSCVKLQTVHSIPYTIVKFEACQRP

SEQ ID NO: 44515 - protein, 25 aa, synthetic construct
  source 1..25: note = Seed: NSCVKLQTVHSIPLTINKEEALQRP
NSCVKLQTVHSIPYTIVKFEADQRP

SEQ ID NO: 44516 - protein, 25 aa, synthetic construct
  source 1..25: note = Seed: NSCVKLQTVHSIPLTINKEEALQRP
NSCVKLQTVHSIPYTIVKFEAEQRP

SEQ ID NO: 44517 - protein, 25 aa, synthetic construct
  source 1..25: note = Seed: NSCVKLQTVHSIPLTINKEEALQRP
NSCVKLQTVHSIPYTIVKFEAFQRP

SEQ ID NO: 44518 - protein, 25 aa, synthetic construct
  source 1..25: note = Seed: NSCVKLQTVHSIPLTINKEEALQRP
NSCVKLQTVHSIPYTIVKFEAGQRP

SEQ ID NO: 44519 - protein, 25 aa, synthetic construct
  source 1..25: note = Seed: NSCVKLQTVHSIPLTINKEEALQRP
NSCVKLQTVHSIPYTIVKFEAHQRP

SEQ ID NO: 44520 - protein, 25 aa, synthetic construct
  source 1..25: note = Seed: NSCVKLQTVHSIPLTINKEEALQRP
NSCVKLQTVHSIPYTIVKFEAIQRP

SEQ ID NO: 44521 - protein, 25 aa, synthetic construct
  source 1..25: note = Seed: NSCVKLQTVHSIPLTINKEEALQRP
NSCVKLQTVHSIPYTIVKFEAKQRP

SEQ ID NO: 44522 - protein, 25 aa, synthetic construct
  source 1..25: note = Seed: NSCVKLQTVHSIPLTINKEEALQRP
NSCVKLQTVHSIPYTIVKFEALQRP

SEQ ID NO: 44523 - protein, 25 aa, synthetic construct
  source 1..25: note = Seed: NSCVKLQTVHSIPLTINKEEALQRP
NSCVKLQTVHSIPYTIVKFEAMQRP

SEQ ID NO: 44524 - protein, 25 aa, synthetic construct
  source 1..25: note = Seed: NSCVKLQTVHSIPLTINKEEALQRP
NSCVKLQTVHSIPYTIVKFEANQRP

SEQ ID NO: 44525 - protein, 25 aa, synthetic construct
  source 1..25: note = Seed: NSCVKLQTVHSIPLTINKEEALQRP
NSCVKLQTVHSIPYTIVKFEAPQRP

SEQ ID NO: 44526 - protein, 25 aa, synthetic construct
  source 1..25: note = Seed: NSCVKLQTVHSIPLTINKEEALQRP
NSCVKLQTVHSIPYTIVKFEAQQRP

SEQ ID NO: 44527 - protein, 25 aa, synthetic construct
  source 1..25: note = Seed: NSCVKLQTVHSIPLTINKEEALQRP
NSCVKLQTVHSIPYTIVKFEARQRP

SEQ ID NO: 44528 - protein, 25 aa, synthetic construct
  source 1..25: note = Seed: NSCVKLQTVHSIPLTINKEEALQRP
NSCVKLQTVHSIPYTIVKFEASQRP

SEQ ID NO: 44529 - protein, 25 aa, synthetic construct
  source 1..25: note = Seed: NSCVKLQTVHSIPLTINKEEALQRP
NSCVKLQTVHSIPYTIVKFEATQRP

SEQ ID NO: 44530 - protein, 25 aa, synthetic construct
  source 1..25: note = Seed: NSCVKLQTVHSIPLTINKEEALQRP
NSCVKLQTVHSIPYTIVKFEAVQRP

SEQ ID NO: 44531 - protein, 25 aa, synthetic construct
  source 1..25: note = Seed: NSCVKLQTVHSIPLTINKEEALQRP
NSCVKLQTVHSIPYTIVKFEAWQRP

SEQ ID NO: 44532 - protein, 25 aa, synthetic construct
  source 1..25: note = Seed: NSCVKLQTVHSIPLTINKEEALQRP
NSCVKLQTVHSIPYTIVKFEAYQRP

SEQ ID NO: 44533 - protein, 25 aa, synthetic construct
  source 1..25: note = Seed: NSCVKLQTVHSIPLTINKEEALQRP
NSCVKLQTVHSIPYTIVKIEAFQRP

SEQ ID NO: 44534 - protein, 25 aa, synthetic construct
  source 1..25: note = Seed: NSCVKLQTVHSIPLTINKEEALQRP
NSCVKLQTVHSIPYTIVKIEAIQRP

SEQ ID NO: 44535 - protein, 25 aa, synthetic construct
  source 1..25: note = Seed: NSCVKLQTVHSIPLTINKEEALQRP
NSCVKLQTVHSIPYTIVKIEALQRP

SEQ ID NO: 44536 - protein, 25 aa, synthetic construct
  source 1..25: note = Seed: NSCVKLQTVHSIPLTINKEEALQRP
NSCVKLQTVHSIPYTIVKIEAVQRP

SEQ ID NO: 44537 - protein, 25 aa, synthetic construct
  source 1..25: note = Seed: NSCVKLQTVHSIPLTINKEEALQRP
NSCVKLQTVHSIPYTIVKLEAFQRP

SEQ ID NO: 44538 - protein, 25 aa, synthetic construct
  source 1..25: note = Seed: NSCVKLQTVHSIPLTINKEEALQRP
NSCVKLQTVHSIPYTIVKLEAIQRP

SEQ ID NO: 44539 - protein, 25 aa, synthetic construct
  source 1..25: note = Seed: NSCVKLQTVHSIPLTINKEEALQRP
NSCVKLQTVHSIPYTIVKLEALQRP

SEQ ID NO: 44540 - protein, 25 aa, synthetic construct
  source 1..25: note = Seed: NSCVKLQTVHSIPLTINKEEALQRP
NSCVKLQTVHSIPYTIVKLEAMQRP

SEQ ID NO: 44541 - protein, 25 aa, synthetic construct
  source 1..25: note = Seed: NSCVKLQTVHSIPLTINKEEALQRP
NSCVKLQTVHSIPYTIVKLEAVQRP

SEQ ID NO: 44542 - protein, 25 aa, synthetic construct
  source 1..25: note = Seed: NSCVKLQTVHSIPLTINKEEALQRP
NSCVKLQTVHSIPYTIVKLEAYQRP

SEQ ID NO: 44543 - protein, 25 aa, synthetic construct
  source 1..25: note = Seed: NSCVKLQTVHSIPLTINKEEALQRP
NSCVKLQTVHSIPYTIVKMEAFQRP

SEQ ID NO: 44544 - protein, 25 aa, synthetic construct
  source 1..25: note = Seed: NSCVKLQTVHSIPLTINKEEALQRP
NSCVKLQTVHSIPYTIVKMEAIQRP

SEQ ID NO: 44545 - protein, 25 aa, synthetic construct
  source 1..25: note = Seed: NSCVKLQTVHSIPLTINKEEALQRP
NSCVKLQTVHSIPYTIVKMEALQRP

SEQ ID NO: 44546 - protein, 25 aa, synthetic construct
  source 1..25: note = Seed: NSCVKLQTVHSIPLTINKEEALQRP
NSCVKLQTVHSIPYTIVKMEAVQRP

SEQ ID NO: 44547 - protein, 25 aa, synthetic construct
  source 1..25: note = Seed: NSCVKLQTVHSIPLTINKEEALQRP
NSCVKLQTVHSIPYTIVKNEAAQRP

SEQ ID NO: 44548 - protein, 25 aa, synthetic construct
  source 1..25: note = Seed: NSCVKLQTVHSIPLTINKEEALQRP
NSCVKLQTVHSIPYTIVKNEASQRP

SEQ ID NO: 44549 - protein, 25 aa, synthetic construct
  source 1..25: note = Seed: NSCVKLQTVHSIPLTINKEEALQRP
NSCVKLQTVHSIPYTIVKSEAAQRP

SEQ ID NO: 44550 - protein, 25 aa, synthetic construct
  source 1..25: note = Seed: NSCVKLQTVHSIPLTINKEEALQRP
NSCVKLQTVHSIPYTIVKTEAAQRP

SEQ ID NO: 44551 - protein, 25 aa, synthetic construct
  source 1..25: note = Seed: NSCVKLQTVHSIPLTINKEEALQRP
NSCVKLQTVHSIPYTIVKTEASQRP

SEQ ID NO: 44552 - protein, 25 aa, synthetic construct
  source 1..25: note = Seed: NSCVKLQTVHSIPLTINKEEALQRP
NSCVKLQTVHSIPYTIVKVEAIQRP

SEQ ID NO: 44553 - protein, 25 aa, synthetic construct
  source 1..25: note = Seed: NSCVKLQTVHSIPLTINKEEALQRP
NSCVKLQTVHSIPYTIVKVEAVQRP

SEQ ID NO: 44554 - protein, 25 aa, synthetic construct
  source 1..25: note = Seed: NSCVKLQTVHSIPLTINKEEALQRP
NSCVKLQTVHSIPYTIVKWEAFQRP

SEQ ID NO: 44555 - protein, 25 aa, synthetic construct
  source 1..25: note = Seed: NSCVKLQTVHSIPLTINKEEALQRP
NSCVKLQTVHSIPYTIVKWEAIQRP

SEQ ID NO: 44556 - protein, 25 aa, synthetic construct
  source 1..25: note = Seed: NSCVKLQTVHSIPLTINKEEALQRP
NSCVKLQTVHSIPYTIVKWEALQRP

SEQ ID NO: 44557 - protein, 25 aa, synthetic construct
  source 1..25: note = Seed: NSCVKLQTVHSIPLTINKEEALQRP
NSCVKLQTVHSIPYTIVKWEAMQRP

SEQ ID NO: 44558 - protein, 25 aa, synthetic construct
  source 1..25: note = Seed: NSCVKLQTVHSIPLTINKEEALQRP
NSCVKLQTVHSIPYTIVKWEAVQRP

SEQ ID NO: 44559 - protein, 25 aa, synthetic construct
  source 1..25: note = Seed: NSCVKLQTVHSIPLTINKEEALQRP
NSCVKLQTVHSIPYTIVKWEAYQRP

SEQ ID NO: 44560 - protein, 25 aa, synthetic construct
  source 1..25: note = Seed: NSCVKLQTVHSIPLTINKEEALQRP
NSCVKLQTVHSIPYTIVKYEAFQRP

SEQ ID NO: 44561 - protein, 25 aa, synthetic construct
  source 1..25: note = Seed: NSCVKLQTVHSIPLTINKEEALQRP
NSCVKLQTVHSIPYTIVKYEAIQRP

SEQ ID NO: 44562 - protein, 25 aa, synthetic construct
  source 1..25: note = Seed: NSCVKLQTVHSIPLTINKEEALQRP
NSCVKLQTVHSIPYTIVKYEALQRP

SEQ ID NO: 44563 - protein, 25 aa, synthetic construct
  source 1..25: note = Seed: NSCVKLQTVHSIPLTINKEEALQRP
NSCVKLQTVHSIPYTIVKYEAMQRP

SEQ ID NO: 44564 - protein, 25 aa, synthetic construct
  source 1..25: note = Seed: NSCVKLQTVHSIPLTINKEEALQRP
NSCVKLQTVHSIPYTIVKYEAVQRP

SEQ ID NO: 44565 - protein, 25 aa, synthetic construct
  source 1..25: note = Seed: NSCVKLQTVHSIPLTINKEEALQRP
NSCVKLQTVHSIPYTIVKYEAYQRP

SEQ ID NO: 44566 - protein, 25 aa, synthetic construct
  source 1..25: note = Seed: NSCVKLQTVHSIPLTINKEEALQRP
NSCVKLQTVHSIPYTIWKFEAFQRP

SEQ ID NO: 44567 - protein, 25 aa, synthetic construct
  source 1..25: note = Seed: NSCVKLQTVHSIPLTINKEEALQRP
NSCVKLQTVHSIPYTIWKFEAIQRP

SEQ ID NO: 44568 - protein, 25 aa, synthetic construct
  source 1..25: note = Seed: NSCVKLQTVHSIPLTINKEEALQRP
NSCVKLQTVHSIPYTIWKFEALQRP

SEQ ID NO: 44569 - protein, 25 aa, synthetic construct
  source 1..25: note = Seed: NSCVKLQTVHSIPLTINKEEALQRP
NSCVKLQTVHSIPYTIWKFEAMQRP

SEQ ID NO: 44570 - protein, 25 aa, synthetic construct
  source 1..25: note = Seed: NSCVKLQTVHSIPLTINKEEALQRP
NSCVKLQTVHSIPYTIWKFEAVQRP

SEQ ID NO: 44571 - protein, 25 aa, synthetic construct
  source 1..25: note = Seed: NSCVKLQTVHSIPLTINKEEALQRP
NSCVKLQTVHSIPYTIWKFEAYQRP

SEQ ID NO: 44572 - protein, 25 aa, synthetic construct
  source 1..25: note = Seed: NSCVKLQTVHSIPLTINKEEALQRP
NSCVKLQTVHSIPYTIWKIEAIQRP

SEQ ID NO: 44573 - protein, 25 aa, synthetic construct
  source 1..25: note = Seed: NSCVKLQTVHSIPLTINKEEALQRP
NSCVKLQTVHSIPYTIWKIEAVQRP

SEQ ID NO: 44574 - protein, 25 aa, synthetic construct
  source 1..25: note = Seed: NSCVKLQTVHSIPLTINKEEALQRP
NSCVKLQTVHSIPYTIWKLEAFQRP

SEQ ID NO: 44575 - protein, 25 aa, synthetic construct
  source 1..25: note = Seed: NSCVKLQTVHSIPLTINKEEALQRP
NSCVKLQTVHSIPYTIWKYEAFQRP

SEQ ID NO: 44576 - protein, 25 aa, synthetic construct
  source 1..25: note = Seed: NSCVKLQTVHSIPLTINKEEALQRP
NSCVKLQTVHSIPYTIWKYEALQRP

SEQ ID NO: 44577 - protein, 25 aa, synthetic construct
  source 1..25: note = Seed: NSCVKLQTVHSIPLTINKEEALQRP
NSCVKLQTVHSIPYTIYKAEAIQRP

SEQ ID NO: 44578 - protein, 25 aa, synthetic construct
  source 1..25: note = Seed: NSCVKLQTVHSIPLTINKEEALQRP
NSCVKLQTVHSIPYTIYKAEAVQRP

SEQ ID NO: 44579 - protein, 25 aa, synthetic construct
  source 1..25: note = Seed: NSCVKLQTVHSIPLTINKEEALQRP
NSCVKLQTVHSIPYTIYKDEAAQRP

SEQ ID NO: 44580 - protein, 25 aa, synthetic construct
  source 1..25: note = Seed: NSCVKLQTVHSIPLTINKEEALQRP
NSCVKLQTVHSIPYTIYKDEAIQRP

SEQ ID NO: 44581 - protein, 25 aa, synthetic construct
  source 1..25: note = Seed: NSCVKLQTVHSIPLTINKEEALQRP
NSCVKLQTVHSIPYTIYKDEAVQRP

SEQ ID NO: 44582 - protein, 25 aa, synthetic construct
  source 1..25: note = Seed: NSCVKLQTVHSIPLTINKEEALQRP
NSCVKLQTVHSIPYTIYKFEAAQRP

SEQ ID NO: 44583 - protein, 25 aa, synthetic construct
  source 1..25: note = Seed: NSCVKLQTVHSIPLTINKEEALQRP
NSCVKLQTVHSIPYTIYKFEAFQRP

SEQ ID NO: 44584 - protein, 25 aa, synthetic construct
  source 1..25: note = Seed: NSCVKLQTVHSIPLTINKEEALQRP
NSCVKLQTVHSIPYTIYKFEAIQRP

SEQ ID NO: 44585 - protein, 25 aa, synthetic construct
  source 1..25: note = Seed: NSCVKLQTVHSIPLTINKEEALQRP
NSCVKLQTVHSIPYTIYKFEALQRP

SEQ ID NO: 44586 - protein, 25 aa, synthetic construct
  source 1..25: note = Seed: NSCVKLQTVHSIPLTINKEEALQRP
NSCVKLQTVHSIPYTIYKFEAMQRP

SEQ ID NO: 44587 - protein, 25 aa, synthetic construct
  source 1..25: note = Seed: NSCVKLQTVHSIPLTINKEEALQRP
NSCVKLQTVHSIPYTIYKFEAVQRP

SEQ ID NO: 44588 - protein, 25 aa, synthetic construct
  source 1..25: note = Seed: NSCVKLQTVHSIPLTINKEEALQRP
NSCVKLQTVHSIPYTIYKFEAYQRP

SEQ ID NO: 44589 - protein, 25 aa, synthetic construct
  source 1..25: note = Seed: NSCVKLQTVHSIPLTINKEEALQRP
NSCVKLQTVHSIPYTIYKIEAFQRP

SEQ ID NO: 44590 - protein, 25 aa, synthetic construct
  source 1..25: note = Seed: NSCVKLQTVHSIPLTINKEEALQRP
NSCVKLQTVHSIPYTIYKIEAIQRP

SEQ ID NO: 44591 - protein, 25 aa, synthetic construct
  source 1..25: note = Seed: NSCVKLQTVHSIPLTINKEEALQRP
NSCVKLQTVHSIPYTIYKIEALQRP

SEQ ID NO: 44592 - protein, 25 aa, synthetic construct
  source 1..25: note = Seed: NSCVKLQTVHSIPLTINKEEALQRP
NSCVKLQTVHSIPYTIYKIEAVQRP

SEQ ID NO: 44593 - protein, 25 aa, synthetic construct
  source 1..25: note = Seed: NSCVKLQTVHSIPLTINKEEALQRP
NSCVKLQTVHSIPYTIYKLEAFQRP

SEQ ID NO: 44594 - protein, 25 aa, synthetic construct
  source 1..25: note = Seed: NSCVKLQTVHSIPLTINKEEALQRP
NSCVKLQTVHSIPYTIYKLEAIQRP

SEQ ID NO: 44595 - protein, 25 aa, synthetic construct
  source 1..25: note = Seed: NSCVKLQTVHSIPLTINKEEALQRP
NSCVKLQTVHSIPYTIYKLEALQRP

SEQ ID NO: 44596 - protein, 25 aa, synthetic construct
  source 1..25: note = Seed: NSCVKLQTVHSIPLTINKEEALQRP
NSCVKLQTVHSIPYTIYKLEAVQRP

SEQ ID NO: 44597 - protein, 25 aa, synthetic construct
  source 1..25: note = Seed: NSCVKLQTVHSIPLTINKEEALQRP
NSCVKLQTVHSIPYTIYKWEAFQRP

SEQ ID NO: 44598 - protein, 25 aa, synthetic construct
  source 1..25: note = Seed: NSCVKLQTVHSIPLTINKEEALQRP
NSCVKLQTVHSIPYTIYKYEAFQRP

SEQ ID NO: 44599 - protein, 25 aa, synthetic construct
  source 1..25: note = Seed: NSCVKLQTVHSIPLTINKEEALQRP
NSCVKLQTVHSIPYTIYKYEAIQRP

SEQ ID NO: 44600 - protein, 25 aa, synthetic construct
  source 1..25: note = Seed: NSCVKLQTVHSIPLTINKEEALQRP
NSCVKLQTVHSIPYTIYKYEALQRP

SEQ ID NO: 44601 - protein, 25 aa, synthetic construct
  source 1..25: note = Seed: NSCVKLQTVHSIPLTINKEEALQRP
NSCVKLQTVHSIPYTIYKYEAVQRP

SEQ ID NO: 44602 - protein, 25 aa, synthetic construct
  source 1..25: note = Seed: QTVHSIPLTINKEEALQRPVASDFE
QTVHSIPLTINKEFALARAVAADFE

SEQ ID NO: 44603 - protein, 25 aa, synthetic construct
  source 1..25: note = Seed: QTVHSIPLTINKEEALQRPVASDFE
QTVHSIPLTINKEFALARAVACDFE

SEQ ID NO: 44604 - protein, 25 aa, synthetic construct
  source 1..25: note = Seed: QTVHSIPLTINKEEALQRPVASDFE
QTVHSIPLTINKEFALARAVADDFE

SEQ ID NO: 44605 - protein, 25 aa, synthetic construct
  source 1..25: note = Seed: QTVHSIPLTINKEEALQRPVASDFE
QTVHSIPLTINKEFALARAVAEDFE

SEQ ID NO: 44606 - protein, 25 aa, synthetic construct
  source 1..25: note = Seed: QTVHSIPLTINKEEALQRPVASDFE
QTVHSIPLTINKEFALARAVAFDFE

SEQ ID NO: 44607 - protein, 25 aa, synthetic construct
  source 1..25: note = Seed: QTVHSIPLTINKEEALQRPVASDFE
QTVHSIPLTINKEFALARAVAGDFE

SEQ ID NO: 44608 - protein, 25 aa, synthetic construct
  source 1..25: note = Seed: QTVHSIPLTINKEEALQRPVASDFE
QTVHSIPLTINKEFALARAVAHDFE

SEQ ID NO: 44609 - protein, 25 aa, synthetic construct
  source 1..25: note = Seed: QTVHSIPLTINKEEALQRPVASDFE
QTVHSIPLTINKEFALARAVAIDFE

SEQ ID NO: 44610 - protein, 25 aa, synthetic construct
  source 1..25: note = Seed: QTVHSIPLTINKEEALQRPVASDFE
QTVHSIPLTINKEFALARAVAKDFE

SEQ ID NO: 44611 - protein, 25 aa, synthetic construct
  source 1..25: note = Seed: QTVHSIPLTINKEEALQRPVASDFE
QTVHSIPLTINKEFALARAVALDFE

SEQ ID NO: 44612 - protein, 25 aa, synthetic construct
  source 1..25: note = Seed: QTVHSIPLTINKEEALQRPVASDFE
QTVHSIPLTINKEFALARAVAMDFE

SEQ ID NO: 44613 - protein, 25 aa, synthetic construct
  source 1..25: note = Seed: QTVHSIPLTINKEEALQRPVASDFE
QTVHSIPLTINKEFALARAVANDFE

SEQ ID NO: 44614 - protein, 25 aa, synthetic construct
  source 1..25: note = Seed: QTVHSIPLTINKEEALQRPVASDFE
QTVHSIPLTINKEFALARAVAPDFE

SEQ ID NO: 44615 - protein, 25 aa, synthetic construct
  source 1..25: note = Seed: QTVHSIPLTINKEEALQRPVASDFE
QTVHSIPLTINKEFALARAVAQDFE

SEQ ID NO: 44616 - protein, 25 aa, synthetic construct
  source 1..25: note = Seed: QTVHSIPLTINKEEALQRPVASDFE
QTVHSIPLTINKEFALARAVARDFE

SEQ ID NO: 44617 - protein, 25 aa, synthetic construct
  source 1..25: note = Seed: QTVHSIPLTINKEEALQRPVASDFE
QTVHSIPLTINKEFALARAVASDFE

SEQ ID NO: 44618 - protein, 25 aa, synthetic construct
  source 1..25: note = Seed: QTVHSIPLTINKEEALQRPVASDFE
QTVHSIPLTINKEFALARAVATDFE

SEQ ID NO: 44619 - protein, 25 aa, synthetic construct
  source 1..25: note = Seed: QTVHSIPLTINKEEALQRPVASDFE
QTVHSIPLTINKEFALARAVAVDFE

SEQ ID NO: 44620 - protein, 25 aa, synthetic construct
  source 1..25: note = Seed: QTVHSIPLTINKEEALQRPVASDFE
QTVHSIPLTINKEFALARAVAWDFE

SEQ ID NO: 44621 - protein, 25 aa, synthetic construct
  source 1..25: note = Seed: QTVHSIPLTINKEEALQRPVASDFE
QTVHSIPLTINKEFALARAVAYDFE

SEQ ID NO: 44622 - protein, 25 aa, synthetic construct
  source 1..25: note = Seed: QTVHSIPLTINKEEALQRPVASDFE
QTVHSIPLTINKEFALARCVAADFE

SEQ ID NO: 44623 - protein, 25 aa, synthetic construct
  source 1..25: note = Seed: QTVHSIPLTINKEEALQRPVASDFE
QTVHSIPLTINKEFALARCVANDFE

SEQ ID NO: 44624 - protein, 25 aa, synthetic construct
  source 1..25: note = Seed: QTVHSIPLTINKEEALQRPVASDFE
QTVHSIPLTINKEFALARCVASDFE

SEQ ID NO: 44625 - protein, 25 aa, synthetic construct
  source 1..25: note = Seed: QTVHSIPLTINKEEALQRPVASDFE
QTVHSIPLTINKEFALARDVAADFE

SEQ ID NO: 44626 - protein, 25 aa, synthetic construct
  source 1..25: note = Seed: QTVHSIPLTINKEEALQRPVASDFE
QTVHSIPLTINKEFALARDVAIDFE

SEQ ID NO: 44627 - protein, 25 aa, synthetic construct
  source 1..25: note = Seed: QTVHSIPLTINKEEALQRPVASDFE
QTVHSIPLTINKEFALARDVANDFE

SEQ ID NO: 44628 - protein, 25 aa, synthetic construct
  source 1..25: note = Seed: QTVHSIPLTINKEEALQRPVASDFE
QTVHSIPLTINKEFALARDVASDFE

SEQ ID NO: 44629 - protein, 25 aa, synthetic construct
  source 1..25: note = Seed: QTVHSIPLTINKEEALQRPVASDFE
QTVHSIPLTINKEFALARDVATDFE

SEQ ID NO: 44630 - protein, 25 aa, synthetic construct
  source 1..25: note = Seed: QTVHSIPLTINKEEALQRPVASDFE
QTVHSIPLTINKEFALARDVAVDFE

SEQ ID NO: 44631 - protein, 25 aa, synthetic construct
  source 1..25: note = Seed: QTVHSIPLTINKEEALQRPVASDFE
QTVHSIPLTINKEFALAREVAADFE

SEQ ID NO: 44632 - protein, 25 aa, synthetic construct
  source 1..25: note = Seed: QTVHSIPLTINKEEALQRPVASDFE
QTVHSIPLTINKEFALAREVANDFE

SEQ ID NO: 44633 - protein, 25 aa, synthetic construct
  source 1..25: note = Seed: QTVHSIPLTINKEEALQRPVASDFE
QTVHSIPLTINKEFALAREVASDFE

SEQ ID NO: 44634 - protein, 25 aa, synthetic construct
  source 1..25: note = Seed: QTVHSIPLTINKEEALQRPVASDFE
QTVHSIPLTINKEFALAREVATDFE

SEQ ID NO: 44635 - protein, 25 aa, synthetic construct
  source 1..25: note = Seed: QTVHSIPLTINKEEALQRPVASDFE
QTVHSIPLTINKEFALAREVAVDFE

SEQ ID NO: 44636 - protein, 25 aa, synthetic construct
  source 1..25: note = Seed: QTVHSIPLTINKEEALQRPVASDFE
QTVHSIPLTINKEFALARFVANDFE

SEQ ID NO: 44637 - protein, 25 aa, synthetic construct
  source 1..25: note = Seed: QTVHSIPLTINKEEALQRPVASDFE
QTVHSIPLTINKEFALARGVAADFE

SEQ ID NO: 44638 - protein, 25 aa, synthetic construct
  source 1..25: note = Seed: QTVHSIPLTINKEEALQRPVASDFE
QTVHSIPLTINKEFALARGVACDFE

SEQ ID NO: 44639 - protein, 25 aa, synthetic construct
  source 1..25: note = Seed: QTVHSIPLTINKEEALQRPVASDFE
QTVHSIPLTINKEFALARGVADDFE

SEQ ID NO: 44640 - protein, 25 aa, synthetic construct
  source 1..25: note = Seed: QTVHSIPLTINKEEALQRPVASDFE
QTVHSIPLTINKEFALARGVAEDFE

SEQ ID NO: 44641 - protein, 25 aa, synthetic construct
  source 1..25: note = Seed: QTVHSIPLTINKEEALQRPVASDFE
QTVHSIPLTINKEFALARGVAFDFE

SEQ ID NO: 44642 - protein, 25 aa, synthetic construct
  source 1..25: note = Seed: QTVHSIPLTINKEEALQRPVASDFE
QTVHSIPLTINKEFALARGVAGDFE

SEQ ID NO: 44643 - protein, 25 aa, synthetic construct
  source 1..25: note = Seed: QTVHSIPLTINKEEALQRPVASDFE
QTVHSIPLTINKEFALARGVAHDFE

SEQ ID NO: 44644 - protein, 25 aa, synthetic construct
  source 1..25: note = Seed: QTVHSIPLTINKEEALQRPVASDFE
QTVHSIPLTINKEFALARGVAIDFE

SEQ ID NO: 44645 - protein, 25 aa, synthetic construct
  source 1..25: note = Seed: QTVHSIPLTINKEEALQRPVASDFE
QTVHSIPLTINKEFALARGVALDFE

SEQ ID NO: 44646 - protein, 25 aa, synthetic construct
  source 1..25: note = Seed: QTVHSIPLTINKEEALQRPVASDFE
QTVHSIPLTINKEFALARGVAMDFE

SEQ ID NO: 44647 - protein, 25 aa, synthetic construct
  source 1..25: note = Seed: QTVHSIPLTINKEEALQRPVASDFE
QTVHSIPLTINKEFALARGVANDFE

SEQ ID NO: 44648 - protein, 25 aa, synthetic construct
  source 1..25: note = Seed: QTVHSIPLTINKEEALQRPVASDFE
QTVHSIPLTINKEFALARGVAPDFE

SEQ ID NO: 44649 - protein, 25 aa, synthetic construct
  source 1..25: note = Seed: QTVHSIPLTINKEEALQRPVASDFE
QTVHSIPLTINKEFALARGVAQDFE

SEQ ID NO: 44650 - protein, 25 aa, synthetic construct
  source 1..25: note = Seed: QTVHSIPLTINKEEALQRPVASDFE
QTVHSIPLTINKEFALARGVASDFE

SEQ ID NO: 44651 - protein, 25 aa, synthetic construct
  source 1..25: note = Seed: QTVHSIPLTINKEEALQRPVASDFE
QTVHSIPLTINKEFALARGVATDFE

SEQ ID NO: 44652 - protein, 25 aa, synthetic construct
  source 1..25: note = Seed: QTVHSIPLTINKEEALQRPVASDFE
QTVHSIPLTINKEFALARGVAVDFE

SEQ ID NO: 44653 - protein, 25 aa, synthetic construct
  source 1..25: note = Seed: QTVHSIPLTINKEEALQRPVASDFE
QTVHSIPLTINKEFALARGVAYDFE

SEQ ID NO: 44654 - protein, 25 aa, synthetic construct
  source 1..25: note = Seed: QTVHSIPLTINKEEALQRPVASDFE
QTVHSIPLTINKEFALARHVAADFE

SEQ ID NO: 44655 - protein, 25 aa, synthetic construct
  source 1..25: note = Seed: QTVHSIPLTINKEEALQRPVASDFE
QTVHSIPLTINKEFALARHVAGDFE

SEQ ID NO: 44656 - protein, 25 aa, synthetic construct
  source 1..25: note = Seed: QTVHSIPLTINKEEALQRPVASDFE
QTVHSIPLTINKEFALARHVAHDFE

SEQ ID NO: 44657 - protein, 25 aa, synthetic construct
  source 1..25: note = Seed: QTVHSIPLTINKEEALQRPVASDFE
QTVHSIPLTINKEFALARHVAIDFE

SEQ ID NO: 44658 - protein, 25 aa, synthetic construct
  source 1..25: note = Seed: QTVHSIPLTINKEEALQRPVASDFE
QTVHSIPLTINKEFALARHVALDFE

SEQ ID NO: 44659 - protein, 25 aa, synthetic construct
  source 1..25: note = Seed: QTVHSIPLTINKEEALQRPVASDFE
QTVHSIPLTINKEFALARHVAMDFE

SEQ ID NO: 44660 - protein, 25 aa, synthetic construct
  source 1..25: note = Seed: QTVHSIPLTINKEEALQRPVASDFE
QTVHSIPLTINKEFALARHVANDFE

SEQ ID NO: 44661 - protein, 25 aa, synthetic construct
  source 1..25: note = Seed: QTVHSIPLTINKEEALQRPVASDFE
QTVHSIPLTINKEFALARHVASDFE

SEQ ID NO: 44662 - protein, 25 aa, synthetic construct
  source 1..25: note = Seed: QTVHSIPLTINKEEALQRPVASDFE
QTVHSIPLTINKEFALARHVATDFE

SEQ ID NO: 44663 - protein, 25 aa, synthetic construct
  source 1..25: note = Seed: QTVHSIPLTINKEEALQRPVASDFE
QTVHSIPLTINKEFALARHVAVDFE

SEQ ID NO: 44664 - protein, 25 aa, synthetic construct
  source 1..25: note = Seed: QTVHSIPLTINKEEALQRPVASDFE
QTVHSIPLTINKEFALARIVAADFE

SEQ ID NO: 44665 - protein, 25 aa, synthetic construct
  source 1..25: note = Seed: QTVHSIPLTINKEEALQRPVASDFE
QTVHSIPLTINKEFALARIVADDFE

SEQ ID NO: 44666 - protein, 25 aa, synthetic construct
  source 1..25: note = Seed: QTVHSIPLTINKEEALQRPVASDFE
QTVHSIPLTINKEFALARIVAEDFE

SEQ ID NO: 44667 - protein, 25 aa, synthetic construct
  source 1..25: note = Seed: QTVHSIPLTINKEEALQRPVASDFE
QTVHSIPLTINKEFALARIVAGDFE

SEQ ID NO: 44668 - protein, 25 aa, synthetic construct
  source 1..25: note = Seed: QTVHSIPLTINKEEALQRPVASDFE
QTVHSIPLTINKEFALARIVAHDFE

SEQ ID NO: 44669 - protein, 25 aa, synthetic construct
  source 1..25: note = Seed: QTVHSIPLTINKEEALQRPVASDFE
QTVHSIPLTINKEFALARIVAIDFE

SEQ ID NO: 44670 - protein, 25 aa, synthetic construct
  source 1..25: note = Seed: QTVHSIPLTINKEEALQRPVASDFE
QTVHSIPLTINKEFALARIVAKDFE

SEQ ID NO: 44671 - protein, 25 aa, synthetic construct
  source 1..25: note = Seed: QTVHSIPLTINKEEALQRPVASDFE
QTVHSIPLTINKEFALARIVALDFE

SEQ ID NO: 44672 - protein, 25 aa, synthetic construct
  source 1..25: note = Seed: QTVHSIPLTINKEEALQRPVASDFE
QTVHSIPLTINKEFALARIVAMDFE

SEQ ID NO: 44673 - protein, 25 aa, synthetic construct
  source 1..25: note = Seed: QTVHSIPLTINKEEALQRPVASDFE
QTVHSIPLTINKEFALARIVANDFE

SEQ ID NO: 44674 - protein, 25 aa, synthetic construct
  source 1..25: note = Seed: QTVHSIPLTINKEEALQRPVASDFE
QTVHSIPLTINKEFALARIVAPDFE

SEQ ID NO: 44675 - protein, 25 aa, synthetic construct
  source 1..25: note = Seed: QTVHSIPLTINKEEALQRPVASDFE
QTVHSIPLTINKEFALARIVAQDFE

SEQ ID NO: 44676 - protein, 25 aa, synthetic construct
  source 1..25: note = Seed: QTVHSIPLTINKEEALQRPVASDFE
QTVHSIPLTINKEFALARIVARDFE

SEQ ID NO: 44677 - protein, 25 aa, synthetic construct
  source 1..25: note = Seed: QTVHSIPLTINKEEALQRPVASDFE
QTVHSIPLTINKEFALARIVASDFE

SEQ ID NO: 44678 - protein, 25 aa, synthetic construct
  source 1..25: note = Seed: QTVHSIPLTINKEEALQRPVASDFE
QTVHSIPLTINKEFALARIVATDFE

SEQ ID NO: 44679 - protein, 25 aa, synthetic construct
  source 1..25: note = Seed: QTVHSIPLTINKEEALQRPVASDFE
QTVHSIPLTINKEFALARIVAVDFE

SEQ ID NO: 44680 - protein, 25 aa, synthetic construct
  source 1..25: note = Seed: QTVHSIPLTINKEEALQRPVASDFE
QTVHSIPLTINKEFALARIVAYDFE

SEQ ID NO: 44681 - protein, 25 aa, synthetic construct
  source 1..25: note = Seed: QTVHSIPLTINKEEALQRPVASDFE
QTVHSIPLTINKEFALARKVAADFE

SEQ ID NO: 44682 - protein, 25 aa, synthetic construct
  source 1..25: note = Seed: QTVHSIPLTINKEEALQRPVASDFE
QTVHSIPLTINKEFALARKVAMDFE

SEQ ID NO: 44683 - protein, 25 aa, synthetic construct
  source 1..25: note = Seed: QTVHSIPLTINKEEALQRPVASDFE
QTVHSIPLTINKEFALARKVANDFE

SEQ ID NO: 44684 - protein, 25 aa, synthetic construct
  source 1..25: note = Seed: QTVHSIPLTINKEEALQRPVASDFE
QTVHSIPLTINKEFALARKVASDFE

SEQ ID NO: 44685 - protein, 25 aa, synthetic construct
  source 1..25: note = Seed: QTVHSIPLTINKEEALQRPVASDFE
QTVHSIPLTINKEFALARKVATDFE

SEQ ID NO: 44686 - protein, 25 aa, synthetic construct
  source 1..25: note = Seed: QTVHSIPLTINKEEALQRPVASDFE
QTVHSIPLTINKEFALARKVAVDFE

SEQ ID NO: 44687 - protein, 25 aa, synthetic construct
  source 1..25: note = Seed: QTVHSIPLTINKEEALQRPVASDFE
QTVHSIPLTINKEFALARLVAADFE

SEQ ID NO: 44688 - protein, 25 aa, synthetic construct
  source 1..25: note = Seed: QTVHSIPLTINKEEALQRPVASDFE
QTVHSIPLTINKEFALARLVADDFE

SEQ ID NO: 44689 - protein, 25 aa, synthetic construct
  source 1..25: note = Seed: QTVHSIPLTINKEEALQRPVASDFE
QTVHSIPLTINKEFALARLVAGDFE

SEQ ID NO: 44690 - protein, 25 aa, synthetic construct
  source 1..25: note = Seed: QTVHSIPLTINKEEALQRPVASDFE
QTVHSIPLTINKEFALARLVAHDFE

SEQ ID NO: 44691 - protein, 25 aa, synthetic construct
  source 1..25: note = Seed: QTVHSIPLTINKEEALQRPVASDFE
QTVHSIPLTINKEFALARLVAMDFE

SEQ ID NO: 44692 - protein, 25 aa, synthetic construct
  source 1..25: note = Seed: QTVHSIPLTINKEEALQRPVASDFE
QTVHSIPLTINKEFALARLVANDFE

SEQ ID NO: 44693 - protein, 25 aa, synthetic construct
  source 1..25: note = Seed: QTVHSIPLTINKEEALQRPVASDFE
QTVHSIPLTINKEFALARLVAQDFE

SEQ ID NO: 44694 - protein, 25 aa, synthetic construct
  source 1..25: note = Seed: QTVHSIPLTINKEEALQRPVASDFE
QTVHSIPLTINKEFALARLVASDFE

SEQ ID NO: 44695 - protein, 25 aa, synthetic construct
  source 1..25: note = Seed: QTVHSIPLTINKEEALQRPVASDFE
QTVHSIPLTINKEFALARLVATDFE

SEQ ID NO: 44696 - protein, 25 aa, synthetic construct
  source 1..25: note = Seed: QTVHSIPLTINKEEALQRPVASDFE
QTVHSIPLTINKEFALARLVAVDFE

SEQ ID NO: 44697 - protein, 25 aa, synthetic construct
  source 1..25: note = Seed: QTVHSIPLTINKEEALQRPVASDFE
QTVHSIPLTINKEFALARMVAADFE

SEQ ID NO: 44698 - protein, 25 aa, synthetic construct
  source 1..25: note = Seed: QTVHSIPLTINKEEALQRPVASDFE
QTVHSIPLTINKEFALARMVAGDFE

SEQ ID NO: 44699 - protein, 25 aa, synthetic construct
  source 1..25: note = Seed: QTVHSIPLTINKEEALQRPVASDFE
QTVHSIPLTINKEFALARMVAHDFE

SEQ ID NO: 44700 - protein, 25 aa, synthetic construct
  source 1..25: note = Seed: QTVHSIPLTINKEEALQRPVASDFE
QTVHSIPLTINKEFALARMVAMDFE

SEQ ID NO: 44701 - protein, 25 aa, synthetic construct
  source 1..25: note = Seed: QTVHSIPLTINKEEALQRPVASDFE
QTVHSIPLTINKEFALARMVANDFE

SEQ ID NO: 44702 - protein, 25 aa, synthetic construct
  source 1..25: note = Seed: QTVHSIPLTINKEEALQRPVASDFE
QTVHSIPLTINKEFALARMVAQDFE

SEQ ID NO: 44703 - protein, 25 aa, synthetic construct
  source 1..25: note = Seed: QTVHSIPLTINKEEALQRPVASDFE
QTVHSIPLTINKEFALARMVASDFE

SEQ ID NO: 44704 - protein, 25 aa, synthetic construct
  source 1..25: note = Seed: QTVHSIPLTINKEEALQRPVASDFE
QTVHSIPLTINKEFALARMVATDFE

SEQ ID NO: 44705 - protein, 25 aa, synthetic construct
  source 1..25: note = Seed: QTVHSIPLTINKEEALQRPVASDFE
QTVHSIPLTINKEFALARMVAVDFE

SEQ ID NO: 44706 - protein, 25 aa, synthetic construct
  source 1..25: note = Seed: QTVHSIPLTINKEEALQRPVASDFE
QTVHSIPLTINKEFALARNVAADFE

SEQ ID NO: 44707 - protein, 25 aa, synthetic construct
  source 1..25: note = Seed: QTVHSIPLTINKEEALQRPVASDFE
QTVHSIPLTINKEFALARNVACDFE

SEQ ID NO: 44708 - protein, 25 aa, synthetic construct
  source 1..25: note = Seed: QTVHSIPLTINKEEALQRPVASDFE
QTVHSIPLTINKEFALARNVADDFE

SEQ ID NO: 44709 - protein, 25 aa, synthetic construct
  source 1..25: note = Seed: QTVHSIPLTINKEEALQRPVASDFE
QTVHSIPLTINKEFALARNVAEDFE

SEQ ID NO: 44710 - protein, 25 aa, synthetic construct
  source 1..25: note = Seed: QTVHSIPLTINKEEALQRPVASDFE
QTVHSIPLTINKEFALARNVAFDFE

SEQ ID NO: 44711 - protein, 25 aa, synthetic construct
  source 1..25: note = Seed: QTVHSIPLTINKEEALQRPVASDFE
QTVHSIPLTINKEFALARNVAGDFE

SEQ ID NO: 44712 - protein, 25 aa, synthetic construct
  source 1..25: note = Seed: QTVHSIPLTINKEEALQRPVASDFE
QTVHSIPLTINKEFALARNVAHDFE

SEQ ID NO: 44713 - protein, 25 aa, synthetic construct
  source 1..25: note = Seed: QTVHSIPLTINKEEALQRPVASDFE
QTVHSIPLTINKEFALARNVAIDFE

SEQ ID NO: 44714 - protein, 25 aa, synthetic construct
  source 1..25: note = Seed: QTVHSIPLTINKEEALQRPVASDFE
QTVHSIPLTINKEFALARNVAKDFE

SEQ ID NO: 44715 - protein, 25 aa, synthetic construct
  source 1..25: note = Seed: QTVHSIPLTINKEEALQRPVASDFE
QTVHSIPLTINKEFALARNVALDFE

SEQ ID NO: 44716 - protein, 25 aa, synthetic construct
  source 1..25: note = Seed: QTVHSIPLTINKEEALQRPVASDFE
QTVHSIPLTINKEFALARNVAMDFE

SEQ ID NO: 44717 - protein, 25 aa, synthetic construct
  source 1..25: note = Seed: QTVHSIPLTINKEEALQRPVASDFE
QTVHSIPLTINKEFALARNVANDFE

SEQ ID NO: 44718 - protein, 25 aa, synthetic construct
  source 1..25: note = Seed: QTVHSIPLTINKEEALQRPVASDFE
QTVHSIPLTINKEFALARNVAPDFE

SEQ ID NO: 44719 - protein, 25 aa, synthetic construct
  source 1..25: note = Seed: QTVHSIPLTINKEEALQRPVASDFE
QTVHSIPLTINKEFALARNVAQDFE

SEQ ID NO: 44720 - protein, 25 aa, synthetic construct
  source 1..25: note = Seed: QTVHSIPLTINKEEALQRPVASDFE
QTVHSIPLTINKEFALARNVASDFE

SEQ ID NO: 44721 - protein, 25 aa, synthetic construct
  source 1..25: note = Seed: QTVHSIPLTINKEEALQRPVASDFE
QTVHSIPLTINKEFALARNVATDFE

SEQ ID NO: 44722 - protein, 25 aa, synthetic construct
  source 1..25: note = Seed: QTVHSIPLTINKEEALQRPVASDFE
QTVHSIPLTINKEFALARNVAVDFE

SEQ ID NO: 44723 - protein, 25 aa, synthetic construct
  source 1..25: note = Seed: QTVHSIPLTINKEEALQRPVASDFE
QTVHSIPLTINKEFALARNVAYDFE

SEQ ID NO: 44724 - protein, 25 aa, synthetic construct
  source 1..25: note = Seed: QTVHSIPLTINKEEALQRPVASDFE
QTVHSIPLTINKEFALARPVAADFE

SEQ ID NO: 44725 - protein, 25 aa, synthetic construct
  source 1..25: note = Seed: QTVHSIPLTINKEEALQRPVASDFE
QTVHSIPLTINKEFALARPVACDFE

SEQ ID NO: 44726 - protein, 25 aa, synthetic construct
  source 1..25: note = Seed: QTVHSIPLTINKEEALQRPVASDFE
QTVHSIPLTINKEFALARPVADDFE

SEQ ID NO: 44727 - protein, 25 aa, synthetic construct
  source 1..25: note = Seed: QTVHSIPLTINKEEALQRPVASDFE
QTVHSIPLTINKEFALARPVAEDFE

SEQ ID NO: 44728 - protein, 25 aa, synthetic construct
  source 1..25: note = Seed: QTVHSIPLTINKEEALQRPVASDFE
QTVHSIPLTINKEFALARPVAFDFE

SEQ ID NO: 44729 - protein, 25 aa, synthetic construct
  source 1..25: note = Seed: QTVHSIPLTINKEEALQRPVASDFE
QTVHSIPLTINKEFALARPVAGDFE

SEQ ID NO: 44730 - protein, 25 aa, synthetic construct
  source 1..25: note = Seed: QTVHSIPLTINKEEALQRPVASDFE
QTVHSIPLTINKEFALARPVAHDFE

SEQ ID NO: 44731 - protein, 25 aa, synthetic construct
  source 1..25: note = Seed: QTVHSIPLTINKEEALQRPVASDFE
QTVHSIPLTINKEFALARPVAIDFE

SEQ ID NO: 44732 - protein, 25 aa, synthetic construct
  source 1..25: note = Seed: QTVHSIPLTINKEEALQRPVASDFE
QTVHSIPLTINKEFALARPVAKDFE

SEQ ID NO: 44733 - protein, 25 aa, synthetic construct
  source 1..25: note = Seed: QTVHSIPLTINKEEALQRPVASDFE
QTVHSIPLTINKEFALARPVALDFE

SEQ ID NO: 44734 - protein, 25 aa, synthetic construct
  source 1..25: note = Seed: QTVHSIPLTINKEEALQRPVASDFE
QTVHSIPLTINKEFALARPVAMDFE

SEQ ID NO: 44735 - protein, 25 aa, synthetic construct
  source 1..25: note = Seed: QTVHSIPLTINKEEALQRPVASDFE
QTVHSIPLTINKEFALARPVANDFE

SEQ ID NO: 44736 - protein, 25 aa, synthetic construct
  source 1..25: note = Seed: QTVHSIPLTINKEEALQRPVASDFE
QTVHSIPLTINKEFALARPVAPDFE

SEQ ID NO: 44737 - protein, 25 aa, synthetic construct
  source 1..25: note = Seed: QTVHSIPLTINKEEALQRPVASDFE
QTVHSIPLTINKEFALARPVAQDFE

SEQ ID NO: 44738 - protein, 25 aa, synthetic construct
  source 1..25: note = Seed: QTVHSIPLTINKEEALQRPVASDFE
QTVHSIPLTINKEFALARPVARDFE

SEQ ID NO: 44739 - protein, 25 aa, synthetic construct
  source 1..25: note = Seed: QTVHSIPLTINKEEALQRPVASDFE
QTVHSIPLTINKEFALARPVASDFE

SEQ ID NO: 44740 - protein, 25 aa, synthetic construct
  source 1..25: note = Seed: QTVHSIPLTINKEEALQRPVASDFE
QTVHSIPLTINKEFALARPVATDFE

SEQ ID NO: 44741 - protein, 25 aa, synthetic construct
  source 1..25: note = Seed: QTVHSIPLTINKEEALQRPVASDFE
QTVHSIPLTINKEFALARPVAVDFE

SEQ ID NO: 44742 - protein, 25 aa, synthetic construct
  source 1..25: note = Seed: QTVHSIPLTINKEEALQRPVASDFE
QTVHSIPLTINKEFALARPVAWDFE

SEQ ID NO: 44743 - protein, 25 aa, synthetic construct
  source 1..25: note = Seed: QTVHSIPLTINKEEALQRPVASDFE
QTVHSIPLTINKEFALARPVAYDFE

SEQ ID NO: 44744 - protein, 25 aa, synthetic construct
  source 1..25: note = Seed: QTVHSIPLTINKEEALQRPVASDFE
QTVHSIPLTINKEFALARQVAADFE

SEQ ID NO: 44745 - protein, 25 aa, synthetic construct
  source 1..25: note = Seed: QTVHSIPLTINKEEALQRPVASDFE
QTVHSIPLTINKEFALARQVAGDFE

SEQ ID NO: 44746 - protein, 25 aa, synthetic construct
  source 1..25: note = Seed: QTVHSIPLTINKEEALQRPVASDFE
QTVHSIPLTINKEFALARQVAIDFE

SEQ ID NO: 44747 - protein, 25 aa, synthetic construct
  source 1..25: note = Seed: QTVHSIPLTINKEEALQRPVASDFE
QTVHSIPLTINKEFALARQVALDFE

SEQ ID NO: 44748 - protein, 25 aa, synthetic construct
  source 1..25: note = Seed: QTVHSIPLTINKEEALQRPVASDFE
QTVHSIPLTINKEFALARQVAMDFE

SEQ ID NO: 44749 - protein, 25 aa, synthetic construct
  source 1..25: note = Seed: QTVHSIPLTINKEEALQRPVASDFE
QTVHSIPLTINKEFALARQVANDFE

SEQ ID NO: 44750 - protein, 25 aa, synthetic construct
  source 1..25: note = Seed: QTVHSIPLTINKEEALQRPVASDFE
QTVHSIPLTINKEFALARQVASDFE

SEQ ID NO: 44751 - protein, 25 aa, synthetic construct
  source 1..25: note = Seed: QTVHSIPLTINKEEALQRPVASDFE
QTVHSIPLTINKEFALARQVATDFE

SEQ ID NO: 44752 - protein, 25 aa, synthetic construct
  source 1..25: note = Seed: QTVHSIPLTINKEEALQRPVASDFE
QTVHSIPLTINKEFALARQVAVDFE

SEQ ID NO: 44753 - protein, 25 aa, synthetic construct
  source 1..25: note = Seed: QTVHSIPLTINKEEALQRPVASDFE
QTVHSIPLTINKEFALARRVAADFE

SEQ ID NO: 44754 - protein, 25 aa, synthetic construct
  source 1..25: note = Seed: QTVHSIPLTINKEEALQRPVASDFE
QTVHSIPLTINKEFALARRVASDFE

SEQ ID NO: 44755 - protein, 25 aa, synthetic construct
  source 1..25: note = Seed: QTVHSIPLTINKEEALQRPVASDFE
QTVHSIPLTINKEFALARSVAADFE

SEQ ID NO: 44756 - protein, 25 aa, synthetic construct
  source 1..25: note = Seed: QTVHSIPLTINKEEALQRPVASDFE
QTVHSIPLTINKEFALARSVACDFE

SEQ ID NO: 44757 - protein, 25 aa, synthetic construct
  source 1..25: note = Seed: QTVHSIPLTINKEEALQRPVASDFE
QTVHSIPLTINKEFALARSVADDFE

SEQ ID NO: 44758 - protein, 25 aa, synthetic construct
  source 1..25: note = Seed: QTVHSIPLTINKEEALQRPVASDFE
QTVHSIPLTINKEFALARSVAEDFE

SEQ ID NO: 44759 - protein, 25 aa, synthetic construct
  source 1..25: note = Seed: QTVHSIPLTINKEEALQRPVASDFE
QTVHSIPLTINKEFALARSVAFDFE

SEQ ID NO: 44760 - protein, 25 aa, synthetic construct
  source 1..25: note = Seed: QTVHSIPLTINKEEALQRPVASDFE
QTVHSIPLTINKEFALARSVAGDFE

SEQ ID NO: 44761 - protein, 25 aa, synthetic construct
  source 1..25: note = Seed: QTVHSIPLTINKEEALQRPVASDFE
QTVHSIPLTINKEFALARSVAHDFE

SEQ ID NO: 44762 - protein, 25 aa, synthetic construct
  source 1..25: note = Seed: QTVHSIPLTINKEEALQRPVASDFE
QTVHSIPLTINKEFALARSVAIDFE

SEQ ID NO: 44763 - protein, 25 aa, synthetic construct
  source 1..25: note = Seed: QTVHSIPLTINKEEALQRPVASDFE
QTVHSIPLTINKEFALARSVAKDFE

SEQ ID NO: 44764 - protein, 25 aa, synthetic construct
  source 1..25: note = Seed: QTVHSIPLTINKEEALQRPVASDFE
QTVHSIPLTINKEFALARSVALDFE

SEQ ID NO: 44765 - protein, 25 aa, synthetic construct
  source 1..25: note = Seed: QTVHSIPLTINKEEALQRPVASDFE
QTVHSIPLTINKEFALARSVAMDFE

SEQ ID NO: 44766 - protein, 25 aa, synthetic construct
  source 1..25: note = Seed: QTVHSIPLTINKEEALQRPVASDFE
QTVHSIPLTINKEFALARSVANDFE

SEQ ID NO: 44767 - protein, 25 aa, synthetic construct
  source 1..25: note = Seed: QTVHSIPLTINKEEALQRPVASDFE
QTVHSIPLTINKEFALARSVAPDFE

SEQ ID NO: 44768 - protein, 25 aa, synthetic construct
  source 1..25: note = Seed: QTVHSIPLTINKEEALQRPVASDFE
QTVHSIPLTINKEFALARSVAQDFE

SEQ ID NO: 44769 - protein, 25 aa, synthetic construct
  source 1..25: note = Seed: QTVHSIPLTINKEEALQRPVASDFE
QTVHSIPLTINKEFALARSVARDFE

SEQ ID NO: 44770 - protein, 25 aa, synthetic construct
  source 1..25: note = Seed: QTVHSIPLTINKEEALQRPVASDFE
QTVHSIPLTINKEFALARSVASDFE

SEQ ID NO: 44771 - protein, 25 aa, synthetic construct
  source 1..25: note = Seed: QTVHSIPLTINKEEALQRPVASDFE
QTVHSIPLTINKEFALARSVATDFE

SEQ ID NO: 44772 - protein, 25 aa, synthetic construct
  source 1..25: note = Seed: QTVHSIPLTINKEEALQRPVASDFE
QTVHSIPLTINKEFALARSVAVDFE

SEQ ID NO: 44773 - protein, 25 aa, synthetic construct
  source 1..25: note = Seed: QTVHSIPLTINKEEALQRPVASDFE
QTVHSIPLTINKEFALARSVAWDFE

SEQ ID NO: 44774 - protein, 25 aa, synthetic construct
  source 1..25: note = Seed: QTVHSIPLTINKEEALQRPVASDFE
QTVHSIPLTINKEFALARSVAYDFE

SEQ ID NO: 44775 - protein, 25 aa, synthetic construct
  source 1..25: note = Seed: QTVHSIPLTINKEEALQRPVASDFE
QTVHSIPLTINKEFALARTVAADFE

SEQ ID NO: 44776 - protein, 25 aa, synthetic construct
  source 1..25: note = Seed: QTVHSIPLTINKEEALQRPVASDFE
QTVHSIPLTINKEFALARTVACDFE

SEQ ID NO: 44777 - protein, 25 aa, synthetic construct
  source 1..25: note = Seed: QTVHSIPLTINKEEALQRPVASDFE
QTVHSIPLTINKEFALARTVADDFE

SEQ ID NO: 44778 - protein, 25 aa, synthetic construct
  source 1..25: note = Seed: QTVHSIPLTINKEEALQRPVASDFE
QTVHSIPLTINKEFALARTVAEDFE

SEQ ID NO: 44779 - protein, 25 aa, synthetic construct
  source 1..25: note = Seed: QTVHSIPLTINKEEALQRPVASDFE
QTVHSIPLTINKEFALARTVAFDFE

SEQ ID NO: 44780 - protein, 25 aa, synthetic construct
  source 1..25: note = Seed: QTVHSIPLTINKEEALQRPVASDFE
QTVHSIPLTINKEFALARTVAGDFE

SEQ ID NO: 44781 - protein, 25 aa, synthetic construct
  source 1..25: note = Seed: QTVHSIPLTINKEEALQRPVASDFE
QTVHSIPLTINKEFALARTVAHDFE

SEQ ID NO: 44782 - protein, 25 aa, synthetic construct
  source 1..25: note = Seed: QTVHSIPLTINKEEALQRPVASDFE
QTVHSIPLTINKEFALARTVAIDFE

SEQ ID NO: 44783 - protein, 25 aa, synthetic construct
  source 1..25: note = Seed: QTVHSIPLTINKEEALQRPVASDFE
QTVHSIPLTINKEFALARTVAKDFE

SEQ ID NO: 44784 - protein, 25 aa, synthetic construct
  source 1..25: note = Seed: QTVHSIPLTINKEEALQRPVASDFE
QTVHSIPLTINKEFALARTVALDFE

SEQ ID NO: 44785 - protein, 25 aa, synthetic construct
  source 1..25: note = Seed: QTVHSIPLTINKEEALQRPVASDFE
QTVHSIPLTINKEFALARTVAMDFE

SEQ ID NO: 44786 - protein, 25 aa, synthetic construct
  source 1..25: note = Seed: QTVHSIPLTINKEEALQRPVASDFE
QTVHSIPLTINKEFALARTVANDFE

SEQ ID NO: 44787 - protein, 25 aa, synthetic construct
  source 1..25: note = Seed: QTVHSIPLTINKEEALQRPVASDFE
QTVHSIPLTINKEFALARTVAPDFE

SEQ ID NO: 44788 - protein, 25 aa, synthetic construct
  source 1..25: note = Seed: QTVHSIPLTINKEEALQRPVASDFE
QTVHSIPLTINKEFALARTVAQDFE

SEQ ID NO: 44789 - protein, 25 aa, synthetic construct
  source 1..25: note = Seed: QTVHSIPLTINKEEALQRPVASDFE
QTVHSIPLTINKEFALARTVARDFE

SEQ ID NO: 44790 - protein, 25 aa, synthetic construct
  source 1..25: note = Seed: QTVHSIPLTINKEEALQRPVASDFE
QTVHSIPLTINKEFALARTVASDFE

SEQ ID NO: 44791 - protein, 25 aa, synthetic construct
  source 1..25: note = Seed: QTVHSIPLTINKEEALQRPVASDFE
QTVHSIPLTINKEFALARTVATDFE

SEQ ID NO: 44792 - protein, 25 aa, synthetic construct
  source 1..25: note = Seed: QTVHSIPLTINKEEALQRPVASDFE
QTVHSIPLTINKEFALARTVAVDFE

SEQ ID NO: 44793 - protein, 25 aa, synthetic construct
  source 1..25: note = Seed: QTVHSIPLTINKEEALQRPVASDFE
QTVHSIPLTINKEFALARTVAYDFE

SEQ ID NO: 44794 - protein, 25 aa, synthetic construct
  source 1..25: note = Seed: QTVHSIPLTINKEEALQRPVASDFE
QTVHSIPLTINKEFALARVVAADFE

SEQ ID NO: 44795 - protein, 25 aa, synthetic construct
  source 1..25: note = Seed: QTVHSIPLTINKEEALQRPVASDFE
QTVHSIPLTINKEFALARVVADDFE

SEQ ID NO: 44796 - protein, 25 aa, synthetic construct
  source 1..25: note = Seed: QTVHSIPLTINKEEALQRPVASDFE
QTVHSIPLTINKEFALARVVAEDFE

SEQ ID NO: 44797 - protein, 25 aa, synthetic construct
  source 1..25: note = Seed: QTVHSIPLTINKEEALQRPVASDFE
QTVHSIPLTINKEFALARVVAFDFE

SEQ ID NO: 44798 - protein, 25 aa, synthetic construct
  source 1..25: note = Seed: QTVHSIPLTINKEEALQRPVASDFE
QTVHSIPLTINKEFALARVVAGDFE

SEQ ID NO: 44799 - protein, 25 aa, synthetic construct
  source 1..25: note = Seed: QTVHSIPLTINKEEALQRPVASDFE
QTVHSIPLTINKEFALARVVAHDFE

SEQ ID NO: 44800 - protein, 25 aa, synthetic construct
  source 1..25: note = Seed: QTVHSIPLTINKEEALQRPVASDFE
QTVHSIPLTINKEFALARVVAIDFE

SEQ ID NO: 44801 - protein, 25 aa, synthetic construct
  source 1..25: note = Seed: QTVHSIPLTINKEEALQRPVASDFE
QTVHSIPLTINKEFALARVVAKDFE

SEQ ID NO: 44802 - protein, 25 aa, synthetic construct
  source 1..25: note = Seed: QTVHSIPLTINKEEALQRPVASDFE
QTVHSIPLTINKEFALARVVALDFE

SEQ ID NO: 44803 - protein, 25 aa, synthetic construct
  source 1..25: note = Seed: QTVHSIPLTINKEEALQRPVASDFE
QTVHSIPLTINKEFALARVVAMDFE

SEQ ID NO: 44804 - protein, 25 aa, synthetic construct
  source 1..25: note = Seed: QTVHSIPLTINKEEALQRPVASDFE
QTVHSIPLTINKEFALARVVANDFE

SEQ ID NO: 44805 - protein, 25 aa, synthetic construct
  source 1..25: note = Seed: QTVHSIPLTINKEEALQRPVASDFE
QTVHSIPLTINKEFALARVVAPDFE

SEQ ID NO: 44806 - protein, 25 aa, synthetic construct
  source 1..25: note = Seed: QTVHSIPLTINKEEALQRPVASDFE
QTVHSIPLTINKEFALARVVAQDFE

SEQ ID NO: 44807 - protein, 25 aa, synthetic construct
  source 1..25: note = Seed: QTVHSIPLTINKEEALQRPVASDFE
QTVHSIPLTINKEFALARVVARDFE

SEQ ID NO: 44808 - protein, 25 aa, synthetic construct
  source 1..25: note = Seed: QTVHSIPLTINKEEALQRPVASDFE
QTVHSIPLTINKEFALARVVASDFE

SEQ ID NO: 44809 - protein, 25 aa, synthetic construct
  source 1..25: note = Seed: QTVHSIPLTINKEEALQRPVASDFE
QTVHSIPLTINKEFALARVVATDFE

SEQ ID NO: 44810 - protein, 25 aa, synthetic construct
  source 1..25: note = Seed: QTVHSIPLTINKEEALQRPVASDFE
QTVHSIPLTINKEFALARVVAVDFE

SEQ ID NO: 44811 - protein, 25 aa, synthetic construct
  source 1..25: note = Seed: QTVHSIPLTINKEEALQRPVASDFE
QTVHSIPLTINKEFALARVVAYDFE

SEQ ID NO: 44812 - protein, 25 aa, synthetic construct
  source 1..25: note = Seed: QTVHSIPLTINKEEALQRPVASDFE
QTVHSIPLTINKEFALARWVAADFE

SEQ ID NO: 44813 - protein, 25 aa, synthetic construct
  source 1..25: note = Seed: QTVHSIPLTINKEEALQRPVASDFE
QTVHSIPLTINKEFALARWVANDFE

SEQ ID NO: 44814 - protein, 25 aa, synthetic construct
  source 1..25: note = Seed: QTVHSIPLTINKEEALQRPVASDFE
QTVHSIPLTINKEFALARWVASDFE

SEQ ID NO: 44815 - protein, 25 aa, synthetic construct
  source 1..25: note = Seed: QTVHSIPLTINKEEALQRPVASDFE
QTVHSIPLTINKEFALARYVAADFE

SEQ ID NO: 44816 - protein, 25 aa, synthetic construct
  source 1..25: note = Seed: QTVHSIPLTINKEEALQRPVASDFE
QTVHSIPLTINKEFALARYVANDFE

SEQ ID NO: 44817 - protein, 25 aa, synthetic construct
  source 1..25: note = Seed: QTVHSIPLTINKEEALQRPVASDFE
QTVHSIPLTINKEFALARYVASDFE

SEQ ID NO: 44818 - protein, 25 aa, synthetic construct
  source 1..25: note = Seed: QTVHSIPLTINKEEALQRPVASDFE
QTVHSIPLTINKEFALCRAVAADFE

SEQ ID NO: 44819 - protein, 25 aa, synthetic construct
  source 1..25: note = Seed: QTVHSIPLTINKEEALQRPVASDFE
QTVHSIPLTINKEFALCRAVAGDFE

SEQ ID NO: 44820 - protein, 25 aa, synthetic construct
  source 1..25: note = Seed: QTVHSIPLTINKEEALQRPVASDFE
QTVHSIPLTINKEFALCRAVAHDFE

SEQ ID NO: 44821 - protein, 25 aa, synthetic construct
  source 1..25: note = Seed: QTVHSIPLTINKEEALQRPVASDFE
QTVHSIPLTINKEFALCRAVAIDFE

SEQ ID NO: 44822 - protein, 25 aa, synthetic construct
  source 1..25: note = Seed: QTVHSIPLTINKEEALQRPVASDFE
QTVHSIPLTINKEFALCRAVALDFE

SEQ ID NO: 44823 - protein, 25 aa, synthetic construct
  source 1..25: note = Seed: QTVHSIPLTINKEEALQRPVASDFE
QTVHSIPLTINKEFALCRAVAMDFE

SEQ ID NO: 44824 - protein, 25 aa, synthetic construct
  source 1..25: note = Seed: QTVHSIPLTINKEEALQRPVASDFE
QTVHSIPLTINKEFALCRAVANDFE

SEQ ID NO: 44825 - protein, 25 aa, synthetic construct
  source 1..25: note = Seed: QTVHSIPLTINKEEALQRPVASDFE
QTVHSIPLTINKEFALCRAVAQDFE

SEQ ID NO: 44826 - protein, 25 aa, synthetic construct
  source 1..25: note = Seed: QTVHSIPLTINKEEALQRPVASDFE
QTVHSIPLTINKEFALCRAVASDFE

SEQ ID NO: 44827 - protein, 25 aa, synthetic construct
  source 1..25: note = Seed: QTVHSIPLTINKEEALQRPVASDFE
QTVHSIPLTINKEFALCRAVATDFE

SEQ ID NO: 44828 - protein, 25 aa, synthetic construct
  source 1..25: note = Seed: QTVHSIPLTINKEEALQRPVASDFE
QTVHSIPLTINKEFALCRAVAVDFE

SEQ ID NO: 44829 - protein, 25 aa, synthetic construct
  source 1..25: note = Seed: QTVHSIPLTINKEEALQRPVASDFE
QTVHSIPLTINKEFALCRGVAADFE

SEQ ID NO: 44830 - protein, 25 aa, synthetic construct
  source 1..25: note = Seed: QTVHSIPLTINKEEALQRPVASDFE
QTVHSIPLTINKEFALCRGVANDFE

SEQ ID NO: 44831 - protein, 25 aa, synthetic construct
  source 1..25: note = Seed: QTVHSIPLTINKEEALQRPVASDFE
QTVHSIPLTINKEFALCRGVASDFE

SEQ ID NO: 44832 - protein, 25 aa, synthetic construct
  source 1..25: note = Seed: QTVHSIPLTINKEEALQRPVASDFE
QTVHSIPLTINKEFALCRIVANDFE

SEQ ID NO: 44833 - protein, 25 aa, synthetic construct
  source 1..25: note = Seed: QTVHSIPLTINKEEALQRPVASDFE
QTVHSIPLTINKEFALCRNVAADFE

SEQ ID NO: 44834 - protein, 25 aa, synthetic construct
  source 1..25: note = Seed: QTVHSIPLTINKEEALQRPVASDFE
QTVHSIPLTINKEFALCRNVANDFE

SEQ ID NO: 44835 - protein, 25 aa, synthetic construct
  source 1..25: note = Seed: QTVHSIPLTINKEEALQRPVASDFE
QTVHSIPLTINKEFALCRPVAADFE

SEQ ID NO: 44836 - protein, 25 aa, synthetic construct
  source 1..25: note = Seed: QTVHSIPLTINKEEALQRPVASDFE
QTVHSIPLTINKEFALCRPVAIDFE

SEQ ID NO: 44837 - protein, 25 aa, synthetic construct
  source 1..25: note = Seed: QTVHSIPLTINKEEALQRPVASDFE
QTVHSIPLTINKEFALCRPVALDFE

SEQ ID NO: 44838 - protein, 25 aa, synthetic construct
  source 1..25: note = Seed: QTVHSIPLTINKEEALQRPVASDFE
QTVHSIPLTINKEFALCRPVAMDFE

SEQ ID NO: 44839 - protein, 25 aa, synthetic construct
  source 1..25: note = Seed: QTVHSIPLTINKEEALQRPVASDFE
QTVHSIPLTINKEFALCRPVANDFE

SEQ ID NO: 44840 - protein, 25 aa, synthetic construct
  source 1..25: note = Seed: QTVHSIPLTINKEEALQRPVASDFE
QTVHSIPLTINKEFALCRPVASDFE

SEQ ID NO: 44841 - protein, 25 aa, synthetic construct
  source 1..25: note = Seed: QTVHSIPLTINKEEALQRPVASDFE
QTVHSIPLTINKEFALCRPVATDFE

SEQ ID NO: 44842 - protein, 25 aa, synthetic construct
  source 1..25: note = Seed: QTVHSIPLTINKEEALQRPVASDFE
QTVHSIPLTINKEFALCRPVAVDFE

SEQ ID NO: 44843 - protein, 25 aa, synthetic construct
  source 1..25: note = Seed: QTVHSIPLTINKEEALQRPVASDFE
QTVHSIPLTINKEFALCRSVAADFE

SEQ ID NO: 44844 - protein, 25 aa, synthetic construct
  source 1..25: note = Seed: QTVHSIPLTINKEEALQRPVASDFE
QTVHSIPLTINKEFALCRSVAIDFE

SEQ ID NO: 44845 - protein, 25 aa, synthetic construct
  source 1..25: note = Seed: QTVHSIPLTINKEEALQRPVASDFE
QTVHSIPLTINKEFALCRSVALDFE

SEQ ID NO: 44846 - protein, 25 aa, synthetic construct
  source 1..25: note = Seed: QTVHSIPLTINKEEALQRPVASDFE
QTVHSIPLTINKEFALCRSVAMDFE

SEQ ID NO: 44847 - protein, 25 aa, synthetic construct
  source 1..25: note = Seed: QTVHSIPLTINKEEALQRPVASDFE
QTVHSIPLTINKEFALCRSVANDFE

SEQ ID NO: 44848 - protein, 25 aa, synthetic construct
  source 1..25: note = Seed: QTVHSIPLTINKEEALQRPVASDFE
QTVHSIPLTINKEFALCRSVASDFE

SEQ ID NO: 44849 - protein, 25 aa, synthetic construct
  source 1..25: note = Seed: QTVHSIPLTINKEEALQRPVASDFE
QTVHSIPLTINKEFALCRSVATDFE

SEQ ID NO: 44850 - protein, 25 aa, synthetic construct
  source 1..25: note = Seed: QTVHSIPLTINKEEALQRPVASDFE
QTVHSIPLTINKEFALCRSVAVDFE

SEQ ID NO: 44851 - protein, 25 aa, synthetic construct
  source 1..25: note = Seed: QTVHSIPLTINKEEALQRPVASDFE
QTVHSIPLTINKEFALCRTVAADFE

SEQ ID NO: 44852 - protein, 25 aa, synthetic construct
  source 1..25: note = Seed: QTVHSIPLTINKEEALQRPVASDFE
QTVHSIPLTINKEFALCRTVAIDFE

SEQ ID NO: 44853 - protein, 25 aa, synthetic construct
  source 1..25: note = Seed: QTVHSIPLTINKEEALQRPVASDFE
QTVHSIPLTINKEFALCRTVALDFE

SEQ ID NO: 44854 - protein, 25 aa, synthetic construct
  source 1..25: note = Seed: QTVHSIPLTINKEEALQRPVASDFE
QTVHSIPLTINKEFALCRTVAMDFE

SEQ ID NO: 44855 - protein, 25 aa, synthetic construct
  source 1..25: note = Seed: QTVHSIPLTINKEEALQRPVASDFE
QTVHSIPLTINKEFALCRTVANDFE

SEQ ID NO: 44856 - protein, 25 aa, synthetic construct
  source 1..25: note = Seed: QTVHSIPLTINKEEALQRPVASDFE
QTVHSIPLTINKEFALCRTVASDFE

SEQ ID NO: 44857 - protein, 25 aa, synthetic construct
  source 1..25: note = Seed: QTVHSIPLTINKEEALQRPVASDFE
QTVHSIPLTINKEFALCRTVATDFE

SEQ ID NO: 44858 - protein, 25 aa, synthetic construct
  source 1..25: note = Seed: QTVHSIPLTINKEEALQRPVASDFE
QTVHSIPLTINKEFALCRTVAVDFE

SEQ ID NO: 44859 - protein, 25 aa, synthetic construct
  source 1..25: note = Seed: QTVHSIPLTINKEEALQRPVASDFE
QTVHSIPLTINKEFALCRVVAADFE

SEQ ID NO: 44860 - protein, 25 aa, synthetic construct
  source 1..25: note = Seed: QTVHSIPLTINKEEALQRPVASDFE
QTVHSIPLTINKEFALCRVVANDFE

SEQ ID NO: 44861 - protein, 25 aa, synthetic construct
  source 1..25: note = Seed: QTVHSIPLTINKEEALQRPVASDFE
QTVHSIPLTINKEFALCRVVASDFE

SEQ ID NO: 44862 - protein, 25 aa, synthetic construct
  source 1..25: note = Seed: QTVHSIPLTINKEEALQRPVASDFE
QTVHSIPLTINKEFALDRAVAADFE

SEQ ID NO: 44863 - protein, 25 aa, synthetic construct
  source 1..25: note = Seed: QTVHSIPLTINKEEALQRPVASDFE
QTVHSIPLTINKEFALDRAVANDFE

SEQ ID NO: 44864 - protein, 25 aa, synthetic construct
  source 1..25: note = Seed: QTVHSIPLTINKEEALQRPVASDFE
QTVHSIPLTINKEFALDRAVASDFE

SEQ ID NO: 44865 - protein, 25 aa, synthetic construct
  source 1..25: note = Seed: QTVHSIPLTINKEEALQRPVASDFE
QTVHSIPLTINKEFALERAVAADFE

SEQ ID NO: 44866 - protein, 25 aa, synthetic construct
  source 1..25: note = Seed: QTVHSIPLTINKEEALQRPVASDFE
QTVHSIPLTINKEFALERAVADDFE

SEQ ID NO: 44867 - protein, 25 aa, synthetic construct
  source 1..25: note = Seed: QTVHSIPLTINKEEALQRPVASDFE
QTVHSIPLTINKEFALERAVAGDFE

SEQ ID NO: 44868 - protein, 25 aa, synthetic construct
  source 1..25: note = Seed: QTVHSIPLTINKEEALQRPVASDFE
QTVHSIPLTINKEFALERAVAHDFE

SEQ ID NO: 44869 - protein, 25 aa, synthetic construct
  source 1..25: note = Seed: QTVHSIPLTINKEEALQRPVASDFE
QTVHSIPLTINKEFALERAVAIDFE

SEQ ID NO: 44870 - protein, 25 aa, synthetic construct
  source 1..25: note = Seed: QTVHSIPLTINKEEALQRPVASDFE
QTVHSIPLTINKEFALERAVALDFE

SEQ ID NO: 44871 - protein, 25 aa, synthetic construct
  source 1..25: note = Seed: QTVHSIPLTINKEEALQRPVASDFE
QTVHSIPLTINKEFALERAVAMDFE

SEQ ID NO: 44872 - protein, 25 aa, synthetic construct
  source 1..25: note = Seed: QTVHSIPLTINKEEALQRPVASDFE
QTVHSIPLTINKEFALERAVANDFE

SEQ ID NO: 44873 - protein, 25 aa, synthetic construct
  source 1..25: note = Seed: QTVHSIPLTINKEEALQRPVASDFE
QTVHSIPLTINKEFALERAVAPDFE

SEQ ID NO: 44874 - protein, 25 aa, synthetic construct
  source 1..25: note = Seed: QTVHSIPLTINKEEALQRPVASDFE
QTVHSIPLTINKEFALERAVAQDFE

SEQ ID NO: 44875 - protein, 25 aa, synthetic construct
  source 1..25: note = Seed: QTVHSIPLTINKEEALQRPVASDFE
QTVHSIPLTINKEFALERAVASDFE

SEQ ID NO: 44876 - protein, 25 aa, synthetic construct
  source 1..25: note = Seed: QTVHSIPLTINKEEALQRPVASDFE
QTVHSIPLTINKEFALERAVATDFE

SEQ ID NO: 44877 - protein, 25 aa, synthetic construct
  source 1..25: note = Seed: QTVHSIPLTINKEEALQRPVASDFE
QTVHSIPLTINKEFALERAVAVDFE

SEQ ID NO: 44878 - protein, 25 aa, synthetic construct
  source 1..25: note = Seed: QTVHSIPLTINKEEALQRPVASDFE
QTVHSIPLTINKEFALERGVAADFE

SEQ ID NO: 44879 - protein, 25 aa, synthetic construct
  source 1..25: note = Seed: QTVHSIPLTINKEEALQRPVASDFE
QTVHSIPLTINKEFALERGVAGDFE

SEQ ID NO: 44880 - protein, 25 aa, synthetic construct
  source 1..25: note = Seed: QTVHSIPLTINKEEALQRPVASDFE
QTVHSIPLTINKEFALERGVAIDFE

SEQ ID NO: 44881 - protein, 25 aa, synthetic construct
  source 1..25: note = Seed: QTVHSIPLTINKEEALQRPVASDFE
QTVHSIPLTINKEFALERGVANDFE

SEQ ID NO: 44882 - protein, 25 aa, synthetic construct
  source 1..25: note = Seed: QTVHSIPLTINKEEALQRPVASDFE
QTVHSIPLTINKEFALERGVASDFE

SEQ ID NO: 44883 - protein, 25 aa, synthetic construct
  source 1..25: note = Seed: QTVHSIPLTINKEEALQRPVASDFE
QTVHSIPLTINKEFALERGVATDFE

SEQ ID NO: 44884 - protein, 25 aa, synthetic construct
  source 1..25: note = Seed: QTVHSIPLTINKEEALQRPVASDFE
QTVHSIPLTINKEFALERGVAVDFE

SEQ ID NO: 44885 - protein, 25 aa, synthetic construct
  source 1..25: note = Seed: QTVHSIPLTINKEEALQRPVASDFE
QTVHSIPLTINKEFALERIVAADFE

SEQ ID NO: 44886 - protein, 25 aa, synthetic construct
  source 1..25: note = Seed: QTVHSIPLTINKEEALQRPVASDFE
QTVHSIPLTINKEFALERIVAGDFE

SEQ ID NO: 44887 - protein, 25 aa, synthetic construct
  source 1..25: note = Seed: QTVHSIPLTINKEEALQRPVASDFE
QTVHSIPLTINKEFALERIVANDFE

SEQ ID NO: 44888 - protein, 25 aa, synthetic construct
  source 1..25: note = Seed: QTVHSIPLTINKEEALQRPVASDFE
QTVHSIPLTINKEFALERIVASDFE

SEQ ID NO: 44889 - protein, 25 aa, synthetic construct
  source 1..25: note = Seed: QTVHSIPLTINKEEALQRPVASDFE
QTVHSIPLTINKEFALERIVATDFE

SEQ ID NO: 44890 - protein, 25 aa, synthetic construct
  source 1..25: note = Seed: QTVHSIPLTINKEEALQRPVASDFE
QTVHSIPLTINKEFALERNVAADFE

SEQ ID NO: 44891 - protein, 25 aa, synthetic construct
  source 1..25: note = Seed: QTVHSIPLTINKEEALQRPVASDFE
QTVHSIPLTINKEFALERNVAGDFE

SEQ ID NO: 44892 - protein, 25 aa, synthetic construct
  source 1..25: note = Seed: QTVHSIPLTINKEEALQRPVASDFE
QTVHSIPLTINKEFALERNVANDFE

SEQ ID NO: 44893 - protein, 25 aa, synthetic construct
  source 1..25: note = Seed: QTVHSIPLTINKEEALQRPVASDFE
QTVHSIPLTINKEFALERNVASDFE

SEQ ID NO: 44894 - protein, 25 aa, synthetic construct
  source 1..25: note = Seed: QTVHSIPLTINKEEALQRPVASDFE
QTVHSIPLTINKEFALERNVATDFE

SEQ ID NO: 44895 - protein, 25 aa, synthetic construct
  source 1..25: note = Seed: QTVHSIPLTINKEEALQRPVASDFE
QTVHSIPLTINKEFALERNVAVDFE

SEQ ID NO: 44896 - protein, 25 aa, synthetic construct
  source 1..25: note = Seed: QTVHSIPLTINKEEALQRPVASDFE
QTVHSIPLTINKEFALERPVAADFE

SEQ ID NO: 44897 - protein, 25 aa, synthetic construct
  source 1..25: note = Seed: QTVHSIPLTINKEEALQRPVASDFE
QTVHSIPLTINKEFALERPVAGDFE

SEQ ID NO: 44898 - protein, 25 aa, synthetic construct
  source 1..25: note = Seed: QTVHSIPLTINKEEALQRPVASDFE
QTVHSIPLTINKEFALERPVAHDFE

SEQ ID NO: 44899 - protein, 25 aa, synthetic construct
  source 1..25: note = Seed: QTVHSIPLTINKEEALQRPVASDFE
QTVHSIPLTINKEFALERPVAIDFE

SEQ ID NO: 44900 - protein, 25 aa, synthetic construct
  source 1..25: note = Seed: QTVHSIPLTINKEEALQRPVASDFE
QTVHSIPLTINKEFALERPVALDFE

SEQ ID NO: 44901 - protein, 25 aa, synthetic construct
  source 1..25: note = Seed: QTVHSIPLTINKEEALQRPVASDFE
QTVHSIPLTINKEFALERPVAMDFE

SEQ ID NO: 44902 - protein, 25 aa, synthetic construct
  source 1..25: note = Seed: QTVHSIPLTINKEEALQRPVASDFE
QTVHSIPLTINKEFALERPVANDFE

SEQ ID NO: 44903 - protein, 25 aa, synthetic construct
  source 1..25: note = Seed: QTVHSIPLTINKEEALQRPVASDFE
QTVHSIPLTINKEFALERPVAQDFE

SEQ ID NO: 44904 - protein, 25 aa, synthetic construct
  source 1..25: note = Seed: QTVHSIPLTINKEEALQRPVASDFE
QTVHSIPLTINKEFALERPVASDFE

SEQ ID NO: 44905 - protein, 25 aa, synthetic construct
  source 1..25: note = Seed: QTVHSIPLTINKEEALQRPVASDFE
QTVHSIPLTINKEFALERPVATDFE

SEQ ID NO: 44906 - protein, 25 aa, synthetic construct
  source 1..25: note = Seed: QTVHSIPLTINKEEALQRPVASDFE
QTVHSIPLTINKEFALERPVAVDFE

SEQ ID NO: 44907 - protein, 25 aa, synthetic construct
  source 1..25: note = Seed: QTVHSIPLTINKEEALQRPVASDFE
QTVHSIPLTINKEFALERSVAADFE

SEQ ID NO: 44908 - protein, 25 aa, synthetic construct
  source 1..25: note = Seed: QTVHSIPLTINKEEALQRPVASDFE
QTVHSIPLTINKEFALERSVAGDFE

SEQ ID NO: 44909 - protein, 25 aa, synthetic construct
  source 1..25: note = Seed: QTVHSIPLTINKEEALQRPVASDFE
QTVHSIPLTINKEFALERSVAHDFE

SEQ ID NO: 44910 - protein, 25 aa, synthetic construct
  source 1..25: note = Seed: QTVHSIPLTINKEEALQRPVASDFE
QTVHSIPLTINKEFALERSVAIDFE

SEQ ID NO: 44911 - protein, 25 aa, synthetic construct
  source 1..25: note = Seed: QTVHSIPLTINKEEALQRPVASDFE
QTVHSIPLTINKEFALERSVALDFE

SEQ ID NO: 44912 - protein, 25 aa, synthetic construct
  source 1..25: note = Seed: QTVHSIPLTINKEEALQRPVASDFE
QTVHSIPLTINKEFALERSVAMDFE

SEQ ID NO: 44913 - protein, 25 aa, synthetic construct
  source 1..25: note = Seed: QTVHSIPLTINKEEALQRPVASDFE
QTVHSIPLTINKEFALERSVANDFE

SEQ ID NO: 44914 - protein, 25 aa, synthetic construct
  source 1..25: note = Seed: QTVHSIPLTINKEEALQRPVASDFE
QTVHSIPLTINKEFALERSVAQDFE

SEQ ID NO: 44915 - protein, 25 aa, synthetic construct
  source 1..25: note = Seed: QTVHSIPLTINKEEALQRPVASDFE
QTVHSIPLTINKEFALERSVASDFE

SEQ ID NO: 44916 - protein, 25 aa, synthetic construct
  source 1..25: note = Seed: QTVHSIPLTINKEEALQRPVASDFE
QTVHSIPLTINKEFALERSVATDFE

SEQ ID NO: 44917 - protein, 25 aa, synthetic construct
  source 1..25: note = Seed: QTVHSIPLTINKEEALQRPVASDFE
QTVHSIPLTINKEFALERSVAVDFE

SEQ ID NO: 44918 - protein, 25 aa, synthetic construct
  source 1..25: note = Seed: QTVHSIPLTINKEEALQRPVASDFE
QTVHSIPLTINKEFALERTVAADFE

SEQ ID NO: 44919 - protein, 25 aa, synthetic construct
  source 1..25: note = Seed: QTVHSIPLTINKEEALQRPVASDFE
QTVHSIPLTINKEFALERTVAGDFE

SEQ ID NO: 44920 - protein, 25 aa, synthetic construct
  source 1..25: note = Seed: QTVHSIPLTINKEEALQRPVASDFE
QTVHSIPLTINKEFALERTVAHDFE

SEQ ID NO: 44921 - protein, 25 aa, synthetic construct
  source 1..25: note = Seed: QTVHSIPLTINKEEALQRPVASDFE
QTVHSIPLTINKEFALERTVAIDFE

SEQ ID NO: 44922 - protein, 25 aa, synthetic construct
  source 1..25: note = Seed: QTVHSIPLTINKEEALQRPVASDFE
QTVHSIPLTINKEFALERTVALDFE

SEQ ID NO: 44923 - protein, 25 aa, synthetic construct
  source 1..25: note = Seed: QTVHSIPLTINKEEALQRPVASDFE
QTVHSIPLTINKEFALERTVAMDFE

SEQ ID NO: 44924 - protein, 25 aa, synthetic construct
  source 1..25: note = Seed: QTVHSIPLTINKEEALQRPVASDFE
QTVHSIPLTINKEFALERTVANDFE

SEQ ID NO: 44925 - protein, 25 aa, synthetic construct
  source 1..25: note = Seed: QTVHSIPLTINKEEALQRPVASDFE
QTVHSIPLTINKEFALERTVAQDFE

SEQ ID NO: 44926 - protein, 25 aa, synthetic construct
  source 1..25: note = Seed: QTVHSIPLTINKEEALQRPVASDFE
QTVHSIPLTINKEFALERTVASDFE

SEQ ID NO: 44927 - protein, 25 aa, synthetic construct
  source 1..25: note = Seed: QTVHSIPLTINKEEALQRPVASDFE
QTVHSIPLTINKEFALERTVATDFE

SEQ ID NO: 44928 - protein, 25 aa, synthetic construct
  source 1..25: note = Seed: QTVHSIPLTINKEEALQRPVASDFE
QTVHSIPLTINKEFALERTVAVDFE

SEQ ID NO: 44929 - protein, 25 aa, synthetic construct
  source 1..25: note = Seed: QTVHSIPLTINKEEALQRPVASDFE
QTVHSIPLTINKEFALERVVAADFE

SEQ ID NO: 44930 - protein, 25 aa, synthetic construct
  source 1..25: note = Seed: QTVHSIPLTINKEEALQRPVASDFE
QTVHSIPLTINKEFALERVVAGDFE

SEQ ID NO: 44931 - protein, 25 aa, synthetic construct
  source 1..25: note = Seed: QTVHSIPLTINKEEALQRPVASDFE
QTVHSIPLTINKEFALERVVAHDFE

SEQ ID NO: 44932 - protein, 25 aa, synthetic construct
  source 1..25: note = Seed: QTVHSIPLTINKEEALQRPVASDFE
QTVHSIPLTINKEFALERVVAIDFE

SEQ ID NO: 44933 - protein, 25 aa, synthetic construct
  source 1..25: note = Seed: QTVHSIPLTINKEEALQRPVASDFE
QTVHSIPLTINKEFALERVVAMDFE

SEQ ID NO: 44934 - protein, 25 aa, synthetic construct
  source 1..25: note = Seed: QTVHSIPLTINKEEALQRPVASDFE
QTVHSIPLTINKEFALERVVANDFE

SEQ ID NO: 44935 - protein, 25 aa, synthetic construct
  source 1..25: note = Seed: QTVHSIPLTINKEEALQRPVASDFE
QTVHSIPLTINKEFALERVVAQDFE

SEQ ID NO: 44936 - protein, 25 aa, synthetic construct
  source 1..25: note = Seed: QTVHSIPLTINKEEALQRPVASDFE
QTVHSIPLTINKEFALERVVASDFE

SEQ ID NO: 44937 - protein, 25 aa, synthetic construct
  source 1..25: note = Seed: QTVHSIPLTINKEEALQRPVASDFE
QTVHSIPLTINKEFALERVVATDFE

SEQ ID NO: 44938 - protein, 25 aa, synthetic construct
  source 1..25: note = Seed: QTVHSIPLTINKEEALQRPVASDFE
QTVHSIPLTINKEFALERVVAVDFE

SEQ ID NO: 44939 - protein, 25 aa, synthetic construct
  source 1..25: note = Seed: QTVHSIPLTINKEEALQRPVASDFE
QTVHSIPLTINKEFALFRAVAADFE

SEQ ID NO: 44940 - protein, 25 aa, synthetic construct
  source 1..25: note = Seed: QTVHSIPLTINKEEALQRPVASDFE
QTVHSIPLTINKEFALFRAVADDFE

SEQ ID NO: 44941 - protein, 25 aa, synthetic construct
  source 1..25: note = Seed: QTVHSIPLTINKEEALQRPVASDFE
QTVHSIPLTINKEFALFRAVAEDFE

SEQ ID NO: 44942 - protein, 25 aa, synthetic construct
  source 1..25: note = Seed: QTVHSIPLTINKEEALQRPVASDFE
QTVHSIPLTINKEFALFRAVAGDFE

SEQ ID NO: 44943 - protein, 25 aa, synthetic construct
  source 1..25: note = Seed: QTVHSIPLTINKEEALQRPVASDFE
QTVHSIPLTINKEFALFRAVAHDFE

SEQ ID NO: 44944 - protein, 25 aa, synthetic construct
  source 1..25: note = Seed: QTVHSIPLTINKEEALQRPVASDFE
QTVHSIPLTINKEFALFRAVAIDFE

SEQ ID NO: 44945 - protein, 25 aa, synthetic construct
  source 1..25: note = Seed: QTVHSIPLTINKEEALQRPVASDFE
QTVHSIPLTINKEFALFRAVALDFE

SEQ ID NO: 44946 - protein, 25 aa, synthetic construct
  source 1..25: note = Seed: QTVHSIPLTINKEEALQRPVASDFE
QTVHSIPLTINKEFALFRAVAMDFE

SEQ ID NO: 44947 - protein, 25 aa, synthetic construct
  source 1..25: note = Seed: QTVHSIPLTINKEEALQRPVASDFE
QTVHSIPLTINKEFALFRAVANDFE

SEQ ID NO: 44948 - protein, 25 aa, synthetic construct
  source 1..25: note = Seed: QTVHSIPLTINKEEALQRPVASDFE
QTVHSIPLTINKEFALFRAVAPDFE

SEQ ID NO: 44949 - protein, 25 aa, synthetic construct
  source 1..25: note = Seed: QTVHSIPLTINKEEALQRPVASDFE
QTVHSIPLTINKEFALFRAVAQDFE

SEQ ID NO: 44950 - protein, 25 aa, synthetic construct
  source 1..25: note = Seed: QTVHSIPLTINKEEALQRPVASDFE
QTVHSIPLTINKEFALFRAVASDFE

SEQ ID NO: 44951 - protein, 25 aa, synthetic construct
  source 1..25: note = Seed: QTVHSIPLTINKEEALQRPVASDFE
QTVHSIPLTINKEFALFRAVATDFE

SEQ ID NO: 44952 - protein, 25 aa, synthetic construct
  source 1..25: note = Seed: QTVHSIPLTINKEEALQRPVASDFE
QTVHSIPLTINKEFALFRAVAVDFE

SEQ ID NO: 44953 - protein, 25 aa, synthetic construct
  source 1..25: note = Seed: QTVHSIPLTINKEEALQRPVASDFE
QTVHSIPLTINKEFALFRGVAADFE

SEQ ID NO: 44954 - protein, 25 aa, synthetic construct
  source 1..25: note = Seed: QTVHSIPLTINKEEALQRPVASDFE
QTVHSIPLTINKEFALFRGVAGDFE

SEQ ID NO: 44955 - protein, 25 aa, synthetic construct
  source 1..25: note = Seed: QTVHSIPLTINKEEALQRPVASDFE
QTVHSIPLTINKEFALFRGVAHDFE

SEQ ID NO: 44956 - protein, 25 aa, synthetic construct
  source 1..25: note = Seed: QTVHSIPLTINKEEALQRPVASDFE
QTVHSIPLTINKEFALFRGVANDFE

SEQ ID NO: 44957 - protein, 25 aa, synthetic construct
  source 1..25: note = Seed: QTVHSIPLTINKEEALQRPVASDFE
QTVHSIPLTINKEFALFRGVASDFE

SEQ ID NO: 44958 - protein, 25 aa, synthetic construct
  source 1..25: note = Seed: QTVHSIPLTINKEEALQRPVASDFE
QTVHSIPLTINKEFALFRGVATDFE

SEQ ID NO: 44959 - protein, 25 aa, synthetic construct
  source 1..25: note = Seed: QTVHSIPLTINKEEALQRPVASDFE
QTVHSIPLTINKEFALFRGVAVDFE

SEQ ID NO: 44960 - protein, 25 aa, synthetic construct
  source 1..25: note = Seed: QTVHSIPLTINKEEALQRPVASDFE
QTVHSIPLTINKEFALFRIVAHDFE

SEQ ID NO: 44961 - protein, 25 aa, synthetic construct
  source 1..25: note = Seed: QTVHSIPLTINKEEALQRPVASDFE
QTVHSIPLTINKEFALFRIVANDFE

SEQ ID NO: 44962 - protein, 25 aa, synthetic construct
  source 1..25: note = Seed: QTVHSIPLTINKEEALQRPVASDFE
QTVHSIPLTINKEFALFRNVAADFE

SEQ ID NO: 44963 - protein, 25 aa, synthetic construct
  source 1..25: note = Seed: QTVHSIPLTINKEEALQRPVASDFE
QTVHSIPLTINKEFALFRNVAGDFE

SEQ ID NO: 44964 - protein, 25 aa, synthetic construct
  source 1..25: note = Seed: QTVHSIPLTINKEEALQRPVASDFE
QTVHSIPLTINKEFALFRNVAHDFE

SEQ ID NO: 44965 - protein, 25 aa, synthetic construct
  source 1..25: note = Seed: QTVHSIPLTINKEEALQRPVASDFE
QTVHSIPLTINKEFALFRNVAIDFE

SEQ ID NO: 44966 - protein, 25 aa, synthetic construct
  source 1..25: note = Seed: QTVHSIPLTINKEEALQRPVASDFE
QTVHSIPLTINKEFALFRNVANDFE

SEQ ID NO: 44967 - protein, 25 aa, synthetic construct
  source 1..25: note = Seed: QTVHSIPLTINKEEALQRPVASDFE
QTVHSIPLTINKEFALFRNVASDFE

SEQ ID NO: 44968 - protein, 25 aa, synthetic construct
  source 1..25: note = Seed: QTVHSIPLTINKEEALQRPVASDFE
QTVHSIPLTINKEFALFRNVATDFE

SEQ ID NO: 44969 - protein, 25 aa, synthetic construct
  source 1..25: note = Seed: QTVHSIPLTINKEEALQRPVASDFE
QTVHSIPLTINKEFALFRNVAVDFE

SEQ ID NO: 44970 - protein, 25 aa, synthetic construct
  source 1..25: note = Seed: QTVHSIPLTINKEEALQRPVASDFE
QTVHSIPLTINKEFALFRPVAADFE

SEQ ID NO: 44971 - protein, 25 aa, synthetic construct
  source 1..25: note = Seed: QTVHSIPLTINKEEALQRPVASDFE
QTVHSIPLTINKEFALFRPVADDFE

SEQ ID NO: 44972 - protein, 25 aa, synthetic construct
  source 1..25: note = Seed: QTVHSIPLTINKEEALQRPVASDFE
QTVHSIPLTINKEFALFRPVAEDFE

SEQ ID NO: 44973 - protein, 25 aa, synthetic construct
  source 1..25: note = Seed: QTVHSIPLTINKEEALQRPVASDFE
QTVHSIPLTINKEFALFRPVAGDFE

SEQ ID NO: 44974 - protein, 25 aa, synthetic construct
  source 1..25: note = Seed: QTVHSIPLTINKEEALQRPVASDFE
QTVHSIPLTINKEFALFRPVAHDFE

SEQ ID NO: 44975 - protein, 25 aa, synthetic construct
  source 1..25: note = Seed: QTVHSIPLTINKEEALQRPVASDFE
QTVHSIPLTINKEFALFRPVAIDFE

SEQ ID NO: 44976 - protein, 25 aa, synthetic construct
  source 1..25: note = Seed: QTVHSIPLTINKEEALQRPVASDFE
QTVHSIPLTINKEFALFRPVALDFE

SEQ ID NO: 44977 - protein, 25 aa, synthetic construct
  source 1..25: note = Seed: QTVHSIPLTINKEEALQRPVASDFE
QTVHSIPLTINKEFALFRPVAMDFE

SEQ ID NO: 44978 - protein, 25 aa, synthetic construct
  source 1..25: note = Seed: QTVHSIPLTINKEEALQRPVASDFE
QTVHSIPLTINKEFALFRPVANDFE

SEQ ID NO: 44979 - protein, 25 aa, synthetic construct
  source 1..25: note = Seed: QTVHSIPLTINKEEALQRPVASDFE
QTVHSIPLTINKEFALFRPVAPDFE

SEQ ID NO: 44980 - protein, 25 aa, synthetic construct
  source 1..25: note = Seed: QTVHSIPLTINKEEALQRPVASDFE
QTVHSIPLTINKEFALFRPVAQDFE

SEQ ID NO: 44981 - protein, 25 aa, synthetic construct
  source 1..25: note = Seed: QTVHSIPLTINKEEALQRPVASDFE
QTVHSIPLTINKEFALFRPVASDFE

SEQ ID NO: 44982 - protein, 25 aa, synthetic construct
  source 1..25: note = Seed: QTVHSIPLTINKEEALQRPVASDFE
QTVHSIPLTINKEFALFRPVATDFE

SEQ ID NO: 44983 - protein, 25 aa, synthetic construct
  source 1..25: note = Seed: QTVHSIPLTINKEEALQRPVASDFE
QTVHSIPLTINKEFALFRPVAVDFE

SEQ ID NO: 44984 - protein, 25 aa, synthetic construct
  source 1..25: note = Seed: QTVHSIPLTINKEEALQRPVASDFE
QTVHSIPLTINKEFALFRSVAADFE

SEQ ID NO: 44985 - protein, 25 aa, synthetic construct
  source 1..25: note = Seed: QTVHSIPLTINKEEALQRPVASDFE
QTVHSIPLTINKEFALFRSVADDFE

SEQ ID NO: 44986 - protein, 25 aa, synthetic construct
  source 1..25: note = Seed: QTVHSIPLTINKEEALQRPVASDFE
QTVHSIPLTINKEFALFRSVAGDFE

SEQ ID NO: 44987 - protein, 25 aa, synthetic construct
  source 1..25: note = Seed: QTVHSIPLTINKEEALQRPVASDFE
QTVHSIPLTINKEFALFRSVAHDFE

SEQ ID NO: 44988 - protein, 25 aa, synthetic construct
  source 1..25: note = Seed: QTVHSIPLTINKEEALQRPVASDFE
QTVHSIPLTINKEFALFRSVAIDFE

SEQ ID NO: 44989 - protein, 25 aa, synthetic construct
  source 1..25: note = Seed: QTVHSIPLTINKEEALQRPVASDFE
QTVHSIPLTINKEFALFRSVALDFE

SEQ ID NO: 44990 - protein, 25 aa, synthetic construct
  source 1..25: note = Seed: QTVHSIPLTINKEEALQRPVASDFE
QTVHSIPLTINKEFALFRSVAMDFE

SEQ ID NO: 44991 - protein, 25 aa, synthetic construct
  source 1..25: note = Seed: QTVHSIPLTINKEEALQRPVASDFE
QTVHSIPLTINKEFALFRSVANDFE

SEQ ID NO: 44992 - protein, 25 aa, synthetic construct
  source 1..25: note = Seed: QTVHSIPLTINKEEALQRPVASDFE
QTVHSIPLTINKEFALFRSVAQDFE

SEQ ID NO: 44993 - protein, 25 aa, synthetic construct
  source 1..25: note = Seed: QTVHSIPLTINKEEALQRPVASDFE
QTVHSIPLTINKEFALFRSVASDFE

SEQ ID NO: 44994 - protein, 25 aa, synthetic construct
  source 1..25: note = Seed: QTVHSIPLTINKEEALQRPVASDFE
QTVHSIPLTINKEFALFRSVATDFE

SEQ ID NO: 44995 - protein, 25 aa, synthetic construct
  source 1..25: note = Seed: QTVHSIPLTINKEEALQRPVASDFE
QTVHSIPLTINKEFALFRSVAVDFE

SEQ ID NO: 44996 - protein, 25 aa, synthetic construct
  source 1..25: note = Seed: QTVHSIPLTINKEEALQRPVASDFE
QTVHSIPLTINKEFALFRTVAADFE

SEQ ID NO: 44997 - protein, 25 aa, synthetic construct
  source 1..25: note = Seed: QTVHSIPLTINKEEALQRPVASDFE
QTVHSIPLTINKEFALFRTVADDFE

SEQ ID NO: 44998 - protein, 25 aa, synthetic construct
  source 1..25: note = Seed: QTVHSIPLTINKEEALQRPVASDFE
QTVHSIPLTINKEFALFRTVAGDFE

SEQ ID NO: 44999 - protein, 25 aa, synthetic construct
  source 1..25: note = Seed: QTVHSIPLTINKEEALQRPVASDFE
QTVHSIPLTINKEFALFRTVAHDFE

SEQ ID NO: 45000 - protein, 25 aa, synthetic construct
  source 1..25: note = Seed: QTVHSIPLTINKEEALQRPVASDFE
QTVHSIPLTINKEFALFRTVAIDFE

SEQ ID NO: 45001 - protein, 25 aa, synthetic construct
  source 1..25: note = Seed: QTVHSIPLTINKEEALQRPVASDFE
QTVHSIPLTINKEFALFRTVALDFE

SEQ ID NO: 45002 - protein, 25 aa, synthetic construct
  source 1..25: note = Seed: QTVHSIPLTINKEEALQRPVASDFE
QTVHSIPLTINKEFALFRTVAMDFE

SEQ ID NO: 45003 - protein, 25 aa, synthetic construct
  source 1..25: note = Seed: QTVHSIPLTINKEEALQRPVASDFE
QTVHSIPLTINKEFALFRTVANDFE

SEQ ID NO: 45004 - protein, 25 aa, synthetic construct
  source 1..25: note = Seed: QTVHSIPLTINKEEALQRPVASDFE
QTVHSIPLTINKEFALFRTVAPDFE

SEQ ID NO: 45005 - protein, 25 aa, synthetic construct
  source 1..25: note = Seed: QTVHSIPLTINKEEALQRPVASDFE
QTVHSIPLTINKEFALFRTVAQDFE

SEQ ID NO: 45006 - protein, 25 aa, synthetic construct
  source 1..25: note = Seed: QTVHSIPLTINKEEALQRPVASDFE
QTVHSIPLTINKEFALFRTVASDFE

SEQ ID NO: 45007 - protein, 25 aa, synthetic construct
  source 1..25: note = Seed: QTVHSIPLTINKEEALQRPVASDFE
QTVHSIPLTINKEFALFRTVATDFE

SEQ ID NO: 45008 - protein, 25 aa, synthetic construct
  source 1..25: note = Seed: QTVHSIPLTINKEEALQRPVASDFE
QTVHSIPLTINKEFALFRTVAVDFE

SEQ ID NO: 45009 - protein, 25 aa, synthetic construct
  source 1..25: note = Seed: QTVHSIPLTINKEEALQRPVASDFE
QTVHSIPLTINKEFALFRVVAADFE

SEQ ID NO: 45010 - protein, 25 aa, synthetic construct
  source 1..25: note = Seed: QTVHSIPLTINKEEALQRPVASDFE
QTVHSIPLTINKEFALFRVVAHDFE

SEQ ID NO: 45011 - protein, 25 aa, synthetic construct
  source 1..25: note = Seed: QTVHSIPLTINKEEALQRPVASDFE
QTVHSIPLTINKEFALFRVVANDFE

SEQ ID NO: 45012 - protein, 25 aa, synthetic construct
  source 1..25: note = Seed: QTVHSIPLTINKEEALQRPVASDFE
QTVHSIPLTINKEFALFRVVASDFE

SEQ ID NO: 45013 - protein, 25 aa, synthetic construct
  source 1..25: note = Seed: QTVHSIPLTINKEEALQRPVASDFE
QTVHSIPLTINKEFALGRAVAADFE

SEQ ID NO: 45014 - protein, 25 aa, synthetic construct
  source 1..25: note = Seed: QTVHSIPLTINKEEALQRPVASDFE
QTVHSIPLTINKEFALGRAVAGDFE

SEQ ID NO: 45015 - protein, 25 aa, synthetic construct
  source 1..25: note = Seed: QTVHSIPLTINKEEALQRPVASDFE
QTVHSIPLTINKEFALGRAVAHDFE

SEQ ID NO: 45016 - protein, 25 aa, synthetic construct
  source 1..25: note = Seed: QTVHSIPLTINKEEALQRPVASDFE
QTVHSIPLTINKEFALGRAVAIDFE

SEQ ID NO: 45017 - protein, 25 aa, synthetic construct
  source 1..25: note = Seed: QTVHSIPLTINKEEALQRPVASDFE
QTVHSIPLTINKEFALGRAVALDFE

SEQ ID NO: 45018 - protein, 25 aa, synthetic construct
  source 1..25: note = Seed: QTVHSIPLTINKEEALQRPVASDFE
QTVHSIPLTINKEFALGRAVAMDFE

SEQ ID NO: 45019 - protein, 25 aa, synthetic construct
  source 1..25: note = Seed: QTVHSIPLTINKEEALQRPVASDFE
QTVHSIPLTINKEFALGRAVANDFE

SEQ ID NO: 45020 - protein, 25 aa, synthetic construct
  source 1..25: note = Seed: QTVHSIPLTINKEEALQRPVASDFE
QTVHSIPLTINKEFALGRAVAQDFE

SEQ ID NO: 45021 - protein, 25 aa, synthetic construct
  source 1..25: note = Seed: QTVHSIPLTINKEEALQRPVASDFE
QTVHSIPLTINKEFALGRAVASDFE

SEQ ID NO: 45022 - protein, 25 aa, synthetic construct
  source 1..25: note = Seed: QTVHSIPLTINKEEALQRPVASDFE
QTVHSIPLTINKEFALGRAVATDFE

SEQ ID NO: 45023 - protein, 25 aa, synthetic construct
  source 1..25: note = Seed: QTVHSIPLTINKEEALQRPVASDFE
QTVHSIPLTINKEFALGRAVAVDFE

SEQ ID NO: 45024 - protein, 25 aa, synthetic construct
  source 1..25: note = Seed: QTVHSIPLTINKEEALQRPVASDFE
QTVHSIPLTINKEFALGRGVAADFE

SEQ ID NO: 45025 - protein, 25 aa, synthetic construct
  source 1..25: note = Seed: QTVHSIPLTINKEEALQRPVASDFE
QTVHSIPLTINKEFALGRGVALDFE

SEQ ID NO: 45026 - protein, 25 aa, synthetic construct
  source 1..25: note = Seed: QTVHSIPLTINKEEALQRPVASDFE
QTVHSIPLTINKEFALGRGVANDFE

SEQ ID NO: 45027 - protein, 25 aa, synthetic construct
  source 1..25: note = Seed: QTVHSIPLTINKEEALQRPVASDFE
QTVHSIPLTINKEFALGRGVASDFE

SEQ ID NO: 45028 - protein, 25 aa, synthetic construct
  source 1..25: note = Seed: QTVHSIPLTINKEEALQRPVASDFE
QTVHSIPLTINKEFALGRGVAVDFE

SEQ ID NO: 45029 - protein, 25 aa, synthetic construct
  source 1..25: note = Seed: QTVHSIPLTINKEEALQRPVASDFE
QTVHSIPLTINKEFALGRIVAADFE

SEQ ID NO: 45030 - protein, 25 aa, synthetic construct
  source 1..25: note = Seed: QTVHSIPLTINKEEALQRPVASDFE
QTVHSIPLTINKEFALGRIVAMDFE

SEQ ID NO: 45031 - protein, 25 aa, synthetic construct
  source 1..25: note = Seed: QTVHSIPLTINKEEALQRPVASDFE
QTVHSIPLTINKEFALGRIVANDFE

SEQ ID NO: 45032 - protein, 25 aa, synthetic construct
  source 1..25: note = Seed: QTVHSIPLTINKEEALQRPVASDFE
QTVHSIPLTINKEFALGRIVASDFE

SEQ ID NO: 45033 - protein, 25 aa, synthetic construct
  source 1..25: note = Seed: QTVHSIPLTINKEEALQRPVASDFE
QTVHSIPLTINKEFALGRIVATDFE

SEQ ID NO: 45034 - protein, 25 aa, synthetic construct
  source 1..25: note = Seed: QTVHSIPLTINKEEALQRPVASDFE
QTVHSIPLTINKEFALGRIVAVDFE

SEQ ID NO: 45035 - protein, 25 aa, synthetic construct
  source 1..25: note = Seed: QTVHSIPLTINKEEALQRPVASDFE
QTVHSIPLTINKEFALGRLVANDFE

SEQ ID NO: 45036 - protein, 25 aa, synthetic construct
  source 1..25: note = Seed: QTVHSIPLTINKEEALQRPVASDFE
QTVHSIPLTINKEFALGRNVAADFE

SEQ ID NO: 45037 - protein, 25 aa, synthetic construct
  source 1..25: note = Seed: QTVHSIPLTINKEEALQRPVASDFE
QTVHSIPLTINKEFALGRNVAIDFE

SEQ ID NO: 45038 - protein, 25 aa, synthetic construct
  source 1..25: note = Seed: QTVHSIPLTINKEEALQRPVASDFE
QTVHSIPLTINKEFALGRNVAMDFE

SEQ ID NO: 45039 - protein, 25 aa, synthetic construct
  source 1..25: note = Seed: QTVHSIPLTINKEEALQRPVASDFE
QTVHSIPLTINKEFALGRNVANDFE

SEQ ID NO: 45040 - protein, 25 aa, synthetic construct
  source 1..25: note = Seed: QTVHSIPLTINKEEALQRPVASDFE
QTVHSIPLTINKEFALGRNVASDFE

SEQ ID NO: 45041 - protein, 25 aa, synthetic construct
  source 1..25: note = Seed: QTVHSIPLTINKEEALQRPVASDFE
QTVHSIPLTINKEFALGRNVAVDFE

SEQ ID NO: 45042 - protein, 25 aa, synthetic construct
  source 1..25: note = Seed: QTVHSIPLTINKEEALQRPVASDFE
QTVHSIPLTINKEFALGRPVAADFE

SEQ ID NO: 45043 - protein, 25 aa, synthetic construct
  source 1..25: note = Seed: QTVHSIPLTINKEEALQRPVASDFE
QTVHSIPLTINKEFALGRPVAHDFE

SEQ ID NO: 45044 - protein, 25 aa, synthetic construct
  source 1..25: note = Seed: QTVHSIPLTINKEEALQRPVASDFE
QTVHSIPLTINKEFALGRPVAIDFE

SEQ ID NO: 45045 - protein, 25 aa, synthetic construct
  source 1..25: note = Seed: QTVHSIPLTINKEEALQRPVASDFE
QTVHSIPLTINKEFALGRPVALDFE

SEQ ID NO: 45046 - protein, 25 aa, synthetic construct
  source 1..25: note = Seed: QTVHSIPLTINKEEALQRPVASDFE
QTVHSIPLTINKEFALGRPVAMDFE

SEQ ID NO: 45047 - protein, 25 aa, synthetic construct
  source 1..25: note = Seed: QTVHSIPLTINKEEALQRPVASDFE
QTVHSIPLTINKEFALGRPVANDFE

SEQ ID NO: 45048 - protein, 25 aa, synthetic construct
  source 1..25: note = Seed: QTVHSIPLTINKEEALQRPVASDFE
QTVHSIPLTINKEFALGRPVAQDFE

SEQ ID NO: 45049 - protein, 25 aa, synthetic construct
  source 1..25: note = Seed: QTVHSIPLTINKEEALQRPVASDFE
QTVHSIPLTINKEFALGRPVASDFE

SEQ ID NO: 45050 - protein, 25 aa, synthetic construct
  source 1..25: note = Seed: QTVHSIPLTINKEEALQRPVASDFE
QTVHSIPLTINKEFALGRPVATDFE

SEQ ID NO: 45051 - protein, 25 aa, synthetic construct
  source 1..25: note = Seed: QTVHSIPLTINKEEALQRPVASDFE
QTVHSIPLTINKEFALGRPVAVDFE

SEQ ID NO: 45052 - protein, 25 aa, synthetic construct
  source 1..25: note = Seed: QTVHSIPLTINKEEALQRPVASDFE
QTVHSIPLTINKEFALGRSVAADFE

SEQ ID NO: 45053 - protein, 25 aa, synthetic construct
  source 1..25: note = Seed: QTVHSIPLTINKEEALQRPVASDFE
QTVHSIPLTINKEFALGRSVAGDFE

SEQ ID NO: 45054 - protein, 25 aa, synthetic construct
  source 1..25: note = Seed: QTVHSIPLTINKEEALQRPVASDFE
QTVHSIPLTINKEFALGRSVAHDFE

SEQ ID NO: 45055 - protein, 25 aa, synthetic construct
  source 1..25: note = Seed: QTVHSIPLTINKEEALQRPVASDFE
QTVHSIPLTINKEFALGRSVAIDFE

SEQ ID NO: 45056 - protein, 25 aa, synthetic construct
  source 1..25: note = Seed: QTVHSIPLTINKEEALQRPVASDFE
QTVHSIPLTINKEFALGRSVALDFE

SEQ ID NO: 45057 - protein, 25 aa, synthetic construct
  source 1..25: note = Seed: QTVHSIPLTINKEEALQRPVASDFE
QTVHSIPLTINKEFALGRSVAMDFE

SEQ ID NO: 45058 - protein, 25 aa, synthetic construct
  source 1..25: note = Seed: QTVHSIPLTINKEEALQRPVASDFE
QTVHSIPLTINKEFALGRSVANDFE

SEQ ID NO: 45059 - protein, 25 aa, synthetic construct
  source 1..25: note = Seed: QTVHSIPLTINKEEALQRPVASDFE
QTVHSIPLTINKEFALGRSVAQDFE

SEQ ID NO: 45060 - protein, 25 aa, synthetic construct
  source 1..25: note = Seed: QTVHSIPLTINKEEALQRPVASDFE
QTVHSIPLTINKEFALGRSVASDFE

SEQ ID NO: 45061 - protein, 25 aa, synthetic construct
  source 1..25: note = Seed: QTVHSIPLTINKEEALQRPVASDFE
QTVHSIPLTINKEFALGRSVATDFE

SEQ ID NO: 45062 - protein, 25 aa, synthetic construct
  source 1..25: note = Seed: QTVHSIPLTINKEEALQRPVASDFE
QTVHSIPLTINKEFALGRSVAVDFE

SEQ ID NO: 45063 - protein, 25 aa, synthetic construct
  source 1..25: note = Seed: QTVHSIPLTINKEEALQRPVASDFE
QTVHSIPLTINKEFALGRTVAADFE

SEQ ID NO: 45064 - protein, 25 aa, synthetic construct
  source 1..25: note = Seed: QTVHSIPLTINKEEALQRPVASDFE
QTVHSIPLTINKEFALGRTVAGDFE

SEQ ID NO: 45065 - protein, 25 aa, synthetic construct
  source 1..25: note = Seed: QTVHSIPLTINKEEALQRPVASDFE
QTVHSIPLTINKEFALGRTVAHDFE

SEQ ID NO: 45066 - protein, 25 aa, synthetic construct
  source 1..25: note = Seed: QTVHSIPLTINKEEALQRPVASDFE
QTVHSIPLTINKEFALGRTVAIDFE

SEQ ID NO: 45067 - protein, 25 aa, synthetic construct
  source 1..25: note = Seed: QTVHSIPLTINKEEALQRPVASDFE
QTVHSIPLTINKEFALGRTVALDFE

SEQ ID NO: 45068 - protein, 25 aa, synthetic construct
  source 1..25: note = Seed: QTVHSIPLTINKEEALQRPVASDFE
QTVHSIPLTINKEFALGRTVAMDFE

SEQ ID NO: 45069 - protein, 25 aa, synthetic construct
  source 1..25: note = Seed: QTVHSIPLTINKEEALQRPVASDFE
QTVHSIPLTINKEFALGRTVANDFE

SEQ ID NO: 45070 - protein, 25 aa, synthetic construct
  source 1..25: note = Seed: QTVHSIPLTINKEEALQRPVASDFE
QTVHSIPLTINKEFALGRTVAQDFE

SEQ ID NO: 45071 - protein, 25 aa, synthetic construct
  source 1..25: note = Seed: QTVHSIPLTINKEEALQRPVASDFE
QTVHSIPLTINKEFALGRTVASDFE

SEQ ID NO: 45072 - protein, 25 aa, synthetic construct
  source 1..25: note = Seed: QTVHSIPLTINKEEALQRPVASDFE
QTVHSIPLTINKEFALGRTVATDFE

SEQ ID NO: 45073 - protein, 25 aa, synthetic construct
  source 1..25: note = Seed: QTVHSIPLTINKEEALQRPVASDFE
QTVHSIPLTINKEFALGRTVAVDFE

SEQ ID NO: 45074 - protein, 25 aa, synthetic construct
  source 1..25: note = Seed: QTVHSIPLTINKEEALQRPVASDFE
QTVHSIPLTINKEFALGRVVAADFE

SEQ ID NO: 45075 - protein, 25 aa, synthetic construct
  source 1..25: note = Seed: QTVHSIPLTINKEEALQRPVASDFE
QTVHSIPLTINKEFALGRVVAGDFE

SEQ ID NO: 45076 - protein, 25 aa, synthetic construct
  source 1..25: note = Seed: QTVHSIPLTINKEEALQRPVASDFE
QTVHSIPLTINKEFALGRVVAHDFE

SEQ ID NO: 45077 - protein, 25 aa, synthetic construct
  source 1..25: note = Seed: QTVHSIPLTINKEEALQRPVASDFE
QTVHSIPLTINKEFALGRVVAIDFE

SEQ ID NO: 45078 - protein, 25 aa, synthetic construct
  source 1..25: note = Seed: QTVHSIPLTINKEEALQRPVASDFE
QTVHSIPLTINKEFALGRVVALDFE

SEQ ID NO: 45079 - protein, 25 aa, synthetic construct
  source 1..25: note = Seed: QTVHSIPLTINKEEALQRPVASDFE
QTVHSIPLTINKEFALGRVVAMDFE

SEQ ID NO: 45080 - protein, 25 aa, synthetic construct
  source 1..25: note = Seed: QTVHSIPLTINKEEALQRPVASDFE
QTVHSIPLTINKEFALGRVVANDFE

SEQ ID NO: 45081 - protein, 25 aa, synthetic construct
  source 1..25: note = Seed: QTVHSIPLTINKEEALQRPVASDFE
QTVHSIPLTINKEFALGRVVAQDFE

SEQ ID NO: 45082 - protein, 25 aa, synthetic construct
  source 1..25: note = Seed: QTVHSIPLTINKEEALQRPVASDFE
QTVHSIPLTINKEFALGRVVASDFE

SEQ ID NO: 45083 - protein, 25 aa, synthetic construct
  source 1..25: note = Seed: QTVHSIPLTINKEEALQRPVASDFE
QTVHSIPLTINKEFALGRVVATDFE

SEQ ID NO: 45084 - protein, 25 aa, synthetic construct
  source 1..25: note = Seed: QTVHSIPLTINKEEALQRPVASDFE
QTVHSIPLTINKEFALGRVVAVDFE

SEQ ID NO: 45085 - protein, 25 aa, synthetic construct
  source 1..25: note = Seed: QTVHSIPLTINKEEALQRPVASDFE
QTVHSIPLTINKEFALHRAVAADFE

SEQ ID NO: 45086 - protein, 25 aa, synthetic construct
  source 1..25: note = Seed: QTVHSIPLTINKEEALQRPVASDFE
QTVHSIPLTINKEFALHRAVAGDFE

SEQ ID NO: 45087 - protein, 25 aa, synthetic construct
  source 1..25: note = Seed: QTVHSIPLTINKEEALQRPVASDFE
QTVHSIPLTINKEFALHRAVAHDFE

SEQ ID NO: 45088 - protein, 25 aa, synthetic construct
  source 1..25: note = Seed: QTVHSIPLTINKEEALQRPVASDFE
QTVHSIPLTINKEFALHRAVAIDFE

SEQ ID NO: 45089 - protein, 25 aa, synthetic construct
  source 1..25: note = Seed: QTVHSIPLTINKEEALQRPVASDFE
QTVHSIPLTINKEFALHRAVALDFE

SEQ ID NO: 45090 - protein, 25 aa, synthetic construct
  source 1..25: note = Seed: QTVHSIPLTINKEEALQRPVASDFE
QTVHSIPLTINKEFALHRAVAMDFE

SEQ ID NO: 45091 - protein, 25 aa, synthetic construct
  source 1..25: note = Seed: QTVHSIPLTINKEEALQRPVASDFE
QTVHSIPLTINKEFALHRAVANDFE

SEQ ID NO: 45092 - protein, 25 aa, synthetic construct
  source 1..25: note = Seed: QTVHSIPLTINKEEALQRPVASDFE
QTVHSIPLTINKEFALHRAVAQDFE

SEQ ID NO: 45093 - protein, 25 aa, synthetic construct
  source 1..25: note = Seed: QTVHSIPLTINKEEALQRPVASDFE
QTVHSIPLTINKEFALHRAVASDFE

SEQ ID NO: 45094 - protein, 25 aa, synthetic construct
  source 1..25: note = Seed: QTVHSIPLTINKEEALQRPVASDFE
QTVHSIPLTINKEFALHRAVATDFE

SEQ ID NO: 45095 - protein, 25 aa, synthetic construct
  source 1..25: note = Seed: QTVHSIPLTINKEEALQRPVASDFE
QTVHSIPLTINKEFALHRAVAVDFE

SEQ ID NO: 45096 - protein, 25 aa, synthetic construct
  source 1..25: note = Seed: QTVHSIPLTINKEEALQRPVASDFE
QTVHSIPLTINKEFALHRGVAADFE

SEQ ID NO: 45097 - protein, 25 aa, synthetic construct
  source 1..25: note = Seed: QTVHSIPLTINKEEALQRPVASDFE
QTVHSIPLTINKEFALHRGVANDFE

SEQ ID NO: 45098 - protein, 25 aa, synthetic construct
  source 1..25: note = Seed: QTVHSIPLTINKEEALQRPVASDFE
QTVHSIPLTINKEFALHRGVASDFE

SEQ ID NO: 45099 - protein, 25 aa, synthetic construct
  source 1..25: note = Seed: QTVHSIPLTINKEEALQRPVASDFE
QTVHSIPLTINKEFALHRIVAADFE

SEQ ID NO: 45100 - protein, 25 aa, synthetic construct
  source 1..25: note = Seed: QTVHSIPLTINKEEALQRPVASDFE
QTVHSIPLTINKEFALHRIVANDFE

SEQ ID NO: 45101 - protein, 25 aa, synthetic construct
  source 1..25: note = Seed: QTVHSIPLTINKEEALQRPVASDFE
QTVHSIPLTINKEFALHRIVASDFE

SEQ ID NO: 45102 - protein, 25 aa, synthetic construct
  source 1..25: note = Seed: QTVHSIPLTINKEEALQRPVASDFE
QTVHSIPLTINKEFALHRNVAADFE

SEQ ID NO: 45103 - protein, 25 aa, synthetic construct
  source 1..25: note = Seed: QTVHSIPLTINKEEALQRPVASDFE
QTVHSIPLTINKEFALHRNVANDFE

SEQ ID NO: 45104 - protein, 25 aa, synthetic construct
  source 1..25: note = Seed: QTVHSIPLTINKEEALQRPVASDFE
QTVHSIPLTINKEFALHRPVAADFE

SEQ ID NO: 45105 - protein, 25 aa, synthetic construct
  source 1..25: note = Seed: QTVHSIPLTINKEEALQRPVASDFE
QTVHSIPLTINKEFALHRPVAIDFE

SEQ ID NO: 45106 - protein, 25 aa, synthetic construct
  source 1..25: note = Seed: QTVHSIPLTINKEEALQRPVASDFE
QTVHSIPLTINKEFALHRPVALDFE

SEQ ID NO: 45107 - protein, 25 aa, synthetic construct
  source 1..25: note = Seed: QTVHSIPLTINKEEALQRPVASDFE
QTVHSIPLTINKEFALHRPVAMDFE

SEQ ID NO: 45108 - protein, 25 aa, synthetic construct
  source 1..25: note = Seed: QTVHSIPLTINKEEALQRPVASDFE
QTVHSIPLTINKEFALHRPVANDFE

SEQ ID NO: 45109 - protein, 25 aa, synthetic construct
  source 1..25: note = Seed: QTVHSIPLTINKEEALQRPVASDFE
QTVHSIPLTINKEFALHRPVASDFE

SEQ ID NO: 45110 - protein, 25 aa, synthetic construct
  source 1..25: note = Seed: QTVHSIPLTINKEEALQRPVASDFE
QTVHSIPLTINKEFALHRPVAVDFE

SEQ ID NO: 45111 - protein, 25 aa, synthetic construct
  source 1..25: note = Seed: QTVHSIPLTINKEEALQRPVASDFE
QTVHSIPLTINKEFALHRSVAADFE

SEQ ID NO: 45112 - protein, 25 aa, synthetic construct
  source 1..25: note = Seed: QTVHSIPLTINKEEALQRPVASDFE
QTVHSIPLTINKEFALHRSVAIDFE

SEQ ID NO: 45113 - protein, 25 aa, synthetic construct
  source 1..25: note = Seed: QTVHSIPLTINKEEALQRPVASDFE
QTVHSIPLTINKEFALHRSVALDFE

SEQ ID NO: 45114 - protein, 25 aa, synthetic construct
  source 1..25: note = Seed: QTVHSIPLTINKEEALQRPVASDFE
QTVHSIPLTINKEFALHRSVAMDFE

SEQ ID NO: 45115 - protein, 25 aa, synthetic construct
  source 1..25: note = Seed: QTVHSIPLTINKEEALQRPVASDFE
QTVHSIPLTINKEFALHRSVANDFE

SEQ ID NO: 45116 - protein, 25 aa, synthetic construct
  source 1..25: note = Seed: QTVHSIPLTINKEEALQRPVASDFE
QTVHSIPLTINKEFALHRSVASDFE

SEQ ID NO: 45117 - protein, 25 aa, synthetic construct
  source 1..25: note = Seed: QTVHSIPLTINKEEALQRPVASDFE
QTVHSIPLTINKEFALHRSVATDFE

SEQ ID NO: 45118 - protein, 25 aa, synthetic construct
  source 1..25: note = Seed: QTVHSIPLTINKEEALQRPVASDFE
QTVHSIPLTINKEFALHRSVAVDFE

SEQ ID NO: 45119 - protein, 25 aa, synthetic construct
  source 1..25: note = Seed: QTVHSIPLTINKEEALQRPVASDFE
QTVHSIPLTINKEFALHRTVAADFE

SEQ ID NO: 45120 - protein, 25 aa, synthetic construct
  source 1..25: note = Seed: QTVHSIPLTINKEEALQRPVASDFE
QTVHSIPLTINKEFALHRTVAIDFE

SEQ ID NO: 45121 - protein, 25 aa, synthetic construct
  source 1..25: note = Seed: QTVHSIPLTINKEEALQRPVASDFE
QTVHSIPLTINKEFALHRTVALDFE

SEQ ID NO: 45122 - protein, 25 aa, synthetic construct
  source 1..25: note = Seed: QTVHSIPLTINKEEALQRPVASDFE
QTVHSIPLTINKEFALHRTVAMDFE

SEQ ID NO: 45123 - protein, 25 aa, synthetic construct
  source 1..25: note = Seed: QTVHSIPLTINKEEALQRPVASDFE
QTVHSIPLTINKEFALHRTVANDFE

SEQ ID NO: 45124 - protein, 25 aa, synthetic construct
  source 1..25: note = Seed: QTVHSIPLTINKEEALQRPVASDFE
QTVHSIPLTINKEFALHRTVASDFE

SEQ ID NO: 45125 - protein, 25 aa, synthetic construct
  source 1..25: note = Seed: QTVHSIPLTINKEEALQRPVASDFE
QTVHSIPLTINKEFALHRTVATDFE

SEQ ID NO: 45126 - protein, 25 aa, synthetic construct
  source 1..25: note = Seed: QTVHSIPLTINKEEALQRPVASDFE
QTVHSIPLTINKEFALHRTVAVDFE

SEQ ID NO: 45127 - protein, 25 aa, synthetic construct
  source 1..25: note = Seed: QTVHSIPLTINKEEALQRPVASDFE
QTVHSIPLTINKEFALHRVVAADFE

SEQ ID NO: 45128 - protein, 25 aa, synthetic construct
  source 1..25: note = Seed: QTVHSIPLTINKEEALQRPVASDFE
QTVHSIPLTINKEFALHRVVAGDFE

SEQ ID NO: 45129 - protein, 25 aa, synthetic construct
  source 1..25: note = Seed: QTVHSIPLTINKEEALQRPVASDFE
QTVHSIPLTINKEFALHRVVAHDFE

SEQ ID NO: 45130 - protein, 25 aa, synthetic construct
  source 1..25: note = Seed: QTVHSIPLTINKEEALQRPVASDFE
QTVHSIPLTINKEFALHRVVANDFE

SEQ ID NO: 45131 - protein, 25 aa, synthetic construct
  source 1..25: note = Seed: QTVHSIPLTINKEEALQRPVASDFE
QTVHSIPLTINKEFALHRVVASDFE

SEQ ID NO: 45132 - protein, 25 aa, synthetic construct
  source 1..25: note = Seed: QTVHSIPLTINKEEALQRPVASDFE
QTVHSIPLTINKEFALHRVVATDFE

SEQ ID NO: 45133 - protein, 25 aa, synthetic construct
  source 1..25: note = Seed: QTVHSIPLTINKEEALQRPVASDFE
QTVHSIPLTINKEFALHRVVAVDFE

SEQ ID NO: 45134 - protein, 25 aa, synthetic construct
  source 1..25: note = Seed: QTVHSIPLTINKEEALQRPVASDFE
QTVHSIPLTINKEFALIRAVAADFE

SEQ ID NO: 45135 - protein, 25 aa, synthetic construct
  source 1..25: note = Seed: QTVHSIPLTINKEEALQRPVASDFE
QTVHSIPLTINKEFALIRAVACDFE

SEQ ID NO: 45136 - protein, 25 aa, synthetic construct
  source 1..25: note = Seed: QTVHSIPLTINKEEALQRPVASDFE
QTVHSIPLTINKEFALIRAVADDFE

SEQ ID NO: 45137 - protein, 25 aa, synthetic construct
  source 1..25: note = Seed: QTVHSIPLTINKEEALQRPVASDFE
QTVHSIPLTINKEFALIRAVAEDFE

SEQ ID NO: 45138 - protein, 25 aa, synthetic construct
  source 1..25: note = Seed: QTVHSIPLTINKEEALQRPVASDFE
QTVHSIPLTINKEFALIRAVAFDFE

SEQ ID NO: 45139 - protein, 25 aa, synthetic construct
  source 1..25: note = Seed: QTVHSIPLTINKEEALQRPVASDFE
QTVHSIPLTINKEFALIRAVAGDFE

SEQ ID NO: 45140 - protein, 25 aa, synthetic construct
  source 1..25: note = Seed: QTVHSIPLTINKEEALQRPVASDFE
QTVHSIPLTINKEFALIRAVAHDFE

SEQ ID NO: 45141 - protein, 25 aa, synthetic construct
  source 1..25: note = Seed: QTVHSIPLTINKEEALQRPVASDFE
QTVHSIPLTINKEFALIRAVAIDFE

SEQ ID NO: 45142 - protein, 25 aa, synthetic construct
  source 1..25: note = Seed: QTVHSIPLTINKEEALQRPVASDFE
QTVHSIPLTINKEFALIRAVAKDFE

SEQ ID NO: 45143 - protein, 25 aa, synthetic construct
  source 1..25: note = Seed: QTVHSIPLTINKEEALQRPVASDFE
QTVHSIPLTINKEFALIRAVALDFE

SEQ ID NO: 45144 - protein, 25 aa, synthetic construct
  source 1..25: note = Seed: QTVHSIPLTINKEEALQRPVASDFE
QTVHSIPLTINKEFALIRAVAMDFE

SEQ ID NO: 45145 - protein, 25 aa, synthetic construct
  source 1..25: note = Seed: QTVHSIPLTINKEEALQRPVASDFE
QTVHSIPLTINKEFALIRAVANDFE

SEQ ID NO: 45146 - protein, 25 aa, synthetic construct
  source 1..25: note = Seed: QTVHSIPLTINKEEALQRPVASDFE
QTVHSIPLTINKEFALIRAVAPDFE

SEQ ID NO: 45147 - protein, 25 aa, synthetic construct
  source 1..25: note = Seed: QTVHSIPLTINKEEALQRPVASDFE
QTVHSIPLTINKEFALIRAVAQDFE

SEQ ID NO: 45148 - protein, 25 aa, synthetic construct
  source 1..25: note = Seed: QTVHSIPLTINKEEALQRPVASDFE
QTVHSIPLTINKEFALIRAVARDFE

SEQ ID NO: 45149 - protein, 25 aa, synthetic construct
  source 1..25: note = Seed: QTVHSIPLTINKEEALQRPVASDFE
QTVHSIPLTINKEFALIRAVASDFE

SEQ ID NO: 45150 - protein, 25 aa, synthetic construct
  source 1..25: note = Seed: QTVHSIPLTINKEEALQRPVASDFE
QTVHSIPLTINKEFALIRAVATDFE

SEQ ID NO: 45151 - protein, 25 aa, synthetic construct
  source 1..25: note = Seed: QTVHSIPLTINKEEALQRPVASDFE
QTVHSIPLTINKEFALIRAVAVDFE

SEQ ID NO: 45152 - protein, 25 aa, synthetic construct
  source 1..25: note = Seed: QTVHSIPLTINKEEALQRPVASDFE
QTVHSIPLTINKEFALIRAVAYDFE

SEQ ID NO: 45153 - protein, 25 aa, synthetic construct
  source 1..25: note = Seed: QTVHSIPLTINKEEALQRPVASDFE
QTVHSIPLTINKEFALIRCVANDFE

SEQ ID NO: 45154 - protein, 25 aa, synthetic construct
  source 1..25: note = Seed: QTVHSIPLTINKEEALQRPVASDFE
QTVHSIPLTINKEFALIRDVAADFE

SEQ ID NO: 45155 - protein, 25 aa, synthetic construct
  source 1..25: note = Seed: QTVHSIPLTINKEEALQRPVASDFE
QTVHSIPLTINKEFALIRDVAIDFE

SEQ ID NO: 45156 - protein, 25 aa, synthetic construct
  source 1..25: note = Seed: QTVHSIPLTINKEEALQRPVASDFE
QTVHSIPLTINKEFALIRDVANDFE

SEQ ID NO: 45157 - protein, 25 aa, synthetic construct
  source 1..25: note = Seed: QTVHSIPLTINKEEALQRPVASDFE
QTVHSIPLTINKEFALIRDVASDFE

SEQ ID NO: 45158 - protein, 25 aa, synthetic construct
  source 1..25: note = Seed: QTVHSIPLTINKEEALQRPVASDFE
QTVHSIPLTINKEFALIRDVATDFE

SEQ ID NO: 45159 - protein, 25 aa, synthetic construct
  source 1..25: note = Seed: QTVHSIPLTINKEEALQRPVASDFE
QTVHSIPLTINKEFALIRDVAVDFE

SEQ ID NO: 45160 - protein, 25 aa, synthetic construct
  source 1..25: note = Seed: QTVHSIPLTINKEEALQRPVASDFE
QTVHSIPLTINKEFALIREVAADFE

SEQ ID NO: 45161 - protein, 25 aa, synthetic construct
  source 1..25: note = Seed: QTVHSIPLTINKEEALQRPVASDFE
QTVHSIPLTINKEFALIREVANDFE

SEQ ID NO: 45162 - protein, 25 aa, synthetic construct
  source 1..25: note = Seed: QTVHSIPLTINKEEALQRPVASDFE
QTVHSIPLTINKEFALIREVASDFE

SEQ ID NO: 45163 - protein, 25 aa, synthetic construct
  source 1..25: note = Seed: QTVHSIPLTINKEEALQRPVASDFE
QTVHSIPLTINKEFALIREVATDFE

SEQ ID NO: 45164 - protein, 25 aa, synthetic construct
  source 1..25: note = Seed: QTVHSIPLTINKEEALQRPVASDFE
QTVHSIPLTINKEFALIRGVAADFE

SEQ ID NO: 45165 - protein, 25 aa, synthetic construct
  source 1..25: note = Seed: QTVHSIPLTINKEEALQRPVASDFE
QTVHSIPLTINKEFALIRGVACDFE

SEQ ID NO: 45166 - protein, 25 aa, synthetic construct
  source 1..25: note = Seed: QTVHSIPLTINKEEALQRPVASDFE
QTVHSIPLTINKEFALIRGVADDFE

SEQ ID NO: 45167 - protein, 25 aa, synthetic construct
  source 1..25: note = Seed: QTVHSIPLTINKEEALQRPVASDFE
QTVHSIPLTINKEFALIRGVAEDFE

SEQ ID NO: 45168 - protein, 25 aa, synthetic construct
  source 1..25: note = Seed: QTVHSIPLTINKEEALQRPVASDFE
QTVHSIPLTINKEFALIRGVAGDFE

SEQ ID NO: 45169 - protein, 25 aa, synthetic construct
  source 1..25: note = Seed: QTVHSIPLTINKEEALQRPVASDFE
QTVHSIPLTINKEFALIRGVAHDFE

SEQ ID NO: 45170 - protein, 25 aa, synthetic construct
  source 1..25: note = Seed: QTVHSIPLTINKEEALQRPVASDFE
QTVHSIPLTINKEFALIRGVAIDFE

SEQ ID NO: 45171 - protein, 25 aa, synthetic construct
  source 1..25: note = Seed: QTVHSIPLTINKEEALQRPVASDFE
QTVHSIPLTINKEFALIRGVALDFE

SEQ ID NO: 45172 - protein, 25 aa, synthetic construct
  source 1..25: note = Seed: QTVHSIPLTINKEEALQRPVASDFE
QTVHSIPLTINKEFALIRGVAMDFE

SEQ ID NO: 45173 - protein, 25 aa, synthetic construct
  source 1..25: note = Seed: QTVHSIPLTINKEEALQRPVASDFE
QTVHSIPLTINKEFALIRGVANDFE

SEQ ID NO: 45174 - protein, 25 aa, synthetic construct
  source 1..25: note = Seed: QTVHSIPLTINKEEALQRPVASDFE
QTVHSIPLTINKEFALIRGVAPDFE

SEQ ID NO: 45175 - protein, 25 aa, synthetic construct
  source 1..25: note = Seed: QTVHSIPLTINKEEALQRPVASDFE
QTVHSIPLTINKEFALIRGVAQDFE

SEQ ID NO: 45176 - protein, 25 aa, synthetic construct
  source 1..25: note = Seed: QTVHSIPLTINKEEALQRPVASDFE
QTVHSIPLTINKEFALIRGVASDFE

SEQ ID NO: 45177 - protein, 25 aa, synthetic construct
  source 1..25: note = Seed: QTVHSIPLTINKEEALQRPVASDFE
QTVHSIPLTINKEFALIRGVATDFE

SEQ ID NO: 45178 - protein, 25 aa, synthetic construct
  source 1..25: note = Seed: QTVHSIPLTINKEEALQRPVASDFE
QTVHSIPLTINKEFALIRGVAVDFE

SEQ ID NO: 45179 - protein, 25 aa, synthetic construct
  source 1..25: note = Seed: QTVHSIPLTINKEEALQRPVASDFE
QTVHSIPLTINKEFALIRGVAYDFE

SEQ ID NO: 45180 - protein, 25 aa, synthetic construct
  source 1..25: note = Seed: QTVHSIPLTINKEEALQRPVASDFE
QTVHSIPLTINKEFALIRHVAADFE

SEQ ID NO: 45181 - protein, 25 aa, synthetic construct
  source 1..25: note = Seed: QTVHSIPLTINKEEALQRPVASDFE
QTVHSIPLTINKEFALIRHVAGDFE

SEQ ID NO: 45182 - protein, 25 aa, synthetic construct
  source 1..25: note = Seed: QTVHSIPLTINKEEALQRPVASDFE
QTVHSIPLTINKEFALIRHVAHDFE

SEQ ID NO: 45183 - protein, 25 aa, synthetic construct
  source 1..25: note = Seed: QTVHSIPLTINKEEALQRPVASDFE
QTVHSIPLTINKEFALIRHVAMDFE

SEQ ID NO: 45184 - protein, 25 aa, synthetic construct
  source 1..25: note = Seed: QTVHSIPLTINKEEALQRPVASDFE
QTVHSIPLTINKEFALIRHVANDFE

SEQ ID NO: 45185 - protein, 25 aa, synthetic construct
  source 1..25: note = Seed: QTVHSIPLTINKEEALQRPVASDFE
QTVHSIPLTINKEFALIRHVASDFE

SEQ ID NO: 45186 - protein, 25 aa, synthetic construct
  source 1..25: note = Seed: QTVHSIPLTINKEEALQRPVASDFE
QTVHSIPLTINKEFALIRHVATDFE

SEQ ID NO: 45187 - protein, 25 aa, synthetic construct
  source 1..25: note = Seed: QTVHSIPLTINKEEALQRPVASDFE
QTVHSIPLTINKEFALIRHVAVDFE

SEQ ID NO: 45188 - protein, 25 aa, synthetic construct
  source 1..25: note = Seed: QTVHSIPLTINKEEALQRPVASDFE
QTVHSIPLTINKEFALIRIVAADFE

SEQ ID NO: 45189 - protein, 25 aa, synthetic construct
  source 1..25: note = Seed: QTVHSIPLTINKEEALQRPVASDFE
QTVHSIPLTINKEFALIRIVADDFE

SEQ ID NO: 45190 - protein, 25 aa, synthetic construct
  source 1..25: note = Seed: QTVHSIPLTINKEEALQRPVASDFE
QTVHSIPLTINKEFALIRIVAEDFE

SEQ ID NO: 45191 - protein, 25 aa, synthetic construct
  source 1..25: note = Seed: QTVHSIPLTINKEEALQRPVASDFE
QTVHSIPLTINKEFALIRIVAGDFE

SEQ ID NO: 45192 - protein, 25 aa, synthetic construct
  source 1..25: note = Seed: QTVHSIPLTINKEEALQRPVASDFE
QTVHSIPLTINKEFALIRIVAHDFE

SEQ ID NO: 45193 - protein, 25 aa, synthetic construct
  source 1..25: note = Seed: QTVHSIPLTINKEEALQRPVASDFE
QTVHSIPLTINKEFALIRIVAKDFE

SEQ ID NO: 45194 - protein, 25 aa, synthetic construct
  source 1..25: note = Seed: QTVHSIPLTINKEEALQRPVASDFE
QTVHSIPLTINKEFALIRIVANDFE

SEQ ID NO: 45195 - protein, 25 aa, synthetic construct
  source 1..25: note = Seed: QTVHSIPLTINKEEALQRPVASDFE
QTVHSIPLTINKEFALIRIVAPDFE

SEQ ID NO: 45196 - protein, 25 aa, synthetic construct
  source 1..25: note = Seed: QTVHSIPLTINKEEALQRPVASDFE
QTVHSIPLTINKEFALIRIVAQDFE

SEQ ID NO: 45197 - protein, 25 aa, synthetic construct
  source 1..25: note = Seed: QTVHSIPLTINKEEALQRPVASDFE
QTVHSIPLTINKEFALIRIVASDFE

SEQ ID NO: 45198 - protein, 25 aa, synthetic construct
  source 1..25: note = Seed: QTVHSIPLTINKEEALQRPVASDFE
QTVHSIPLTINKEFALIRIVATDFE

SEQ ID NO: 45199 - protein, 25 aa, synthetic construct
  source 1..25: note = Seed: QTVHSIPLTINKEEALQRPVASDFE
QTVHSIPLTINKEFALIRKVAADFE

SEQ ID NO: 45200 - protein, 25 aa, synthetic construct
  source 1..25: note = Seed: QTVHSIPLTINKEEALQRPVASDFE
QTVHSIPLTINKEFALIRKVASDFE

SEQ ID NO: 45201 - protein, 25 aa, synthetic construct
  source 1..25: note = Seed: QTVHSIPLTINKEEALQRPVASDFE
QTVHSIPLTINKEFALIRLVAHDFE

SEQ ID NO: 45202 - protein, 25 aa, synthetic construct
  source 1..25: note = Seed: QTVHSIPLTINKEEALQRPVASDFE
QTVHSIPLTINKEFALIRLVANDFE

SEQ ID NO: 45203 - protein, 25 aa, synthetic construct
  source 1..25: note = Seed: QTVHSIPLTINKEEALQRPVASDFE
QTVHSIPLTINKEFALIRMVAADFE

SEQ ID NO: 45204 - protein, 25 aa, synthetic construct
  source 1..25: note = Seed: QTVHSIPLTINKEEALQRPVASDFE
QTVHSIPLTINKEFALIRMVAHDFE

SEQ ID NO: 45205 - protein, 25 aa, synthetic construct
  source 1..25: note = Seed: QTVHSIPLTINKEEALQRPVASDFE
QTVHSIPLTINKEFALIRMVANDFE

SEQ ID NO: 45206 - protein, 25 aa, synthetic construct
  source 1..25: note = Seed: QTVHSIPLTINKEEALQRPVASDFE
QTVHSIPLTINKEFALIRMVASDFE

SEQ ID NO: 45207 - protein, 25 aa, synthetic construct
  source 1..25: note = Seed: QTVHSIPLTINKEEALQRPVASDFE
QTVHSIPLTINKEFALIRNVAADFE

SEQ ID NO: 45208 - protein, 25 aa, synthetic construct
  source 1..25: note = Seed: QTVHSIPLTINKEEALQRPVASDFE
QTVHSIPLTINKEFALIRNVACDFE

SEQ ID NO: 45209 - protein, 25 aa, synthetic construct
  source 1..25: note = Seed: QTVHSIPLTINKEEALQRPVASDFE
QTVHSIPLTINKEFALIRNVADDFE

SEQ ID NO: 45210 - protein, 25 aa, synthetic construct
  source 1..25: note = Seed: QTVHSIPLTINKEEALQRPVASDFE
QTVHSIPLTINKEFALIRNVAEDFE

SEQ ID NO: 45211 - protein, 25 aa, synthetic construct
  source 1..25: note = Seed: QTVHSIPLTINKEEALQRPVASDFE
QTVHSIPLTINKEFALIRNVAFDFE

SEQ ID NO: 45212 - protein, 25 aa, synthetic construct
  source 1..25: note = Seed: QTVHSIPLTINKEEALQRPVASDFE
QTVHSIPLTINKEFALIRNVAGDFE

SEQ ID NO: 45213 - protein, 25 aa, synthetic construct
  source 1..25: note = Seed: QTVHSIPLTINKEEALQRPVASDFE
QTVHSIPLTINKEFALIRNVAHDFE

SEQ ID NO: 45214 - protein, 25 aa, synthetic construct
  source 1..25: note = Seed: QTVHSIPLTINKEEALQRPVASDFE
QTVHSIPLTINKEFALIRNVAIDFE

SEQ ID NO: 45215 - protein, 25 aa, synthetic construct
  source 1..25: note = Seed: QTVHSIPLTINKEEALQRPVASDFE
QTVHSIPLTINKEFALIRNVAKDFE

SEQ ID NO: 45216 - protein, 25 aa, synthetic construct
  source 1..25: note = Seed: QTVHSIPLTINKEEALQRPVASDFE
QTVHSIPLTINKEFALIRNVALDFE

SEQ ID NO: 45217 - protein, 25 aa, synthetic construct
  source 1..25: note = Seed: QTVHSIPLTINKEEALQRPVASDFE
QTVHSIPLTINKEFALIRNVAMDFE

SEQ ID NO: 45218 - protein, 25 aa, synthetic construct
  source 1..25: note = Seed: QTVHSIPLTINKEEALQRPVASDFE
QTVHSIPLTINKEFALIRNVANDFE

SEQ ID NO: 45219 - protein, 25 aa, synthetic construct
  source 1..25: note = Seed: QTVHSIPLTINKEEALQRPVASDFE
QTVHSIPLTINKEFALIRNVAPDFE

SEQ ID NO: 45220 - protein, 25 aa, synthetic construct
  source 1..25: note = Seed: QTVHSIPLTINKEEALQRPVASDFE
QTVHSIPLTINKEFALIRNVAQDFE

SEQ ID NO: 45221 - protein, 25 aa, synthetic construct
  source 1..25: note = Seed: QTVHSIPLTINKEEALQRPVASDFE
QTVHSIPLTINKEFALIRNVASDFE

SEQ ID NO: 45222 - protein, 25 aa, synthetic construct
  source 1..25: note = Seed: QTVHSIPLTINKEEALQRPVASDFE
QTVHSIPLTINKEFALIRNVATDFE

SEQ ID NO: 45223 - protein, 25 aa, synthetic construct
  source 1..25: note = Seed: QTVHSIPLTINKEEALQRPVASDFE
QTVHSIPLTINKEFALIRNVAVDFE

SEQ ID NO: 45224 - protein, 25 aa, synthetic construct
  source 1..25: note = Seed: QTVHSIPLTINKEEALQRPVASDFE
QTVHSIPLTINKEFALIRNVAYDFE

SEQ ID NO: 45225 - protein, 25 aa, synthetic construct
  source 1..25: note = Seed: QTVHSIPLTINKEEALQRPVASDFE
QTVHSIPLTINKEFALIRPVAADFE

SEQ ID NO: 45226 - protein, 25 aa, synthetic construct
  source 1..25: note = Seed: QTVHSIPLTINKEEALQRPVASDFE
QTVHSIPLTINKEFALIRPVACDFE

SEQ ID NO: 45227 - protein, 25 aa, synthetic construct
  source 1..25: note = Seed: QTVHSIPLTINKEEALQRPVASDFE
QTVHSIPLTINKEFALIRPVADDFE

SEQ ID NO: 45228 - protein, 25 aa, synthetic construct
  source 1..25: note = Seed: QTVHSIPLTINKEEALQRPVASDFE
QTVHSIPLTINKEFALIRPVAEDFE

SEQ ID NO: 45229 - protein, 25 aa, synthetic construct
  source 1..25: note = Seed: QTVHSIPLTINKEEALQRPVASDFE
QTVHSIPLTINKEFALIRPVAFDFE

SEQ ID NO: 45230 - protein, 25 aa, synthetic construct
  source 1..25: note = Seed: QTVHSIPLTINKEEALQRPVASDFE
QTVHSIPLTINKEFALIRPVAGDFE

SEQ ID NO: 45231 - protein, 25 aa, synthetic construct
  source 1..25: note = Seed: QTVHSIPLTINKEEALQRPVASDFE
QTVHSIPLTINKEFALIRPVAHDFE

SEQ ID NO: 45232 - protein, 25 aa, synthetic construct
  source 1..25: note = Seed: QTVHSIPLTINKEEALQRPVASDFE
QTVHSIPLTINKEFALIRPVAIDFE

SEQ ID NO: 45233 - protein, 25 aa, synthetic construct
  source 1..25: note = Seed: QTVHSIPLTINKEEALQRPVASDFE
QTVHSIPLTINKEFALIRPVAKDFE

SEQ ID NO: 45234 - protein, 25 aa, synthetic construct
  source 1..25: note = Seed: QTVHSIPLTINKEEALQRPVASDFE
QTVHSIPLTINKEFALIRPVALDFE

SEQ ID NO: 45235 - protein, 25 aa, synthetic construct
  source 1..25: note = Seed: QTVHSIPLTINKEEALQRPVASDFE
QTVHSIPLTINKEFALIRPVAMDFE

SEQ ID NO: 45236 - protein, 25 aa, synthetic construct
  source 1..25: note = Seed: QTVHSIPLTINKEEALQRPVASDFE
QTVHSIPLTINKEFALIRPVANDFE

SEQ ID NO: 45237 - protein, 25 aa, synthetic construct
  source 1..25: note = Seed: QTVHSIPLTINKEEALQRPVASDFE
QTVHSIPLTINKEFALIRPVAPDFE

SEQ ID NO: 45238 - protein, 25 aa, synthetic construct
  source 1..25: note = Seed: QTVHSIPLTINKEEALQRPVASDFE
QTVHSIPLTINKEFALIRPVAQDFE

SEQ ID NO: 45239 - protein, 25 aa, synthetic construct
  source 1..25: note = Seed: QTVHSIPLTINKEEALQRPVASDFE
QTVHSIPLTINKEFALIRPVARDFE

SEQ ID NO: 45240 - protein, 25 aa, synthetic construct
  source 1..25: note = Seed: QTVHSIPLTINKEEALQRPVASDFE
QTVHSIPLTINKEFALIRPVASDFE

SEQ ID NO: 45241 - protein, 25 aa, synthetic construct
  source 1..25: note = Seed: QTVHSIPLTINKEEALQRPVASDFE
QTVHSIPLTINKEFALIRPVATDFE

SEQ ID NO: 45242 - protein, 25 aa, synthetic construct
  source 1..25: note = Seed: QTVHSIPLTINKEEALQRPVASDFE
QTVHSIPLTINKEFALIRPVAVDFE

SEQ ID NO: 45243 - protein, 25 aa, synthetic construct
  source 1..25: note = Seed: QTVHSIPLTINKEEALQRPVASDFE
QTVHSIPLTINKEFALIRPVAWDFE

SEQ ID NO: 45244 - protein, 25 aa, synthetic construct
  source 1..25: note = Seed: QTVHSIPLTINKEEALQRPVASDFE
QTVHSIPLTINKEFALIRPVAYDFE

SEQ ID NO: 45245 - protein, 25 aa, synthetic construct
  source 1..25: note = Seed: QTVHSIPLTINKEEALQRPVASDFE
QTVHSIPLTINKEFALIRQVAADFE

SEQ ID NO: 45246 - protein, 25 aa, synthetic construct
  source 1..25: note = Seed: QTVHSIPLTINKEEALQRPVASDFE
QTVHSIPLTINKEFALIRQVANDFE

SEQ ID NO: 45247 - protein, 25 aa, synthetic construct
  source 1..25: note = Seed: QTVHSIPLTINKEEALQRPVASDFE
QTVHSIPLTINKEFALIRQVASDFE

SEQ ID NO: 45248 - protein, 25 aa, synthetic construct
  source 1..25: note = Seed: QTVHSIPLTINKEEALQRPVASDFE
QTVHSIPLTINKEFALIRQVATDFE

SEQ ID NO: 45249 - protein, 25 aa, synthetic construct
  source 1..25: note = Seed: QTVHSIPLTINKEEALQRPVASDFE
QTVHSIPLTINKEFALIRSVAADFE

SEQ ID NO: 45250 - protein, 25 aa, synthetic construct
  source 1..25: note = Seed: QTVHSIPLTINKEEALQRPVASDFE
QTVHSIPLTINKEFALIRSVACDFE

SEQ ID NO: 45251 - protein, 25 aa, synthetic construct
  source 1..25: note = Seed: QTVHSIPLTINKEEALQRPVASDFE
QTVHSIPLTINKEFALIRSVADDFE

SEQ ID NO: 45252 - protein, 25 aa, synthetic construct
  source 1..25: note = Seed: QTVHSIPLTINKEEALQRPVASDFE
QTVHSIPLTINKEFALIRSVAEDFE

SEQ ID NO: 45253 - protein, 25 aa, synthetic construct
  source 1..25: note = Seed: QTVHSIPLTINKEEALQRPVASDFE
QTVHSIPLTINKEFALIRSVAFDFE

SEQ ID NO: 45254 - protein, 25 aa, synthetic construct
  source 1..25: note = Seed: QTVHSIPLTINKEEALQRPVASDFE
QTVHSIPLTINKEFALIRSVAGDFE

SEQ ID NO: 45255 - protein, 25 aa, synthetic construct
  source 1..25: note = Seed: QTVHSIPLTINKEEALQRPVASDFE
QTVHSIPLTINKEFALIRSVAHDFE

SEQ ID NO: 45256 - protein, 25 aa, synthetic construct
  source 1..25: note = Seed: QTVHSIPLTINKEEALQRPVASDFE
QTVHSIPLTINKEFALIRSVAIDFE

SEQ ID NO: 45257 - protein, 25 aa, synthetic construct
  source 1..25: note = Seed: QTVHSIPLTINKEEALQRPVASDFE
QTVHSIPLTINKEFALIRSVAKDFE

SEQ ID NO: 45258 - protein, 25 aa, synthetic construct
  source 1..25: note = Seed: QTVHSIPLTINKEEALQRPVASDFE
QTVHSIPLTINKEFALIRSVALDFE

SEQ ID NO: 45259 - protein, 25 aa, synthetic construct
  source 1..25: note = Seed: QTVHSIPLTINKEEALQRPVASDFE
QTVHSIPLTINKEFALIRSVAMDFE

SEQ ID NO: 45260 - protein, 25 aa, synthetic construct
  source 1..25: note = Seed: QTVHSIPLTINKEEALQRPVASDFE
QTVHSIPLTINKEFALIRSVANDFE

SEQ ID NO: 45261 - protein, 25 aa, synthetic construct
  source 1..25: note = Seed: QTVHSIPLTINKEEALQRPVASDFE
QTVHSIPLTINKEFALIRSVAPDFE

SEQ ID NO: 45262 - protein, 25 aa, synthetic construct
  source 1..25: note = Seed: QTVHSIPLTINKEEALQRPVASDFE
QTVHSIPLTINKEFALIRSVAQDFE

SEQ ID NO: 45263 - protein, 25 aa, synthetic construct
  source 1..25: note = Seed: QTVHSIPLTINKEEALQRPVASDFE
QTVHSIPLTINKEFALIRSVARDFE

SEQ ID NO: 45264 - protein, 25 aa, synthetic construct
  source 1..25: note = Seed: QTVHSIPLTINKEEALQRPVASDFE
QTVHSIPLTINKEFALIRSVASDFE

SEQ ID NO: 45265 - protein, 25 aa, synthetic construct
  source 1..25: note = Seed: QTVHSIPLTINKEEALQRPVASDFE
QTVHSIPLTINKEFALIRSVATDFE

SEQ ID NO: 45266 - protein, 25 aa, synthetic construct
  source 1..25: note = Seed: QTVHSIPLTINKEEALQRPVASDFE
QTVHSIPLTINKEFALIRSVAVDFE

SEQ ID NO: 45267 - protein, 25 aa, synthetic construct
  source 1..25: note = Seed: QTVHSIPLTINKEEALQRPVASDFE
QTVHSIPLTINKEFALIRSVAYDFE

SEQ ID NO: 45268 - protein, 25 aa, synthetic construct
  source 1..25: note = Seed: QTVHSIPLTINKEEALQRPVASDFE
QTVHSIPLTINKEFALIRTVAADFE

SEQ ID NO: 45269 - protein, 25 aa, synthetic construct
  source 1..25: note = Seed: QTVHSIPLTINKEEALQRPVASDFE
QTVHSIPLTINKEFALIRTVACDFE

SEQ ID NO: 45270 - protein, 25 aa, synthetic construct
  source 1..25: note = Seed: QTVHSIPLTINKEEALQRPVASDFE
QTVHSIPLTINKEFALIRTVADDFE

SEQ ID NO: 45271 - protein, 25 aa, synthetic construct
  source 1..25: note = Seed: QTVHSIPLTINKEEALQRPVASDFE
QTVHSIPLTINKEFALIRTVAEDFE

SEQ ID NO: 45272 - protein, 25 aa, synthetic construct
  source 1..25: note = Seed: QTVHSIPLTINKEEALQRPVASDFE
QTVHSIPLTINKEFALIRTVAFDFE

SEQ ID NO: 45273 - protein, 25 aa, synthetic construct
  source 1..25: note = Seed: QTVHSIPLTINKEEALQRPVASDFE
QTVHSIPLTINKEFALIRTVAGDFE

SEQ ID NO: 45274 - protein, 25 aa, synthetic construct
  source 1..25: note = Seed: QTVHSIPLTINKEEALQRPVASDFE
QTVHSIPLTINKEFALIRTVAHDFE

SEQ ID NO: 45275 - protein, 25 aa, synthetic construct
  source 1..25: note = Seed: QTVHSIPLTINKEEALQRPVASDFE
QTVHSIPLTINKEFALIRTVAIDFE

SEQ ID NO: 45276 - protein, 25 aa, synthetic construct
  source 1..25: note = Seed: QTVHSIPLTINKEEALQRPVASDFE
QTVHSIPLTINKEFALIRTVAKDFE

SEQ ID NO: 45277 - protein, 25 aa, synthetic construct
  source 1..25: note = Seed: QTVHSIPLTINKEEALQRPVASDFE
QTVHSIPLTINKEFALIRTVALDFE

SEQ ID NO: 45278 - protein, 25 aa, synthetic construct
  source 1..25: note = Seed: QTVHSIPLTINKEEALQRPVASDFE
QTVHSIPLTINKEFALIRTVAMDFE

SEQ ID NO: 45279 - protein, 25 aa, synthetic construct
  source 1..25: note = Seed: QTVHSIPLTINKEEALQRPVASDFE
QTVHSIPLTINKEFALIRTVANDFE

SEQ ID NO: 45280 - protein, 25 aa, synthetic construct
  source 1..25: note = Seed: QTVHSIPLTINKEEALQRPVASDFE
QTVHSIPLTINKEFALIRTVAPDFE

SEQ ID NO: 45281 - protein, 25 aa, synthetic construct
  source 1..25: note = Seed: QTVHSIPLTINKEEALQRPVASDFE
QTVHSIPLTINKEFALIRTVAQDFE

SEQ ID NO: 45282 - protein, 25 aa, synthetic construct
  source 1..25: note = Seed: QTVHSIPLTINKEEALQRPVASDFE
QTVHSIPLTINKEFALIRTVARDFE

SEQ ID NO: 45283 - protein, 25 aa, synthetic construct
  source 1..25: note = Seed: QTVHSIPLTINKEEALQRPVASDFE
QTVHSIPLTINKEFALIRTVASDFE

SEQ ID NO: 45284 - protein, 25 aa, synthetic construct
  source 1..25: note = Seed: QTVHSIPLTINKEEALQRPVASDFE
QTVHSIPLTINKEFALIRTVATDFE

SEQ ID NO: 45285 - protein, 25 aa, synthetic construct
  source 1..25: note = Seed: QTVHSIPLTINKEEALQRPVASDFE
QTVHSIPLTINKEFALIRTVAVDFE

SEQ ID NO: 45286 - protein, 25 aa, synthetic construct
  source 1..25: note = Seed: QTVHSIPLTINKEEALQRPVASDFE
QTVHSIPLTINKEFALIRTVAYDFE

SEQ ID NO: 45287 - protein, 25 aa, synthetic construct
  source 1..25: note = Seed: QTVHSIPLTINKEEALQRPVASDFE
QTVHSIPLTINKEFALIRVVAADFE

SEQ ID NO: 45288 - protein, 25 aa, synthetic construct
  source 1..25: note = Seed: QTVHSIPLTINKEEALQRPVASDFE
QTVHSIPLTINKEFALIRVVADDFE

SEQ ID NO: 45289 - protein, 25 aa, synthetic construct
  source 1..25: note = Seed: QTVHSIPLTINKEEALQRPVASDFE
QTVHSIPLTINKEFALIRVVAEDFE

SEQ ID NO: 45290 - protein, 25 aa, synthetic construct
  source 1..25: note = Seed: QTVHSIPLTINKEEALQRPVASDFE
QTVHSIPLTINKEFALIRVVAGDFE

SEQ ID NO: 45291 - protein, 25 aa, synthetic construct
  source 1..25: note = Seed: QTVHSIPLTINKEEALQRPVASDFE
QTVHSIPLTINKEFALIRVVAHDFE

SEQ ID NO: 45292 - protein, 25 aa, synthetic construct
  source 1..25: note = Seed: QTVHSIPLTINKEEALQRPVASDFE
QTVHSIPLTINKEFALIRVVAKDFE

SEQ ID NO: 45293 - protein, 25 aa, synthetic construct
  source 1..25: note = Seed: QTVHSIPLTINKEEALQRPVASDFE
QTVHSIPLTINKEFALIRVVAMDFE

SEQ ID NO: 45294 - protein, 25 aa, synthetic construct
  source 1..25: note = Seed: QTVHSIPLTINKEEALQRPVASDFE
QTVHSIPLTINKEFALIRVVANDFE

SEQ ID NO: 45295 - protein, 25 aa, synthetic construct
  source 1..25: note = Seed: QTVHSIPLTINKEEALQRPVASDFE
QTVHSIPLTINKEFALIRVVAPDFE

SEQ ID NO: 45296 - protein, 25 aa, synthetic construct
  source 1..25: note = Seed: QTVHSIPLTINKEEALQRPVASDFE
QTVHSIPLTINKEFALIRVVAQDFE

SEQ ID NO: 45297 - protein, 25 aa, synthetic construct
  source 1..25: note = Seed: QTVHSIPLTINKEEALQRPVASDFE
QTVHSIPLTINKEFALIRVVARDFE

SEQ ID NO: 45298 - protein, 25 aa, synthetic construct
  source 1..25: note = Seed: QTVHSIPLTINKEEALQRPVASDFE
QTVHSIPLTINKEFALIRVVASDFE

SEQ ID NO: 45299 - protein, 25 aa, synthetic construct
  source 1..25: note = Seed: QTVHSIPLTINKEEALQRPVASDFE
QTVHSIPLTINKEFALIRVVATDFE

SEQ ID NO: 45300 - protein, 25 aa, synthetic construct
  source 1..25: note = Seed: QTVHSIPLTINKEEALQRPVASDFE
QTVHSIPLTINKEFALIRVVAVDFE

SEQ ID NO: 45301 - protein, 25 aa, synthetic construct
  source 1..25: note = Seed: QTVHSIPLTINKEEALQRPVASDFE
QTVHSIPLTINKEFALIRYVANDFE

SEQ ID NO: 45302 - protein, 25 aa, synthetic construct
  source 1..25: note = Seed: QTVHSIPLTINKEEALQRPVASDFE
QTVHSIPLTINKEFALKRAVAADFE

SEQ ID NO: 45303 - protein, 25 aa, synthetic construct
  source 1..25: note = Seed: QTVHSIPLTINKEEALQRPVASDFE
QTVHSIPLTINKEFALKRAVANDFE

SEQ ID NO: 45304 - protein, 25 aa, synthetic construct
  source 1..25: note = Seed: QTVHSIPLTINKEEALQRPVASDFE
QTVHSIPLTINKEFALKRAVASDFE

SEQ ID NO: 45305 - protein, 25 aa, synthetic construct
  source 1..25: note = Seed: QTVHSIPLTINKEEALQRPVASDFE
QTVHSIPLTINKEFALKRPVAADFE

SEQ ID NO: 45306 - protein, 25 aa, synthetic construct
  source 1..25: note = Seed: QTVHSIPLTINKEEALQRPVASDFE
QTVHSIPLTINKEFALKRSVAADFE

SEQ ID NO: 45307 - protein, 25 aa, synthetic construct
  source 1..25: note = Seed: QTVHSIPLTINKEEALQRPVASDFE
QTVHSIPLTINKEFALKRSVANDFE

SEQ ID NO: 45308 - protein, 25 aa, synthetic construct
  source 1..25: note = Seed: QTVHSIPLTINKEEALQRPVASDFE
QTVHSIPLTINKEFALKRSVASDFE

SEQ ID NO: 45309 - protein, 25 aa, synthetic construct
  source 1..25: note = Seed: QTVHSIPLTINKEEALQRPVASDFE
QTVHSIPLTINKEFALKRTVAADFE

SEQ ID NO: 45310 - protein, 25 aa, synthetic construct
  source 1..25: note = Seed: QTVHSIPLTINKEEALQRPVASDFE
QTVHSIPLTINKEFALKRTVANDFE

SEQ ID NO: 45311 - protein, 25 aa, synthetic construct
  source 1..25: note = Seed: QTVHSIPLTINKEEALQRPVASDFE
QTVHSIPLTINKEFALKRTVASDFE

SEQ ID NO: 45312 - protein, 25 aa, synthetic construct
  source 1..25: note = Seed: QTVHSIPLTINKEEALQRPVASDFE
QTVHSIPLTINKEFALKRVVAADFE

SEQ ID NO: 45313 - protein, 25 aa, synthetic construct
  source 1..25: note = Seed: QTVHSIPLTINKEEALQRPVASDFE
QTVHSIPLTINKEFALKRVVANDFE

SEQ ID NO: 45314 - protein, 25 aa, synthetic construct
  source 1..25: note = Seed: QTVHSIPLTINKEEALQRPVASDFE
QTVHSIPLTINKEFALLRAVAADFE

SEQ ID NO: 45315 - protein, 25 aa, synthetic construct
  source 1..25: note = Seed: QTVHSIPLTINKEEALQRPVASDFE
QTVHSIPLTINKEFALLRAVACDFE

SEQ ID NO: 45316 - protein, 25 aa, synthetic construct
  source 1..25: note = Seed: QTVHSIPLTINKEEALQRPVASDFE
QTVHSIPLTINKEFALLRAVADDFE

SEQ ID NO: 45317 - protein, 25 aa, synthetic construct
  source 1..25: note = Seed: QTVHSIPLTINKEEALQRPVASDFE
QTVHSIPLTINKEFALLRAVAEDFE

SEQ ID NO: 45318 - protein, 25 aa, synthetic construct
  source 1..25: note = Seed: QTVHSIPLTINKEEALQRPVASDFE
QTVHSIPLTINKEFALLRAVAFDFE

SEQ ID NO: 45319 - protein, 25 aa, synthetic construct
  source 1..25: note = Seed: QTVHSIPLTINKEEALQRPVASDFE
QTVHSIPLTINKEFALLRAVAGDFE

SEQ ID NO: 45320 - protein, 25 aa, synthetic construct
  source 1..25: note = Seed: QTVHSIPLTINKEEALQRPVASDFE
QTVHSIPLTINKEFALLRAVAHDFE

SEQ ID NO: 45321 - protein, 25 aa, synthetic construct
  source 1..25: note = Seed: QTVHSIPLTINKEEALQRPVASDFE
QTVHSIPLTINKEFALLRAVAIDFE

SEQ ID NO: 45322 - protein, 25 aa, synthetic construct
  source 1..25: note = Seed: QTVHSIPLTINKEEALQRPVASDFE
QTVHSIPLTINKEFALLRAVAKDFE

SEQ ID NO: 45323 - protein, 25 aa, synthetic construct
  source 1..25: note = Seed: QTVHSIPLTINKEEALQRPVASDFE
QTVHSIPLTINKEFALLRAVALDFE

SEQ ID NO: 45324 - protein, 25 aa, synthetic construct
  source 1..25: note = Seed: QTVHSIPLTINKEEALQRPVASDFE
QTVHSIPLTINKEFALLRAVAMDFE

SEQ ID NO: 45325 - protein, 25 aa, synthetic construct
  source 1..25: note = Seed: QTVHSIPLTINKEEALQRPVASDFE
QTVHSIPLTINKEFALLRAVANDFE

SEQ ID NO: 45326 - protein, 25 aa, synthetic construct
  source 1..25: note = Seed: QTVHSIPLTINKEEALQRPVASDFE
QTVHSIPLTINKEFALLRAVAPDFE

SEQ ID NO: 45327 - protein, 25 aa, synthetic construct
  source 1..25: note = Seed: QTVHSIPLTINKEEALQRPVASDFE
QTVHSIPLTINKEFALLRAVAQDFE

SEQ ID NO: 45328 - protein, 25 aa, synthetic construct
  source 1..25: note = Seed: QTVHSIPLTINKEEALQRPVASDFE
QTVHSIPLTINKEFALLRAVARDFE

SEQ ID NO: 45329 - protein, 25 aa, synthetic construct
  source 1..25: note = Seed: QTVHSIPLTINKEEALQRPVASDFE
QTVHSIPLTINKEFALLRAVASDFE

SEQ ID NO: 45330 - protein, 25 aa, synthetic construct
  source 1..25: note = Seed: QTVHSIPLTINKEEALQRPVASDFE
QTVHSIPLTINKEFALLRAVATDFE

SEQ ID NO: 45331 - protein, 25 aa, synthetic construct
  source 1..25: note = Seed: QTVHSIPLTINKEEALQRPVASDFE
QTVHSIPLTINKEFALLRAVAVDFE

SEQ ID NO: 45332 - protein, 25 aa, synthetic construct
  source 1..25: note = Seed: QTVHSIPLTINKEEALQRPVASDFE
QTVHSIPLTINKEFALLRAVAYDFE

SEQ ID NO: 45333 - protein, 25 aa, synthetic construct
  source 1..25: note = Seed: QTVHSIPLTINKEEALQRPVASDFE
QTVHSIPLTINKEFALLRCVANDFE

SEQ ID NO: 45334 - protein, 25 aa, synthetic construct
  source 1..25: note = Seed: QTVHSIPLTINKEEALQRPVASDFE
QTVHSIPLTINKEFALLRDVAADFE

SEQ ID NO: 45335 - protein, 25 aa, synthetic construct
  source 1..25: note = Seed: QTVHSIPLTINKEEALQRPVASDFE
QTVHSIPLTINKEFALLRDVAIDFE

SEQ ID NO: 45336 - protein, 25 aa, synthetic construct
  source 1..25: note = Seed: QTVHSIPLTINKEEALQRPVASDFE
QTVHSIPLTINKEFALLRDVALDFE

SEQ ID NO: 45337 - protein, 25 aa, synthetic construct
  source 1..25: note = Seed: QTVHSIPLTINKEEALQRPVASDFE
QTVHSIPLTINKEFALLRDVAMDFE

SEQ ID NO: 45338 - protein, 25 aa, synthetic construct
  source 1..25: note = Seed: QTVHSIPLTINKEEALQRPVASDFE
QTVHSIPLTINKEFALLRDVANDFE

SEQ ID NO: 45339 - protein, 25 aa, synthetic construct
  source 1..25: note = Seed: QTVHSIPLTINKEEALQRPVASDFE
QTVHSIPLTINKEFALLRDVASDFE

SEQ ID NO: 45340 - protein, 25 aa, synthetic construct
  source 1..25: note = Seed: QTVHSIPLTINKEEALQRPVASDFE
QTVHSIPLTINKEFALLRDVATDFE

SEQ ID NO: 45341 - protein, 25 aa, synthetic construct
  source 1..25: note = Seed: QTVHSIPLTINKEEALQRPVASDFE
QTVHSIPLTINKEFALLRDVAVDFE

SEQ ID NO: 45342 - protein, 25 aa, synthetic construct
  source 1..25: note = Seed: QTVHSIPLTINKEEALQRPVASDFE
QTVHSIPLTINKEFALLREVAADFE

SEQ ID NO: 45343 - protein, 25 aa, synthetic construct
  source 1..25: note = Seed: QTVHSIPLTINKEEALQRPVASDFE
QTVHSIPLTINKEFALLREVAGDFE

SEQ ID NO: 45344 - protein, 25 aa, synthetic construct
  source 1..25: note = Seed: QTVHSIPLTINKEEALQRPVASDFE
QTVHSIPLTINKEFALLREVANDFE

SEQ ID NO: 45345 - protein, 25 aa, synthetic construct
  source 1..25: note = Seed: QTVHSIPLTINKEEALQRPVASDFE
QTVHSIPLTINKEFALLREVASDFE

SEQ ID NO: 45346 - protein, 25 aa, synthetic construct
  source 1..25: note = Seed: QTVHSIPLTINKEEALQRPVASDFE
QTVHSIPLTINKEFALLREVATDFE

SEQ ID NO: 45347 - protein, 25 aa, synthetic construct
  source 1..25: note = Seed: QTVHSIPLTINKEEALQRPVASDFE
QTVHSIPLTINKEFALLREVAVDFE

SEQ ID NO: 45348 - protein, 25 aa, synthetic construct
  source 1..25: note = Seed: QTVHSIPLTINKEEALQRPVASDFE
QTVHSIPLTINKEFALLRGVAADFE

SEQ ID NO: 45349 - protein, 25 aa, synthetic construct
  source 1..25: note = Seed: QTVHSIPLTINKEEALQRPVASDFE
QTVHSIPLTINKEFALLRGVACDFE

SEQ ID NO: 45350 - protein, 25 aa, synthetic construct
  source 1..25: note = Seed: QTVHSIPLTINKEEALQRPVASDFE
QTVHSIPLTINKEFALLRGVADDFE

SEQ ID NO: 45351 - protein, 25 aa, synthetic construct
  source 1..25: note = Seed: QTVHSIPLTINKEEALQRPVASDFE
QTVHSIPLTINKEFALLRGVAEDFE

SEQ ID NO: 45352 - protein, 25 aa, synthetic construct
  source 1..25: note = Seed: QTVHSIPLTINKEEALQRPVASDFE
QTVHSIPLTINKEFALLRGVAGDFE

SEQ ID NO: 45353 - protein, 25 aa, synthetic construct
  source 1..25: note = Seed: QTVHSIPLTINKEEALQRPVASDFE
QTVHSIPLTINKEFALLRGVAHDFE

SEQ ID NO: 45354 - protein, 25 aa, synthetic construct
  source 1..25: note = Seed: QTVHSIPLTINKEEALQRPVASDFE
QTVHSIPLTINKEFALLRGVAIDFE

SEQ ID NO: 45355 - protein, 25 aa, synthetic construct
  source 1..25: note = Seed: QTVHSIPLTINKEEALQRPVASDFE
QTVHSIPLTINKEFALLRGVAKDFE

SEQ ID NO: 45356 - protein, 25 aa, synthetic construct
  source 1..25: note = Seed: QTVHSIPLTINKEEALQRPVASDFE
QTVHSIPLTINKEFALLRGVALDFE

SEQ ID NO: 45357 - protein, 25 aa, synthetic construct
  source 1..25: note = Seed: QTVHSIPLTINKEEALQRPVASDFE
QTVHSIPLTINKEFALLRGVAMDFE

SEQ ID NO: 45358 - protein, 25 aa, synthetic construct
  source 1..25: note = Seed: QTVHSIPLTINKEEALQRPVASDFE
QTVHSIPLTINKEFALLRGVANDFE

SEQ ID NO: 45359 - protein, 25 aa, synthetic construct
  source 1..25: note = Seed: QTVHSIPLTINKEEALQRPVASDFE
QTVHSIPLTINKEFALLRGVAPDFE

SEQ ID NO: 45360 - protein, 25 aa, synthetic construct
  source 1..25: note = Seed: QTVHSIPLTINKEEALQRPVASDFE
QTVHSIPLTINKEFALLRGVAQDFE

SEQ ID NO: 45361 - protein, 25 aa, synthetic construct
  source 1..25: note = Seed: QTVHSIPLTINKEEALQRPVASDFE
QTVHSIPLTINKEFALLRGVASDFE

SEQ ID NO: 45362 - protein, 25 aa, synthetic construct
  source 1..25: note = Seed: QTVHSIPLTINKEEALQRPVASDFE
QTVHSIPLTINKEFALLRGVATDFE

SEQ ID NO: 45363 - protein, 25 aa, synthetic construct
  source 1..25: note = Seed: QTVHSIPLTINKEEALQRPVASDFE
QTVHSIPLTINKEFALLRGVAVDFE

SEQ ID NO: 45364 - protein, 25 aa, synthetic construct
  source 1..25: note = Seed: QTVHSIPLTINKEEALQRPVASDFE
QTVHSIPLTINKEFALLRGVAYDFE

SEQ ID NO: 45365 - protein, 25 aa, synthetic construct
  source 1..25: note = Seed: QTVHSIPLTINKEEALQRPVASDFE
QTVHSIPLTINKEFALLRHVAADFE

SEQ ID NO: 45366 - protein, 25 aa, synthetic construct
  source 1..25: note = Seed: QTVHSIPLTINKEEALQRPVASDFE
QTVHSIPLTINKEFALLRHVAGDFE

SEQ ID NO: 45367 - protein, 25 aa, synthetic construct
  source 1..25: note = Seed: QTVHSIPLTINKEEALQRPVASDFE
QTVHSIPLTINKEFALLRHVAHDFE

SEQ ID NO: 45368 - protein, 25 aa, synthetic construct
  source 1..25: note = Seed: QTVHSIPLTINKEEALQRPVASDFE
QTVHSIPLTINKEFALLRHVAMDFE

SEQ ID NO: 45369 - protein, 25 aa, synthetic construct
  source 1..25: note = Seed: QTVHSIPLTINKEEALQRPVASDFE
QTVHSIPLTINKEFALLRHVANDFE

SEQ ID NO: 45370 - protein, 25 aa, synthetic construct
  source 1..25: note = Seed: QTVHSIPLTINKEEALQRPVASDFE
QTVHSIPLTINKEFALLRHVASDFE

SEQ ID NO: 45371 - protein, 25 aa, synthetic construct
  source 1..25: note = Seed: QTVHSIPLTINKEEALQRPVASDFE
QTVHSIPLTINKEFALLRHVATDFE

SEQ ID NO: 45372 - protein, 25 aa, synthetic construct
  source 1..25: note = Seed: QTVHSIPLTINKEEALQRPVASDFE
QTVHSIPLTINKEFALLRHVAVDFE

SEQ ID NO: 45373 - protein, 25 aa, synthetic construct
  source 1..25: note = Seed: QTVHSIPLTINKEEALQRPVASDFE
QTVHSIPLTINKEFALLRIVAADFE

SEQ ID NO: 45374 - protein, 25 aa, synthetic construct
  source 1..25: note = Seed: QTVHSIPLTINKEEALQRPVASDFE
QTVHSIPLTINKEFALLRIVADDFE

SEQ ID NO: 45375 - protein, 25 aa, synthetic construct
  source 1..25: note = Seed: QTVHSIPLTINKEEALQRPVASDFE
QTVHSIPLTINKEFALLRIVAEDFE

SEQ ID NO: 45376 - protein, 25 aa, synthetic construct
  source 1..25: note = Seed: QTVHSIPLTINKEEALQRPVASDFE
QTVHSIPLTINKEFALLRIVAGDFE

SEQ ID NO: 45377 - protein, 25 aa, synthetic construct
  source 1..25: note = Seed: QTVHSIPLTINKEEALQRPVASDFE
QTVHSIPLTINKEFALLRIVAHDFE

SEQ ID NO: 45378 - protein, 25 aa, synthetic construct
  source 1..25: note = Seed: QTVHSIPLTINKEEALQRPVASDFE
QTVHSIPLTINKEFALLRIVAKDFE

SEQ ID NO: 45379 - protein, 25 aa, synthetic construct
  source 1..25: note = Seed: QTVHSIPLTINKEEALQRPVASDFE
QTVHSIPLTINKEFALLRIVAMDFE

SEQ ID NO: 45380 - protein, 25 aa, synthetic construct
  source 1..25: note = Seed: QTVHSIPLTINKEEALQRPVASDFE
QTVHSIPLTINKEFALLRIVANDFE

SEQ ID NO: 45381 - protein, 25 aa, synthetic construct
  source 1..25: note = Seed: QTVHSIPLTINKEEALQRPVASDFE
QTVHSIPLTINKEFALLRIVAPDFE

SEQ ID NO: 45382 - protein, 25 aa, synthetic construct
  source 1..25: note = Seed: QTVHSIPLTINKEEALQRPVASDFE
QTVHSIPLTINKEFALLRIVAQDFE

SEQ ID NO: 45383 - protein, 25 aa, synthetic construct
  source 1..25: note = Seed: QTVHSIPLTINKEEALQRPVASDFE
QTVHSIPLTINKEFALLRIVASDFE

SEQ ID NO: 45384 - protein, 25 aa, synthetic construct
  source 1..25: note = Seed: QTVHSIPLTINKEEALQRPVASDFE
QTVHSIPLTINKEFALLRIVATDFE

SEQ ID NO: 45385 - protein, 25 aa, synthetic construct
  source 1..25: note = Seed: QTVHSIPLTINKEEALQRPVASDFE
QTVHSIPLTINKEFALLRIVAVDFE

SEQ ID NO: 45386 - protein, 25 aa, synthetic construct
  source 1..25: note = Seed: QTVHSIPLTINKEEALQRPVASDFE
QTVHSIPLTINKEFALLRKVAADFE

SEQ ID NO: 45387 - protein, 25 aa, synthetic construct
  source 1..25: note = Seed: QTVHSIPLTINKEEALQRPVASDFE
QTVHSIPLTINKEFALLRKVASDFE

SEQ ID NO: 45388 - protein, 25 aa, synthetic construct
  source 1..25: note = Seed: QTVHSIPLTINKEEALQRPVASDFE
QTVHSIPLTINKEFALLRLVAHDFE

SEQ ID NO: 45389 - protein, 25 aa, synthetic construct
  source 1..25: note = Seed: QTVHSIPLTINKEEALQRPVASDFE
QTVHSIPLTINKEFALLRLVANDFE

SEQ ID NO: 45390 - protein, 25 aa, synthetic construct
  source 1..25: note = Seed: QTVHSIPLTINKEEALQRPVASDFE
QTVHSIPLTINKEFALLRLVASDFE

SEQ ID NO: 45391 - protein, 25 aa, synthetic construct
  source 1..25: note = Seed: QTVHSIPLTINKEEALQRPVASDFE
QTVHSIPLTINKEFALLRMVAADFE

SEQ ID NO: 45392 - protein, 25 aa, synthetic construct
  source 1..25: note = Seed: QTVHSIPLTINKEEALQRPVASDFE
QTVHSIPLTINKEFALLRMVAHDFE

SEQ ID NO: 45393 - protein, 25 aa, synthetic construct
  source 1..25: note = Seed: QTVHSIPLTINKEEALQRPVASDFE
QTVHSIPLTINKEFALLRMVANDFE

SEQ ID NO: 45394 - protein, 25 aa, synthetic construct
  source 1..25: note = Seed: QTVHSIPLTINKEEALQRPVASDFE
QTVHSIPLTINKEFALLRMVASDFE

SEQ ID NO: 45395 - protein, 25 aa, synthetic construct
  source 1..25: note = Seed: QTVHSIPLTINKEEALQRPVASDFE
QTVHSIPLTINKEFALLRNVAADFE

SEQ ID NO: 45396 - protein, 25 aa, synthetic construct
  source 1..25: note = Seed: QTVHSIPLTINKEEALQRPVASDFE
QTVHSIPLTINKEFALLRNVACDFE

SEQ ID NO: 45397 - protein, 25 aa, synthetic construct
  source 1..25: note = Seed: QTVHSIPLTINKEEALQRPVASDFE
QTVHSIPLTINKEFALLRNVADDFE

SEQ ID NO: 45398 - protein, 25 aa, synthetic construct
  source 1..25: note = Seed: QTVHSIPLTINKEEALQRPVASDFE
QTVHSIPLTINKEFALLRNVAEDFE

SEQ ID NO: 45399 - protein, 25 aa, synthetic construct
  source 1..25: note = Seed: QTVHSIPLTINKEEALQRPVASDFE
QTVHSIPLTINKEFALLRNVAFDFE

SEQ ID NO: 45400 - protein, 25 aa, synthetic construct
  source 1..25: note = Seed: QTVHSIPLTINKEEALQRPVASDFE
QTVHSIPLTINKEFALLRNVAGDFE

SEQ ID NO: 45401 - protein, 25 aa, synthetic construct
  source 1..25: note = Seed: QTVHSIPLTINKEEALQRPVASDFE
QTVHSIPLTINKEFALLRNVAHDFE

SEQ ID NO: 45402 - protein, 25 aa, synthetic construct
  source 1..25: note = Seed: QTVHSIPLTINKEEALQRPVASDFE
QTVHSIPLTINKEFALLRNVAIDFE

SEQ ID NO: 45403 - protein, 25 aa, synthetic construct
  source 1..25: note = Seed: QTVHSIPLTINKEEALQRPVASDFE
QTVHSIPLTINKEFALLRNVAKDFE

SEQ ID NO: 45404 - protein, 25 aa, synthetic construct
  source 1..25: note = Seed: QTVHSIPLTINKEEALQRPVASDFE
QTVHSIPLTINKEFALLRNVALDFE

SEQ ID NO: 45405 - protein, 25 aa, synthetic construct
  source 1..25: note = Seed: QTVHSIPLTINKEEALQRPVASDFE
QTVHSIPLTINKEFALLRNVAMDFE

SEQ ID NO: 45406 - protein, 25 aa, synthetic construct
  source 1..25: note = Seed: QTVHSIPLTINKEEALQRPVASDFE
QTVHSIPLTINKEFALLRNVANDFE

SEQ ID NO: 45407 - protein, 25 aa, synthetic construct
  source 1..25: note = Seed: QTVHSIPLTINKEEALQRPVASDFE
QTVHSIPLTINKEFALLRNVAPDFE

SEQ ID NO: 45408 - protein, 25 aa, synthetic construct
  source 1..25: note = Seed: QTVHSIPLTINKEEALQRPVASDFE
QTVHSIPLTINKEFALLRNVAQDFE

SEQ ID NO: 45409 - protein, 25 aa, synthetic construct
  source 1..25: note = Seed: QTVHSIPLTINKEEALQRPVASDFE
QTVHSIPLTINKEFALLRNVASDFE

SEQ ID NO: 45410 - protein, 25 aa, synthetic construct
  source 1..25: note = Seed: QTVHSIPLTINKEEALQRPVASDFE
QTVHSIPLTINKEFALLRNVATDFE

SEQ ID NO: 45411 - protein, 25 aa, synthetic construct
  source 1..25: note = Seed: QTVHSIPLTINKEEALQRPVASDFE
QTVHSIPLTINKEFALLRNVAVDFE

SEQ ID NO: 45412 - protein, 25 aa, synthetic construct
  source 1..25: note = Seed: QTVHSIPLTINKEEALQRPVASDFE
QTVHSIPLTINKEFALLRNVAYDFE

SEQ ID NO: 45413 - protein, 25 aa, synthetic construct
  source 1..25: note = Seed: QTVHSIPLTINKEEALQRPVASDFE
QTVHSIPLTINKEFALLRPVAADFE

SEQ ID NO: 45414 - protein, 25 aa, synthetic construct
  source 1..25: note = Seed: QTVHSIPLTINKEEALQRPVASDFE
QTVHSIPLTINKEFALLRPVACDFE

SEQ ID NO: 45415 - protein, 25 aa, synthetic construct
  source 1..25: note = Seed: QTVHSIPLTINKEEALQRPVASDFE
QTVHSIPLTINKEFALLRPVADDFE

SEQ ID NO: 45416 - protein, 25 aa, synthetic construct
  source 1..25: note = Seed: QTVHSIPLTINKEEALQRPVASDFE
QTVHSIPLTINKEFALLRPVAEDFE

SEQ ID NO: 45417 - protein, 25 aa, synthetic construct
  source 1..25: note = Seed: QTVHSIPLTINKEEALQRPVASDFE
QTVHSIPLTINKEFALLRPVAFDFE

SEQ ID NO: 45418 - protein, 25 aa, synthetic construct
  source 1..25: note = Seed: QTVHSIPLTINKEEALQRPVASDFE
QTVHSIPLTINKEFALLRPVAGDFE

SEQ ID NO: 45419 - protein, 25 aa, synthetic construct
  source 1..25: note = Seed: QTVHSIPLTINKEEALQRPVASDFE
QTVHSIPLTINKEFALLRPVAHDFE

SEQ ID NO: 45420 - protein, 25 aa, synthetic construct
  source 1..25: note = Seed: QTVHSIPLTINKEEALQRPVASDFE
QTVHSIPLTINKEFALLRPVAIDFE

SEQ ID NO: 45421 - protein, 25 aa, synthetic construct
  source 1..25: note = Seed: QTVHSIPLTINKEEALQRPVASDFE
QTVHSIPLTINKEFALLRPVAKDFE

SEQ ID NO: 45422 - protein, 25 aa, synthetic construct
  source 1..25: note = Seed: QTVHSIPLTINKEEALQRPVASDFE
QTVHSIPLTINKEFALLRPVALDFE

SEQ ID NO: 45423 - protein, 25 aa, synthetic construct
  source 1..25: note = Seed: QTVHSIPLTINKEEALQRPVASDFE
QTVHSIPLTINKEFALLRPVAMDFE

SEQ ID NO: 45424 - protein, 25 aa, synthetic construct
  source 1..25: note = Seed: QTVHSIPLTINKEEALQRPVASDFE
QTVHSIPLTINKEFALLRPVANDFE

SEQ ID NO: 45425 - protein, 25 aa, synthetic construct
  source 1..25: note = Seed: QTVHSIPLTINKEEALQRPVASDFE
QTVHSIPLTINKEFALLRPVAPDFE

SEQ ID NO: 45426 - protein, 25 aa, synthetic construct
  source 1..25: note = Seed: QTVHSIPLTINKEEALQRPVASDFE
QTVHSIPLTINKEFALLRPVAQDFE

SEQ ID NO: 45427 - protein, 25 aa, synthetic construct
  source 1..25: note = Seed: QTVHSIPLTINKEEALQRPVASDFE
QTVHSIPLTINKEFALLRPVARDFE

SEQ ID NO: 45428 - protein, 25 aa, synthetic construct
  source 1..25: note = Seed: QTVHSIPLTINKEEALQRPVASDFE
QTVHSIPLTINKEFALLRPVASDFE

SEQ ID NO: 45429 - protein, 25 aa, synthetic construct
  source 1..25: note = Seed: QTVHSIPLTINKEEALQRPVASDFE
QTVHSIPLTINKEFALLRPVATDFE

SEQ ID NO: 45430 - protein, 25 aa, synthetic construct
  source 1..25: note = Seed: QTVHSIPLTINKEEALQRPVASDFE
QTVHSIPLTINKEFALLRPVAVDFE

SEQ ID NO: 45431 - protein, 25 aa, synthetic construct
  source 1..25: note = Seed: QTVHSIPLTINKEEALQRPVASDFE
QTVHSIPLTINKEFALLRPVAWDFE

SEQ ID NO: 45432 - protein, 25 aa, synthetic construct
  source 1..25: note = Seed: QTVHSIPLTINKEEALQRPVASDFE
QTVHSIPLTINKEFALLRPVAYDFE

SEQ ID NO: 45433 - protein, 25 aa, synthetic construct
  source 1..25: note = Seed: QTVHSIPLTINKEEALQRPVASDFE
QTVHSIPLTINKEFALLRQVAADFE

SEQ ID NO: 45434 - protein, 25 aa, synthetic construct
  source 1..25: note = Seed: QTVHSIPLTINKEEALQRPVASDFE
QTVHSIPLTINKEFALLRQVANDFE

SEQ ID NO: 45435 - protein, 25 aa, synthetic construct
  source 1..25: note = Seed: QTVHSIPLTINKEEALQRPVASDFE
QTVHSIPLTINKEFALLRQVASDFE

SEQ ID NO: 45436 - protein, 25 aa, synthetic construct
  source 1..25: note = Seed: QTVHSIPLTINKEEALQRPVASDFE
QTVHSIPLTINKEFALLRQVATDFE

SEQ ID NO: 45437 - protein, 25 aa, synthetic construct
  source 1..25: note = Seed: QTVHSIPLTINKEEALQRPVASDFE
QTVHSIPLTINKEFALLRSVAADFE

SEQ ID NO: 45438 - protein, 25 aa, synthetic construct
  source 1..25: note = Seed: QTVHSIPLTINKEEALQRPVASDFE
QTVHSIPLTINKEFALLRSVACDFE

SEQ ID NO: 45439 - protein, 25 aa, synthetic construct
  source 1..25: note = Seed: QTVHSIPLTINKEEALQRPVASDFE
QTVHSIPLTINKEFALLRSVADDFE

SEQ ID NO: 45440 - protein, 25 aa, synthetic construct
  source 1..25: note = Seed: QTVHSIPLTINKEEALQRPVASDFE
QTVHSIPLTINKEFALLRSVAEDFE

SEQ ID NO: 45441 - protein, 25 aa, synthetic construct
  source 1..25: note = Seed: QTVHSIPLTINKEEALQRPVASDFE
QTVHSIPLTINKEFALLRSVAFDFE

SEQ ID NO: 45442 - protein, 25 aa, synthetic construct
  source 1..25: note = Seed: QTVHSIPLTINKEEALQRPVASDFE
QTVHSIPLTINKEFALLRSVAGDFE

SEQ ID NO: 45443 - protein, 25 aa, synthetic construct
  source 1..25: note = Seed: QTVHSIPLTINKEEALQRPVASDFE
QTVHSIPLTINKEFALLRSVAHDFE

SEQ ID NO: 45444 - protein, 25 aa, synthetic construct
  source 1..25: note = Seed: QTVHSIPLTINKEEALQRPVASDFE
QTVHSIPLTINKEFALLRSVAIDFE

SEQ ID NO: 45445 - protein, 25 aa, synthetic construct
  source 1..25: note = Seed: QTVHSIPLTINKEEALQRPVASDFE
QTVHSIPLTINKEFALLRSVAKDFE

SEQ ID NO: 45446 - protein, 25 aa, synthetic construct
  source 1..25: note = Seed: QTVHSIPLTINKEEALQRPVASDFE
QTVHSIPLTINKEFALLRSVALDFE

SEQ ID NO: 45447 - protein, 25 aa, synthetic construct
  source 1..25: note = Seed: QTVHSIPLTINKEEALQRPVASDFE
QTVHSIPLTINKEFALLRSVAMDFE

SEQ ID NO: 45448 - protein, 25 aa, synthetic construct
  source 1..25: note = Seed: QTVHSIPLTINKEEALQRPVASDFE
QTVHSIPLTINKEFALLRSVANDFE

SEQ ID NO: 45449 - protein, 25 aa, synthetic construct
  source 1..25: note = Seed: QTVHSIPLTINKEEALQRPVASDFE
QTVHSIPLTINKEFALLRSVAPDFE

SEQ ID NO: 45450 - protein, 25 aa, synthetic construct
  source 1..25: note = Seed: QTVHSIPLTINKEEALQRPVASDFE
QTVHSIPLTINKEFALLRSVAQDFE

SEQ ID NO: 45451 - protein, 25 aa, synthetic construct
  source 1..25: note = Seed: QTVHSIPLTINKEEALQRPVASDFE
QTVHSIPLTINKEFALLRSVARDFE

SEQ ID NO: 45452 - protein, 25 aa, synthetic construct
  source 1..25: note = Seed: QTVHSIPLTINKEEALQRPVASDFE
QTVHSIPLTINKEFALLRSVASDFE

SEQ ID NO: 45453 - protein, 25 aa, synthetic construct
  source 1..25: note = Seed: QTVHSIPLTINKEEALQRPVASDFE
QTVHSIPLTINKEFALLRSVATDFE

SEQ ID NO: 45454 - protein, 25 aa, synthetic construct
  source 1..25: note = Seed: QTVHSIPLTINKEEALQRPVASDFE
QTVHSIPLTINKEFALLRSVAVDFE

SEQ ID NO: 45455 - protein, 25 aa, synthetic construct
  source 1..25: note = Seed: QTVHSIPLTINKEEALQRPVASDFE
QTVHSIPLTINKEFALLRSVAYDFE

SEQ ID NO: 45456 - protein, 25 aa, synthetic construct
  source 1..25: note = Seed: QTVHSIPLTINKEEALQRPVASDFE
QTVHSIPLTINKEFALLRTVAADFE

SEQ ID NO: 45457 - protein, 25 aa, synthetic construct
  source 1..25: note = Seed: QTVHSIPLTINKEEALQRPVASDFE
QTVHSIPLTINKEFALLRTVACDFE

SEQ ID NO: 45458 - protein, 25 aa, synthetic construct
  source 1..25: note = Seed: QTVHSIPLTINKEEALQRPVASDFE
QTVHSIPLTINKEFALLRTVADDFE

SEQ ID NO: 45459 - protein, 25 aa, synthetic construct
  source 1..25: note = Seed: QTVHSIPLTINKEEALQRPVASDFE
QTVHSIPLTINKEFALLRTVAEDFE

SEQ ID NO: 45460 - protein, 25 aa, synthetic construct
  source 1..25: note = Seed: QTVHSIPLTINKEEALQRPVASDFE
QTVHSIPLTINKEFALLRTVAFDFE

SEQ ID NO: 45461 - protein, 25 aa, synthetic construct
  source 1..25: note = Seed: QTVHSIPLTINKEEALQRPVASDFE
QTVHSIPLTINKEFALLRTVAGDFE

SEQ ID NO: 45462 - protein, 25 aa, synthetic construct
  source 1..25: note = Seed: QTVHSIPLTINKEEALQRPVASDFE
QTVHSIPLTINKEFALLRTVAHDFE

SEQ ID NO: 45463 - protein, 25 aa, synthetic construct
  source 1..25: note = Seed: QTVHSIPLTINKEEALQRPVASDFE
QTVHSIPLTINKEFALLRTVAIDFE

SEQ ID NO: 45464 - protein, 25 aa, synthetic construct
  source 1..25: note = Seed: QTVHSIPLTINKEEALQRPVASDFE
QTVHSIPLTINKEFALLRTVAKDFE

SEQ ID NO: 45465 - protein, 25 aa, synthetic construct
  source 1..25: note = Seed: QTVHSIPLTINKEEALQRPVASDFE
QTVHSIPLTINKEFALLRTVALDFE

SEQ ID NO: 45466 - protein, 25 aa, synthetic construct
  source 1..25: note = Seed: QTVHSIPLTINKEEALQRPVASDFE
QTVHSIPLTINKEFALLRTVAMDFE

SEQ ID NO: 45467 - protein, 25 aa, synthetic construct
  source 1..25: note = Seed: QTVHSIPLTINKEEALQRPVASDFE
QTVHSIPLTINKEFALLRTVANDFE

SEQ ID NO: 45468 - protein, 25 aa, synthetic construct
  source 1..25: note = Seed: QTVHSIPLTINKEEALQRPVASDFE
QTVHSIPLTINKEFALLRTVAPDFE

SEQ ID NO: 45469 - protein, 25 aa, synthetic construct
  source 1..25: note = Seed: QTVHSIPLTINKEEALQRPVASDFE
QTVHSIPLTINKEFALLRTVAQDFE

SEQ ID NO: 45470 - protein, 25 aa, synthetic construct
  source 1..25: note = Seed: QTVHSIPLTINKEEALQRPVASDFE
QTVHSIPLTINKEFALLRTVARDFE

SEQ ID NO: 45471 - protein, 25 aa, synthetic construct
  source 1..25: note = Seed: QTVHSIPLTINKEEALQRPVASDFE
QTVHSIPLTINKEFALLRTVASDFE

SEQ ID NO: 45472 - protein, 25 aa, synthetic construct
  source 1..25: note = Seed: QTVHSIPLTINKEEALQRPVASDFE
QTVHSIPLTINKEFALLRTVATDFE

SEQ ID NO: 45473 - protein, 25 aa, synthetic construct
  source 1..25: note = Seed: QTVHSIPLTINKEEALQRPVASDFE
QTVHSIPLTINKEFALLRTVAVDFE

SEQ ID NO: 45474 - protein, 25 aa, synthetic construct
  source 1..25: note = Seed: QTVHSIPLTINKEEALQRPVASDFE
QTVHSIPLTINKEFALLRTVAYDFE

SEQ ID NO: 45475 - protein, 25 aa, synthetic construct
  source 1..25: note = Seed: QTVHSIPLTINKEEALQRPVASDFE
QTVHSIPLTINKEFALLRVVAADFE

SEQ ID NO: 45476 - protein, 25 aa, synthetic construct
  source 1..25: note = Seed: QTVHSIPLTINKEEALQRPVASDFE
QTVHSIPLTINKEFALLRVVADDFE

SEQ ID NO: 45477 - protein, 25 aa, synthetic construct
  source 1..25: note = Seed: QTVHSIPLTINKEEALQRPVASDFE
QTVHSIPLTINKEFALLRVVAEDFE

SEQ ID NO: 45478 - protein, 25 aa, synthetic construct
  source 1..25: note = Seed: QTVHSIPLTINKEEALQRPVASDFE
QTVHSIPLTINKEFALLRVVAGDFE

SEQ ID NO: 45479 - protein, 25 aa, synthetic construct
  source 1..25: note = Seed: QTVHSIPLTINKEEALQRPVASDFE
QTVHSIPLTINKEFALLRVVAHDFE

SEQ ID NO: 45480 - protein, 25 aa, synthetic construct
  source 1..25: note = Seed: QTVHSIPLTINKEEALQRPVASDFE
QTVHSIPLTINKEFALLRVVAIDFE

SEQ ID NO: 45481 - protein, 25 aa, synthetic construct
  source 1..25: note = Seed: QTVHSIPLTINKEEALQRPVASDFE
QTVHSIPLTINKEFALLRVVAKDFE

SEQ ID NO: 45482 - protein, 25 aa, synthetic construct
  source 1..25: note = Seed: QTVHSIPLTINKEEALQRPVASDFE
QTVHSIPLTINKEFALLRVVALDFE

SEQ ID NO: 45483 - protein, 25 aa, synthetic construct
  source 1..25: note = Seed: QTVHSIPLTINKEEALQRPVASDFE
QTVHSIPLTINKEFALLRVVAMDFE

SEQ ID NO: 45484 - protein, 25 aa, synthetic construct
  source 1..25: note = Seed: QTVHSIPLTINKEEALQRPVASDFE
QTVHSIPLTINKEFALLRVVANDFE

SEQ ID NO: 45485 - protein, 25 aa, synthetic construct
  source 1..25: note = Seed: QTVHSIPLTINKEEALQRPVASDFE
QTVHSIPLTINKEFALLRVVAPDFE

SEQ ID NO: 45486 - protein, 25 aa, synthetic construct
  source 1..25: note = Seed: QTVHSIPLTINKEEALQRPVASDFE
QTVHSIPLTINKEFALLRVVAQDFE

SEQ ID NO: 45487 - protein, 25 aa, synthetic construct
  source 1..25: note = Seed: QTVHSIPLTINKEEALQRPVASDFE
QTVHSIPLTINKEFALLRVVARDFE

SEQ ID NO: 45488 - protein, 25 aa, synthetic construct
  source 1..25: note = Seed: QTVHSIPLTINKEEALQRPVASDFE
QTVHSIPLTINKEFALLRVVASDFE

SEQ ID NO: 45489 - protein, 25 aa, synthetic construct
  source 1..25: note = Seed: QTVHSIPLTINKEEALQRPVASDFE
QTVHSIPLTINKEFALLRVVATDFE

SEQ ID NO: 45490 - protein, 25 aa, synthetic construct
  source 1..25: note = Seed: QTVHSIPLTINKEEALQRPVASDFE
QTVHSIPLTINKEFALLRVVAVDFE

SEQ ID NO: 45491 - protein, 25 aa, synthetic construct
  source 1..25: note = Seed: QTVHSIPLTINKEEALQRPVASDFE
QTVHSIPLTINKEFALLRYVANDFE

SEQ ID NO: 45492 - protein, 25 aa, synthetic construct
  source 1..25: note = Seed: QTVHSIPLTINKEEALQRPVASDFE
QTVHSIPLTINKEFALMRAVAADFE

SEQ ID NO: 45493 - protein, 25 aa, synthetic construct
  source 1..25: note = Seed: QTVHSIPLTINKEEALQRPVASDFE
QTVHSIPLTINKEFALMRAVACDFE

SEQ ID NO: 45494 - protein, 25 aa, synthetic construct
  source 1..25: note = Seed: QTVHSIPLTINKEEALQRPVASDFE
QTVHSIPLTINKEFALMRAVADDFE

SEQ ID NO: 45495 - protein, 25 aa, synthetic construct
  source 1..25: note = Seed: QTVHSIPLTINKEEALQRPVASDFE
QTVHSIPLTINKEFALMRAVAEDFE

SEQ ID NO: 45496 - protein, 25 aa, synthetic construct
  source 1..25: note = Seed: QTVHSIPLTINKEEALQRPVASDFE
QTVHSIPLTINKEFALMRAVAFDFE

SEQ ID NO: 45497 - protein, 25 aa, synthetic construct
  source 1..25: note = Seed: QTVHSIPLTINKEEALQRPVASDFE
QTVHSIPLTINKEFALMRAVAGDFE

SEQ ID NO: 45498 - protein, 25 aa, synthetic construct
  source 1..25: note = Seed: QTVHSIPLTINKEEALQRPVASDFE
QTVHSIPLTINKEFALMRAVAHDFE

SEQ ID NO: 45499 - protein, 25 aa, synthetic construct
  source 1..25: note = Seed: QTVHSIPLTINKEEALQRPVASDFE
QTVHSIPLTINKEFALMRAVAIDFE

SEQ ID NO: 45500 - protein, 25 aa, synthetic construct
  source 1..25: note = Seed: QTVHSIPLTINKEEALQRPVASDFE
QTVHSIPLTINKEFALMRAVAKDFE

SEQ ID NO: 45501 - protein, 25 aa, synthetic construct
  source 1..25: note = Seed: QTVHSIPLTINKEEALQRPVASDFE
QTVHSIPLTINKEFALMRAVALDFE

SEQ ID NO: 45502 - protein, 25 aa, synthetic construct
  source 1..25: note = Seed: QTVHSIPLTINKEEALQRPVASDFE
QTVHSIPLTINKEFALMRAVAMDFE

SEQ ID NO: 45503 - protein, 25 aa, synthetic construct
  source 1..25: note = Seed: QTVHSIPLTINKEEALQRPVASDFE
QTVHSIPLTINKEFALMRAVANDFE

SEQ ID NO: 45504 - protein, 25 aa, synthetic construct
  source 1..25: note = Seed: QTVHSIPLTINKEEALQRPVASDFE
QTVHSIPLTINKEFALMRAVAPDFE

SEQ ID NO: 45505 - protein, 25 aa, synthetic construct
  source 1..25: note = Seed: QTVHSIPLTINKEEALQRPVASDFE
QTVHSIPLTINKEFALMRAVAQDFE

SEQ ID NO: 45506 - protein, 25 aa, synthetic construct
  source 1..25: note = Seed: QTVHSIPLTINKEEALQRPVASDFE
QTVHSIPLTINKEFALMRAVARDFE

SEQ ID NO: 45507 - protein, 25 aa, synthetic construct
  source 1..25: note = Seed: QTVHSIPLTINKEEALQRPVASDFE
QTVHSIPLTINKEFALMRAVASDFE

SEQ ID NO: 45508 - protein, 25 aa, synthetic construct
  source 1..25: note = Seed: QTVHSIPLTINKEEALQRPVASDFE
QTVHSIPLTINKEFALMRAVATDFE

SEQ ID NO: 45509 - protein, 25 aa, synthetic construct
  source 1..25: note = Seed: QTVHSIPLTINKEEALQRPVASDFE
QTVHSIPLTINKEFALMRAVAVDFE

SEQ ID NO: 45510 - protein, 25 aa, synthetic construct
  source 1..25: note = Seed: QTVHSIPLTINKEEALQRPVASDFE
QTVHSIPLTINKEFALMRAVAYDFE

SEQ ID NO: 45511 - protein, 25 aa, synthetic construct
  source 1..25: note = Seed: QTVHSIPLTINKEEALQRPVASDFE
QTVHSIPLTINKEFALMRCVAADFE

SEQ ID NO: 45512 - protein, 25 aa, synthetic construct
  source 1..25: note = Seed: QTVHSIPLTINKEEALQRPVASDFE
QTVHSIPLTINKEFALMRCVAHDFE

SEQ ID NO: 45513 - protein, 25 aa, synthetic construct
  source 1..25: note = Seed: QTVHSIPLTINKEEALQRPVASDFE
QTVHSIPLTINKEFALMRCVANDFE

SEQ ID NO: 45514 - protein, 25 aa, synthetic construct
  source 1..25: note = Seed: QTVHSIPLTINKEEALQRPVASDFE
QTVHSIPLTINKEFALMRCVASDFE

SEQ ID NO: 45515 - protein, 25 aa, synthetic construct
  source 1..25: note = Seed: QTVHSIPLTINKEEALQRPVASDFE
QTVHSIPLTINKEFALMRCVATDFE

SEQ ID NO: 45516 - protein, 25 aa, synthetic construct
  source 1..25: note = Seed: QTVHSIPLTINKEEALQRPVASDFE
QTVHSIPLTINKEFALMRDVAADFE

SEQ ID NO: 45517 - protein, 25 aa, synthetic construct
  source 1..25: note = Seed: QTVHSIPLTINKEEALQRPVASDFE
QTVHSIPLTINKEFALMRDVAGDFE

SEQ ID NO: 45518 - protein, 25 aa, synthetic construct
  source 1..25: note = Seed: QTVHSIPLTINKEEALQRPVASDFE
QTVHSIPLTINKEFALMRDVAIDFE

SEQ ID NO: 45519 - protein, 25 aa, synthetic construct
  source 1..25: note = Seed: QTVHSIPLTINKEEALQRPVASDFE
QTVHSIPLTINKEFALMRDVALDFE

SEQ ID NO: 45520 - protein, 25 aa, synthetic construct
  source 1..25: note = Seed: QTVHSIPLTINKEEALQRPVASDFE
QTVHSIPLTINKEFALMRDVAMDFE

SEQ ID NO: 45521 - protein, 25 aa, synthetic construct
  source 1..25: note = Seed: QTVHSIPLTINKEEALQRPVASDFE
QTVHSIPLTINKEFALMRDVANDFE

SEQ ID NO: 45522 - protein, 25 aa, synthetic construct
  source 1..25: note = Seed: QTVHSIPLTINKEEALQRPVASDFE
QTVHSIPLTINKEFALMRDVASDFE

SEQ ID NO: 45523 - protein, 25 aa, synthetic construct
  source 1..25: note = Seed: QTVHSIPLTINKEEALQRPVASDFE
QTVHSIPLTINKEFALMRDVATDFE

SEQ ID NO: 45524 - protein, 25 aa, synthetic construct
  source 1..25: note = Seed: QTVHSIPLTINKEEALQRPVASDFE
QTVHSIPLTINKEFALMRDVAVDFE

SEQ ID NO: 45525 - protein, 25 aa, synthetic construct
  source 1..25: note = Seed: QTVHSIPLTINKEEALQRPVASDFE
QTVHSIPLTINKEFALMREVAADFE

SEQ ID NO: 45526 - protein, 25 aa, synthetic construct
  source 1..25: note = Seed: QTVHSIPLTINKEEALQRPVASDFE
QTVHSIPLTINKEFALMREVAGDFE

SEQ ID NO: 45527 - protein, 25 aa, synthetic construct
  source 1..25: note = Seed: QTVHSIPLTINKEEALQRPVASDFE
QTVHSIPLTINKEFALMREVAHDFE

SEQ ID NO: 45528 - protein, 25 aa, synthetic construct
  source 1..25: note = Seed: QTVHSIPLTINKEEALQRPVASDFE
QTVHSIPLTINKEFALMREVAIDFE

SEQ ID NO: 45529 - protein, 25 aa, synthetic construct
  source 1..25: note = Seed: QTVHSIPLTINKEEALQRPVASDFE
QTVHSIPLTINKEFALMREVALDFE

SEQ ID NO: 45530 - protein, 25 aa, synthetic construct
  source 1..25: note = Seed: QTVHSIPLTINKEEALQRPVASDFE
QTVHSIPLTINKEFALMREVAMDFE

SEQ ID NO: 45531 - protein, 25 aa, synthetic construct
  source 1..25: note = Seed: QTVHSIPLTINKEEALQRPVASDFE
QTVHSIPLTINKEFALMREVANDFE

SEQ ID NO: 45532 - protein, 25 aa, synthetic construct
  source 1..25: note = Seed: QTVHSIPLTINKEEALQRPVASDFE
QTVHSIPLTINKEFALMREVASDFE

SEQ ID NO: 45533 - protein, 25 aa, synthetic construct
  source 1..25: note = Seed: QTVHSIPLTINKEEALQRPVASDFE
QTVHSIPLTINKEFALMREVATDFE

SEQ ID NO: 45534 - protein, 25 aa, synthetic construct
  source 1..25: note = Seed: QTVHSIPLTINKEEALQRPVASDFE
QTVHSIPLTINKEFALMREVAVDFE

SEQ ID NO: 45535 - protein, 25 aa, synthetic construct
  source 1..25: note = Seed: QTVHSIPLTINKEEALQRPVASDFE
QTVHSIPLTINKEFALMRFVANDFE

SEQ ID NO: 45536 - protein, 25 aa, synthetic construct
  source 1..25: note = Seed: QTVHSIPLTINKEEALQRPVASDFE
QTVHSIPLTINKEFALMRGVAADFE

SEQ ID NO: 45537 - protein, 25 aa, synthetic construct
  source 1..25: note = Seed: QTVHSIPLTINKEEALQRPVASDFE
QTVHSIPLTINKEFALMRGVACDFE

SEQ ID NO: 45538 - protein, 25 aa, synthetic construct
  source 1..25: note = Seed: QTVHSIPLTINKEEALQRPVASDFE
QTVHSIPLTINKEFALMRGVADDFE

SEQ ID NO: 45539 - protein, 25 aa, synthetic construct
  source 1..25: note = Seed: QTVHSIPLTINKEEALQRPVASDFE
QTVHSIPLTINKEFALMRGVAEDFE

SEQ ID NO: 45540 - protein, 25 aa, synthetic construct
  source 1..25: note = Seed: QTVHSIPLTINKEEALQRPVASDFE
QTVHSIPLTINKEFALMRGVAFDFE

SEQ ID NO: 45541 - protein, 25 aa, synthetic construct
  source 1..25: note = Seed: QTVHSIPLTINKEEALQRPVASDFE
QTVHSIPLTINKEFALMRGVAGDFE

SEQ ID NO: 45542 - protein, 25 aa, synthetic construct
  source 1..25: note = Seed: QTVHSIPLTINKEEALQRPVASDFE
QTVHSIPLTINKEFALMRGVAHDFE

SEQ ID NO: 45543 - protein, 25 aa, synthetic construct
  source 1..25: note = Seed: QTVHSIPLTINKEEALQRPVASDFE
QTVHSIPLTINKEFALMRGVAIDFE

SEQ ID NO: 45544 - protein, 25 aa, synthetic construct
  source 1..25: note = Seed: QTVHSIPLTINKEEALQRPVASDFE
QTVHSIPLTINKEFALMRGVAKDFE

SEQ ID NO: 45545 - protein, 25 aa, synthetic construct
  source 1..25: note = Seed: QTVHSIPLTINKEEALQRPVASDFE
QTVHSIPLTINKEFALMRGVALDFE

SEQ ID NO: 45546 - protein, 25 aa, synthetic construct
  source 1..25: note = Seed: QTVHSIPLTINKEEALQRPVASDFE
QTVHSIPLTINKEFALMRGVAMDFE

SEQ ID NO: 45547 - protein, 25 aa, synthetic construct
  source 1..25: note = Seed: QTVHSIPLTINKEEALQRPVASDFE
QTVHSIPLTINKEFALMRGVANDFE

SEQ ID NO: 45548 - protein, 25 aa, synthetic construct
  source 1..25: note = Seed: QTVHSIPLTINKEEALQRPVASDFE
QTVHSIPLTINKEFALMRGVAPDFE

SEQ ID NO: 45549 - protein, 25 aa, synthetic construct
  source 1..25: note = Seed: QTVHSIPLTINKEEALQRPVASDFE
QTVHSIPLTINKEFALMRGVAQDFE

SEQ ID NO: 45550 - protein, 25 aa, synthetic construct
  source 1..25: note = Seed: QTVHSIPLTINKEEALQRPVASDFE
QTVHSIPLTINKEFALMRGVARDFE

SEQ ID NO: 45551 - protein, 25 aa, synthetic construct
  source 1..25: note = Seed: QTVHSIPLTINKEEALQRPVASDFE
QTVHSIPLTINKEFALMRGVASDFE

SEQ ID NO: 45552 - protein, 25 aa, synthetic construct
  source 1..25: note = Seed: QTVHSIPLTINKEEALQRPVASDFE
QTVHSIPLTINKEFALMRGVATDFE

SEQ ID NO: 45553 - protein, 25 aa, synthetic construct
  source 1..25: note = Seed: QTVHSIPLTINKEEALQRPVASDFE
QTVHSIPLTINKEFALMRGVAVDFE

SEQ ID NO: 45554 - protein, 25 aa, synthetic construct
  source 1..25: note = Seed: QTVHSIPLTINKEEALQRPVASDFE
QTVHSIPLTINKEFALMRGVAYDFE

SEQ ID NO: 45555 - protein, 25 aa, synthetic construct
  source 1..25: note = Seed: QTVHSIPLTINKEEALQRPVASDFE
QTVHSIPLTINKEFALMRHVAADFE

SEQ ID NO: 45556 - protein, 25 aa, synthetic construct
  source 1..25: note = Seed: QTVHSIPLTINKEEALQRPVASDFE
QTVHSIPLTINKEFALMRHVADDFE

SEQ ID NO: 45557 - protein, 25 aa, synthetic construct
  source 1..25: note = Seed: QTVHSIPLTINKEEALQRPVASDFE
QTVHSIPLTINKEFALMRHVAGDFE

SEQ ID NO: 45558 - protein, 25 aa, synthetic construct
  source 1..25: note = Seed: QTVHSIPLTINKEEALQRPVASDFE
QTVHSIPLTINKEFALMRHVAHDFE

SEQ ID NO: 45559 - protein, 25 aa, synthetic construct
  source 1..25: note = Seed: QTVHSIPLTINKEEALQRPVASDFE
QTVHSIPLTINKEFALMRHVAIDFE

SEQ ID NO: 45560 - protein, 25 aa, synthetic construct
  source 1..25: note = Seed: QTVHSIPLTINKEEALQRPVASDFE
QTVHSIPLTINKEFALMRHVALDFE

SEQ ID NO: 45561 - protein, 25 aa, synthetic construct
  source 1..25: note = Seed: QTVHSIPLTINKEEALQRPVASDFE
QTVHSIPLTINKEFALMRHVAMDFE

SEQ ID NO: 45562 - protein, 25 aa, synthetic construct
  source 1..25: note = Seed: QTVHSIPLTINKEEALQRPVASDFE
QTVHSIPLTINKEFALMRHVANDFE

SEQ ID NO: 45563 - protein, 25 aa, synthetic construct
  source 1..25: note = Seed: QTVHSIPLTINKEEALQRPVASDFE
QTVHSIPLTINKEFALMRHVAPDFE

SEQ ID NO: 45564 - protein, 25 aa, synthetic construct
  source 1..25: note = Seed: QTVHSIPLTINKEEALQRPVASDFE
QTVHSIPLTINKEFALMRHVAQDFE

SEQ ID NO: 45565 - protein, 25 aa, synthetic construct
  source 1..25: note = Seed: QTVHSIPLTINKEEALQRPVASDFE
QTVHSIPLTINKEFALMRHVASDFE

SEQ ID NO: 45566 - protein, 25 aa, synthetic construct
  source 1..25: note = Seed: QTVHSIPLTINKEEALQRPVASDFE
QTVHSIPLTINKEFALMRHVATDFE

SEQ ID NO: 45567 - protein, 25 aa, synthetic construct
  source 1..25: note = Seed: QTVHSIPLTINKEEALQRPVASDFE
QTVHSIPLTINKEFALMRHVAVDFE

SEQ ID NO: 45568 - protein, 25 aa, synthetic construct
  source 1..25: note = Seed: QTVHSIPLTINKEEALQRPVASDFE
QTVHSIPLTINKEFALMRIVAADFE

SEQ ID NO: 45569 - protein, 25 aa, synthetic construct
  source 1..25: note = Seed: QTVHSIPLTINKEEALQRPVASDFE
QTVHSIPLTINKEFALMRIVADDFE

SEQ ID NO: 45570 - protein, 25 aa, synthetic construct
  source 1..25: note = Seed: QTVHSIPLTINKEEALQRPVASDFE
QTVHSIPLTINKEFALMRIVAEDFE

SEQ ID NO: 45571 - protein, 25 aa, synthetic construct
  source 1..25: note = Seed: QTVHSIPLTINKEEALQRPVASDFE
QTVHSIPLTINKEFALMRIVAGDFE

SEQ ID NO: 45572 - protein, 25 aa, synthetic construct
  source 1..25: note = Seed: QTVHSIPLTINKEEALQRPVASDFE
QTVHSIPLTINKEFALMRIVAHDFE

SEQ ID NO: 45573 - protein, 25 aa, synthetic construct
  source 1..25: note = Seed: QTVHSIPLTINKEEALQRPVASDFE
QTVHSIPLTINKEFALMRIVAIDFE

SEQ ID NO: 45574 - protein, 25 aa, synthetic construct
  source 1..25: note = Seed: QTVHSIPLTINKEEALQRPVASDFE
QTVHSIPLTINKEFALMRIVAKDFE

SEQ ID NO: 45575 - protein, 25 aa, synthetic construct
  source 1..25: note = Seed: QTVHSIPLTINKEEALQRPVASDFE
QTVHSIPLTINKEFALMRIVALDFE

SEQ ID NO: 45576 - protein, 25 aa, synthetic construct
  source 1..25: note = Seed: QTVHSIPLTINKEEALQRPVASDFE
QTVHSIPLTINKEFALMRIVAMDFE

SEQ ID NO: 45577 - protein, 25 aa, synthetic construct
  source 1..25: note = Seed: QTVHSIPLTINKEEALQRPVASDFE
QTVHSIPLTINKEFALMRIVANDFE

SEQ ID NO: 45578 - protein, 25 aa, synthetic construct
  source 1..25: note = Seed: QTVHSIPLTINKEEALQRPVASDFE
QTVHSIPLTINKEFALMRIVAPDFE

SEQ ID NO: 45579 - protein, 25 aa, synthetic construct
  source 1..25: note = Seed: QTVHSIPLTINKEEALQRPVASDFE
QTVHSIPLTINKEFALMRIVAQDFE

SEQ ID NO: 45580 - protein, 25 aa, synthetic construct
  source 1..25: note = Seed: QTVHSIPLTINKEEALQRPVASDFE
QTVHSIPLTINKEFALMRIVARDFE

SEQ ID NO: 45581 - protein, 25 aa, synthetic construct
  source 1..25: note = Seed: QTVHSIPLTINKEEALQRPVASDFE
QTVHSIPLTINKEFALMRIVASDFE

SEQ ID NO: 45582 - protein, 25 aa, synthetic construct
  source 1..25: note = Seed: QTVHSIPLTINKEEALQRPVASDFE
QTVHSIPLTINKEFALMRIVATDFE

SEQ ID NO: 45583 - protein, 25 aa, synthetic construct
  source 1..25: note = Seed: QTVHSIPLTINKEEALQRPVASDFE
QTVHSIPLTINKEFALMRIVAVDFE

SEQ ID NO: 45584 - protein, 25 aa, synthetic construct
  source 1..25: note = Seed: QTVHSIPLTINKEEALQRPVASDFE
QTVHSIPLTINKEFALMRKVAADFE

SEQ ID NO: 45585 - protein, 25 aa, synthetic construct
  source 1..25: note = Seed: QTVHSIPLTINKEEALQRPVASDFE
QTVHSIPLTINKEFALMRKVANDFE

SEQ ID NO: 45586 - protein, 25 aa, synthetic construct
  source 1..25: note = Seed: QTVHSIPLTINKEEALQRPVASDFE
QTVHSIPLTINKEFALMRKVASDFE

SEQ ID NO: 45587 - protein, 25 aa, synthetic construct
  source 1..25: note = Seed: QTVHSIPLTINKEEALQRPVASDFE
QTVHSIPLTINKEFALMRKVATDFE

SEQ ID NO: 45588 - protein, 25 aa, synthetic construct
  source 1..25: note = Seed: QTVHSIPLTINKEEALQRPVASDFE
QTVHSIPLTINKEFALMRKVAVDFE

SEQ ID NO: 45589 - protein, 25 aa, synthetic construct
  source 1..25: note = Seed: QTVHSIPLTINKEEALQRPVASDFE
QTVHSIPLTINKEFALMRLVAADFE

SEQ ID NO: 45590 - protein, 25 aa, synthetic construct
  source 1..25: note = Seed: QTVHSIPLTINKEEALQRPVASDFE
QTVHSIPLTINKEFALMRLVADDFE

SEQ ID NO: 45591 - protein, 25 aa, synthetic construct
  source 1..25: note = Seed: QTVHSIPLTINKEEALQRPVASDFE
QTVHSIPLTINKEFALMRLVAEDFE

SEQ ID NO: 45592 - protein, 25 aa, synthetic construct
  source 1..25: note = Seed: QTVHSIPLTINKEEALQRPVASDFE
QTVHSIPLTINKEFALMRLVAGDFE

SEQ ID NO: 45593 - protein, 25 aa, synthetic construct
  source 1..25: note = Seed: QTVHSIPLTINKEEALQRPVASDFE
QTVHSIPLTINKEFALMRLVAHDFE

SEQ ID NO: 45594 - protein, 25 aa, synthetic construct
  source 1..25: note = Seed: QTVHSIPLTINKEEALQRPVASDFE
QTVHSIPLTINKEFALMRLVAKDFE

SEQ ID NO: 45595 - protein, 25 aa, synthetic construct
  source 1..25: note = Seed: QTVHSIPLTINKEEALQRPVASDFE
QTVHSIPLTINKEFALMRLVANDFE

SEQ ID NO: 45596 - protein, 25 aa, synthetic construct
  source 1..25: note = Seed: QTVHSIPLTINKEEALQRPVASDFE
QTVHSIPLTINKEFALMRLVASDFE

SEQ ID NO: 45597 - protein, 25 aa, synthetic construct
  source 1..25: note = Seed: QTVHSIPLTINKEEALQRPVASDFE
QTVHSIPLTINKEFALMRLVATDFE

SEQ ID NO: 45598 - protein, 25 aa, synthetic construct
  source 1..25: note = Seed: QTVHSIPLTINKEEALQRPVASDFE
QTVHSIPLTINKEFALMRMVAADFE

SEQ ID NO: 45599 - protein, 25 aa, synthetic construct
  source 1..25: note = Seed: QTVHSIPLTINKEEALQRPVASDFE
QTVHSIPLTINKEFALMRMVADDFE

SEQ ID NO: 45600 - protein, 25 aa, synthetic construct
  source 1..25: note = Seed: QTVHSIPLTINKEEALQRPVASDFE
QTVHSIPLTINKEFALMRMVAEDFE

SEQ ID NO: 45601 - protein, 25 aa, synthetic construct
  source 1..25: note = Seed: QTVHSIPLTINKEEALQRPVASDFE
QTVHSIPLTINKEFALMRMVAGDFE

SEQ ID NO: 45602 - protein, 25 aa, synthetic construct
  source 1..25: note = Seed: QTVHSIPLTINKEEALQRPVASDFE
QTVHSIPLTINKEFALMRMVAHDFE

SEQ ID NO: 45603 - protein, 25 aa, synthetic construct
  source 1..25: note = Seed: QTVHSIPLTINKEEALQRPVASDFE
QTVHSIPLTINKEFALMRMVAKDFE

SEQ ID NO: 45604 - protein, 25 aa, synthetic construct
  source 1..25: note = Seed: QTVHSIPLTINKEEALQRPVASDFE
QTVHSIPLTINKEFALMRMVANDFE

SEQ ID NO: 45605 - protein, 25 aa, synthetic construct
  source 1..25: note = Seed: QTVHSIPLTINKEEALQRPVASDFE
QTVHSIPLTINKEFALMRMVAQDFE

SEQ ID NO: 45606 - protein, 25 aa, synthetic construct
  source 1..25: note = Seed: QTVHSIPLTINKEEALQRPVASDFE
QTVHSIPLTINKEFALMRMVASDFE

SEQ ID NO: 45607 - protein, 25 aa, synthetic construct
  source 1..25: note = Seed: QTVHSIPLTINKEEALQRPVASDFE
QTVHSIPLTINKEFALMRMVATDFE

SEQ ID NO: 45608 - protein, 25 aa, synthetic construct
  source 1..25: note = Seed: QTVHSIPLTINKEEALQRPVASDFE
QTVHSIPLTINKEFALMRNVAADFE

SEQ ID NO: 45609 - protein, 25 aa, synthetic construct
  source 1..25: note = Seed: QTVHSIPLTINKEEALQRPVASDFE
QTVHSIPLTINKEFALMRNVACDFE

SEQ ID NO: 45610 - protein, 25 aa, synthetic construct
  source 1..25: note = Seed: QTVHSIPLTINKEEALQRPVASDFE
QTVHSIPLTINKEFALMRNVADDFE

SEQ ID NO: 45611 - protein, 25 aa, synthetic construct
  source 1..25: note = Seed: QTVHSIPLTINKEEALQRPVASDFE
QTVHSIPLTINKEFALMRNVAEDFE

SEQ ID NO: 45612 - protein, 25 aa, synthetic construct
  source 1..25: note = Seed: QTVHSIPLTINKEEALQRPVASDFE
QTVHSIPLTINKEFALMRNVAFDFE

SEQ ID NO: 45613 - protein, 25 aa, synthetic construct
  source 1..25: note = Seed: QTVHSIPLTINKEEALQRPVASDFE
QTVHSIPLTINKEFALMRNVAGDFE

SEQ ID NO: 45614 - protein, 25 aa, synthetic construct
  source 1..25: note = Seed: QTVHSIPLTINKEEALQRPVASDFE
QTVHSIPLTINKEFALMRNVAHDFE

SEQ ID NO: 45615 - protein, 25 aa, synthetic construct
  source 1..25: note = Seed: QTVHSIPLTINKEEALQRPVASDFE
QTVHSIPLTINKEFALMRNVAIDFE

SEQ ID NO: 45616 - protein, 25 aa, synthetic construct
  source 1..25: note = Seed: QTVHSIPLTINKEEALQRPVASDFE
QTVHSIPLTINKEFALMRNVAKDFE

SEQ ID NO: 45617 - protein, 25 aa, synthetic construct
  source 1..25: note = Seed: QTVHSIPLTINKEEALQRPVASDFE
QTVHSIPLTINKEFALMRNVALDFE

SEQ ID NO: 45618 - protein, 25 aa, synthetic construct
  source 1..25: note = Seed: QTVHSIPLTINKEEALQRPVASDFE
QTVHSIPLTINKEFALMRNVAMDFE

SEQ ID NO: 45619 - protein, 25 aa, synthetic construct
  source 1..25: note = Seed: QTVHSIPLTINKEEALQRPVASDFE
QTVHSIPLTINKEFALMRNVANDFE

SEQ ID NO: 45620 - protein, 25 aa, synthetic construct
  source 1..25: note = Seed: QTVHSIPLTINKEEALQRPVASDFE
QTVHSIPLTINKEFALMRNVAPDFE

SEQ ID NO: 45621 - protein, 25 aa, synthetic construct
  source 1..25: note = Seed: QTVHSIPLTINKEEALQRPVASDFE
QTVHSIPLTINKEFALMRNVAQDFE

SEQ ID NO: 45622 - protein, 25 aa, synthetic construct
  source 1..25: note = Seed: QTVHSIPLTINKEEALQRPVASDFE
QTVHSIPLTINKEFALMRNVARDFE

SEQ ID NO: 45623 - protein, 25 aa, synthetic construct
  source 1..25: note = Seed: QTVHSIPLTINKEEALQRPVASDFE
QTVHSIPLTINKEFALMRNVASDFE

SEQ ID NO: 45624 - protein, 25 aa, synthetic construct
  source 1..25: note = Seed: QTVHSIPLTINKEEALQRPVASDFE
QTVHSIPLTINKEFALMRNVATDFE

SEQ ID NO: 45625 - protein, 25 aa, synthetic construct
  source 1..25: note = Seed: QTVHSIPLTINKEEALQRPVASDFE
QTVHSIPLTINKEFALMRNVAVDFE

SEQ ID NO: 45626 - protein, 25 aa, synthetic construct
  source 1..25: note = Seed: QTVHSIPLTINKEEALQRPVASDFE
QTVHSIPLTINKEFALMRNVAYDFE

SEQ ID NO: 45627 - protein, 25 aa, synthetic construct
  source 1..25: note = Seed: QTVHSIPLTINKEEALQRPVASDFE
QTVHSIPLTINKEFALMRPVAADFE

SEQ ID NO: 45628 - protein, 25 aa, synthetic construct
  source 1..25: note = Seed: QTVHSIPLTINKEEALQRPVASDFE
QTVHSIPLTINKEFALMRPVACDFE

SEQ ID NO: 45629 - protein, 25 aa, synthetic construct
  source 1..25: note = Seed: QTVHSIPLTINKEEALQRPVASDFE
QTVHSIPLTINKEFALMRPVADDFE

SEQ ID NO: 45630 - protein, 25 aa, synthetic construct
  source 1..25: note = Seed: QTVHSIPLTINKEEALQRPVASDFE
QTVHSIPLTINKEFALMRPVAEDFE

SEQ ID NO: 45631 - protein, 25 aa, synthetic construct
  source 1..25: note = Seed: QTVHSIPLTINKEEALQRPVASDFE
QTVHSIPLTINKEFALMRPVAFDFE

SEQ ID NO: 45632 - protein, 25 aa, synthetic construct
  source 1..25: note = Seed: QTVHSIPLTINKEEALQRPVASDFE
QTVHSIPLTINKEFALMRPVAGDFE

SEQ ID NO: 45633 - protein, 25 aa, synthetic construct
  source 1..25: note = Seed: QTVHSIPLTINKEEALQRPVASDFE
QTVHSIPLTINKEFALMRPVAHDFE

SEQ ID NO: 45634 - protein, 25 aa, synthetic construct
  source 1..25: note = Seed: QTVHSIPLTINKEEALQRPVASDFE
QTVHSIPLTINKEFALMRPVAIDFE

SEQ ID NO: 45635 - protein, 25 aa, synthetic construct
  source 1..25: note = Seed: QTVHSIPLTINKEEALQRPVASDFE
QTVHSIPLTINKEFALMRPVAKDFE

SEQ ID NO: 45636 - protein, 25 aa, synthetic construct
  source 1..25: note = Seed: QTVHSIPLTINKEEALQRPVASDFE
QTVHSIPLTINKEFALMRPVALDFE

SEQ ID NO: 45637 - protein, 25 aa, synthetic construct
  source 1..25: note = Seed: QTVHSIPLTINKEEALQRPVASDFE
QTVHSIPLTINKEFALMRPVAMDFE

SEQ ID NO: 45638 - protein, 25 aa, synthetic construct
  source 1..25: note = Seed: QTVHSIPLTINKEEALQRPVASDFE
QTVHSIPLTINKEFALMRPVAPDFE

SEQ ID NO: 45639 - protein, 25 aa, synthetic construct
  source 1..25: note = Seed: QTVHSIPLTINKEEALQRPVASDFE
QTVHSIPLTINKEFALMRPVAQDFE

SEQ ID NO: 45640 - protein, 25 aa, synthetic construct
  source 1..25: note = Seed: QTVHSIPLTINKEEALQRPVASDFE
QTVHSIPLTINKEFALMRPVARDFE

SEQ ID NO: 45641 - protein, 25 aa, synthetic construct
  source 1..25: note = Seed: QTVHSIPLTINKEEALQRPVASDFE
QTVHSIPLTINKEFALMRPVASDFE

SEQ ID NO: 45642 - protein, 25 aa, synthetic construct
  source 1..25: note = Seed: QTVHSIPLTINKEEALQRPVASDFE
QTVHSIPLTINKEFALMRPVATDFE

SEQ ID NO: 45643 - protein, 25 aa, synthetic construct
  source 1..25: note = Seed: QTVHSIPLTINKEEALQRPVASDFE
QTVHSIPLTINKEFALMRPVAVDFE

SEQ ID NO: 45644 - protein, 25 aa, synthetic construct
  source 1..25: note = Seed: QTVHSIPLTINKEEALQRPVASDFE
QTVHSIPLTINKEFALMRPVAWDFE

SEQ ID NO: 45645 - protein, 25 aa, synthetic construct
  source 1..25: note = Seed: QTVHSIPLTINKEEALQRPVASDFE
QTVHSIPLTINKEFALMRPVAYDFE

SEQ ID NO: 45646 - protein, 25 aa, synthetic construct
  source 1..25: note = Seed: QTVHSIPLTINKEEALQRPVASDFE
QTVHSIPLTINKEFALMRQVAADFE

SEQ ID NO: 45647 - protein, 25 aa, synthetic construct
  source 1..25: note = Seed: QTVHSIPLTINKEEALQRPVASDFE
QTVHSIPLTINKEFALMRQVAGDFE

SEQ ID NO: 45648 - protein, 25 aa, synthetic construct
  source 1..25: note = Seed: QTVHSIPLTINKEEALQRPVASDFE
QTVHSIPLTINKEFALMRQVAHDFE

SEQ ID NO: 45649 - protein, 25 aa, synthetic construct
  source 1..25: note = Seed: QTVHSIPLTINKEEALQRPVASDFE
QTVHSIPLTINKEFALMRQVAIDFE

SEQ ID NO: 45650 - protein, 25 aa, synthetic construct
  source 1..25: note = Seed: QTVHSIPLTINKEEALQRPVASDFE
QTVHSIPLTINKEFALMRQVAMDFE

SEQ ID NO: 45651 - protein, 25 aa, synthetic construct
  source 1..25: note = Seed: QTVHSIPLTINKEEALQRPVASDFE
QTVHSIPLTINKEFALMRQVANDFE

SEQ ID NO: 45652 - protein, 25 aa, synthetic construct
  source 1..25: note = Seed: QTVHSIPLTINKEEALQRPVASDFE
QTVHSIPLTINKEFALMRQVAQDFE

SEQ ID NO: 45653 - protein, 25 aa, synthetic construct
  source 1..25: note = Seed: QTVHSIPLTINKEEALQRPVASDFE
QTVHSIPLTINKEFALMRQVASDFE

SEQ ID NO: 45654 - protein, 25 aa, synthetic construct
  source 1..25: note = Seed: QTVHSIPLTINKEEALQRPVASDFE
QTVHSIPLTINKEFALMRQVATDFE

SEQ ID NO: 45655 - protein, 25 aa, synthetic construct
  source 1..25: note = Seed: QTVHSIPLTINKEEALQRPVASDFE
QTVHSIPLTINKEFALMRQVAVDFE

SEQ ID NO: 45656 - protein, 25 aa, synthetic construct
  source 1..25: note = Seed: QTVHSIPLTINKEEALQRPVASDFE
QTVHSIPLTINKEFALMRRVAADFE

SEQ ID NO: 45657 - protein, 25 aa, synthetic construct
  source 1..25: note = Seed: QTVHSIPLTINKEEALQRPVASDFE
QTVHSIPLTINKEFALMRRVANDFE

SEQ ID NO: 45658 - protein, 25 aa, synthetic construct
  source 1..25: note = Seed: QTVHSIPLTINKEEALQRPVASDFE
QTVHSIPLTINKEFALMRRVASDFE

SEQ ID NO: 45659 - protein, 25 aa, synthetic construct
  source 1..25: note = Seed: QTVHSIPLTINKEEALQRPVASDFE
QTVHSIPLTINKEFALMRSVAADFE

SEQ ID NO: 45660 - protein, 25 aa, synthetic construct
  source 1..25: note = Seed: QTVHSIPLTINKEEALQRPVASDFE
QTVHSIPLTINKEFALMRSVACDFE

SEQ ID NO: 45661 - protein, 25 aa, synthetic construct
  source 1..25: note = Seed: QTVHSIPLTINKEEALQRPVASDFE
QTVHSIPLTINKEFALMRSVADDFE

SEQ ID NO: 45662 - protein, 25 aa, synthetic construct
  source 1..25: note = Seed: QTVHSIPLTINKEEALQRPVASDFE
QTVHSIPLTINKEFALMRSVAEDFE

SEQ ID NO: 45663 - protein, 25 aa, synthetic construct
  source 1..25: note = Seed: QTVHSIPLTINKEEALQRPVASDFE
QTVHSIPLTINKEFALMRSVAFDFE

SEQ ID NO: 45664 - protein, 25 aa, synthetic construct
  source 1..25: note = Seed: QTVHSIPLTINKEEALQRPVASDFE
QTVHSIPLTINKEFALMRSVAGDFE

SEQ ID NO: 45665 - protein, 25 aa, synthetic construct
  source 1..25: note = Seed: QTVHSIPLTINKEEALQRPVASDFE
QTVHSIPLTINKEFALMRSVAHDFE

SEQ ID NO: 45666 - protein, 25 aa, synthetic construct
  source 1..25: note = Seed: QTVHSIPLTINKEEALQRPVASDFE
QTVHSIPLTINKEFALMRSVAIDFE

SEQ ID NO: 45667 - protein, 25 aa, synthetic construct
  source 1..25: note = Seed: QTVHSIPLTINKEEALQRPVASDFE
QTVHSIPLTINKEFALMRSVAKDFE

SEQ ID NO: 45668 - protein, 25 aa, synthetic construct
  source 1..25: note = Seed: QTVHSIPLTINKEEALQRPVASDFE
QTVHSIPLTINKEFALMRSVALDFE

SEQ ID NO: 45669 - protein, 25 aa, synthetic construct
  source 1..25: note = Seed: QTVHSIPLTINKEEALQRPVASDFE
QTVHSIPLTINKEFALMRSVAMDFE

SEQ ID NO: 45670 - protein, 25 aa, synthetic construct
  source 1..25: note = Seed: QTVHSIPLTINKEEALQRPVASDFE
QTVHSIPLTINKEFALMRSVANDFE

SEQ ID NO: 45671 - protein, 25 aa, synthetic construct
  source 1..25: note = Seed: QTVHSIPLTINKEEALQRPVASDFE
QTVHSIPLTINKEFALMRSVAPDFE

SEQ ID NO: 45672 - protein, 25 aa, synthetic construct
  source 1..25: note = Seed: QTVHSIPLTINKEEALQRPVASDFE
QTVHSIPLTINKEFALMRSVAQDFE

SEQ ID NO: 45673 - protein, 25 aa, synthetic construct
  source 1..25: note = Seed: QTVHSIPLTINKEEALQRPVASDFE
QTVHSIPLTINKEFALMRSVARDFE

SEQ ID NO: 45674 - protein, 25 aa, synthetic construct
  source 1..25: note = Seed: QTVHSIPLTINKEEALQRPVASDFE
QTVHSIPLTINKEFALMRSVASDFE

SEQ ID NO: 45675 - protein, 25 aa, synthetic construct
  source 1..25: note = Seed: QTVHSIPLTINKEEALQRPVASDFE
QTVHSIPLTINKEFALMRSVATDFE

SEQ ID NO: 45676 - protein, 25 aa, synthetic construct
  source 1..25: note = Seed: QTVHSIPLTINKEEALQRPVASDFE
QTVHSIPLTINKEFALMRSVAVDFE

SEQ ID NO: 45677 - protein, 25 aa, synthetic construct
  source 1..25: note = Seed: QTVHSIPLTINKEEALQRPVASDFE
QTVHSIPLTINKEFALMRSVAYDFE

SEQ ID NO: 45678 - protein, 25 aa, synthetic construct
  source 1..25: note = Seed: QTVHSIPLTINKEEALQRPVASDFE
QTVHSIPLTINKEFALMRTVAADFE

SEQ ID NO: 45679 - protein, 25 aa, synthetic construct
  source 1..25: note = Seed: QTVHSIPLTINKEEALQRPVASDFE
QTVHSIPLTINKEFALMRTVACDFE

SEQ ID NO: 45680 - protein, 25 aa, synthetic construct
  source 1..25: note = Seed: QTVHSIPLTINKEEALQRPVASDFE
QTVHSIPLTINKEFALMRTVADDFE

SEQ ID NO: 45681 - protein, 25 aa, synthetic construct
  source 1..25: note = Seed: QTVHSIPLTINKEEALQRPVASDFE
QTVHSIPLTINKEFALMRTVAEDFE

SEQ ID NO: 45682 - protein, 25 aa, synthetic construct
  source 1..25: note = Seed: QTVHSIPLTINKEEALQRPVASDFE
QTVHSIPLTINKEFALMRTVAFDFE

SEQ ID NO: 45683 - protein, 25 aa, synthetic construct
  source 1..25: note = Seed: QTVHSIPLTINKEEALQRPVASDFE
QTVHSIPLTINKEFALMRTVAGDFE

SEQ ID NO: 45684 - protein, 25 aa, synthetic construct
  source 1..25: note = Seed: QTVHSIPLTINKEEALQRPVASDFE
QTVHSIPLTINKEFALMRTVAHDFE

SEQ ID NO: 45685 - protein, 25 aa, synthetic construct
  source 1..25: note = Seed: QTVHSIPLTINKEEALQRPVASDFE
QTVHSIPLTINKEFALMRTVAIDFE

SEQ ID NO: 45686 - protein, 25 aa, synthetic construct
  source 1..25: note = Seed: QTVHSIPLTINKEEALQRPVASDFE
QTVHSIPLTINKEFALMRTVAKDFE

SEQ ID NO: 45687 - protein, 25 aa, synthetic construct
  source 1..25: note = Seed: QTVHSIPLTINKEEALQRPVASDFE
QTVHSIPLTINKEFALMRTVALDFE

SEQ ID NO: 45688 - protein, 25 aa, synthetic construct
  source 1..25: note = Seed: QTVHSIPLTINKEEALQRPVASDFE
QTVHSIPLTINKEFALMRTVAMDFE

SEQ ID NO: 45689 - protein, 25 aa, synthetic construct
  source 1..25: note = Seed: QTVHSIPLTINKEEALQRPVASDFE
QTVHSIPLTINKEFALMRTVANDFE

SEQ ID NO: 45690 - protein, 25 aa, synthetic construct
  source 1..25: note = Seed: QTVHSIPLTINKEEALQRPVASDFE
QTVHSIPLTINKEFALMRTVAPDFE

SEQ ID NO: 45691 - protein, 25 aa, synthetic construct
  source 1..25: note = Seed: QTVHSIPLTINKEEALQRPVASDFE
QTVHSIPLTINKEFALMRTVAQDFE

SEQ ID NO: 45692 - protein, 25 aa, synthetic construct
  source 1..25: note = Seed: QTVHSIPLTINKEEALQRPVASDFE
QTVHSIPLTINKEFALMRTVARDFE

SEQ ID NO: 45693 - protein, 25 aa, synthetic construct
  source 1..25: note = Seed: QTVHSIPLTINKEEALQRPVASDFE
QTVHSIPLTINKEFALMRTVASDFE

SEQ ID NO: 45694 - protein, 25 aa, synthetic construct
  source 1..25: note = Seed: QTVHSIPLTINKEEALQRPVASDFE
QTVHSIPLTINKEFALMRTVATDFE

SEQ ID NO: 45695 - protein, 25 aa, synthetic construct
  source 1..25: note = Seed: QTVHSIPLTINKEEALQRPVASDFE
QTVHSIPLTINKEFALMRTVAVDFE

SEQ ID NO: 45696 - protein, 25 aa, synthetic construct
  source 1..25: note = Seed: QTVHSIPLTINKEEALQRPVASDFE
QTVHSIPLTINKEFALMRTVAYDFE

SEQ ID NO: 45697 - protein, 25 aa, synthetic construct
  source 1..25: note = Seed: QTVHSIPLTINKEEALQRPVASDFE
QTVHSIPLTINKEFALMRVVAADFE

SEQ ID NO: 45698 - protein, 25 aa, synthetic construct
  source 1..25: note = Seed: QTVHSIPLTINKEEALQRPVASDFE
QTVHSIPLTINKEFALMRVVADDFE

SEQ ID NO: 45699 - protein, 25 aa, synthetic construct
  source 1..25: note = Seed: QTVHSIPLTINKEEALQRPVASDFE
QTVHSIPLTINKEFALMRVVAEDFE

SEQ ID NO: 45700 - protein, 25 aa, synthetic construct
  source 1..25: note = Seed: QTVHSIPLTINKEEALQRPVASDFE
QTVHSIPLTINKEFALMRVVAGDFE

SEQ ID NO: 45701 - protein, 25 aa, synthetic construct
  source 1..25: note = Seed: QTVHSIPLTINKEEALQRPVASDFE
QTVHSIPLTINKEFALMRVVAHDFE

SEQ ID NO: 45702 - protein, 25 aa, synthetic construct
  source 1..25: note = Seed: QTVHSIPLTINKEEALQRPVASDFE
QTVHSIPLTINKEFALMRVVAIDFE

SEQ ID NO: 45703 - protein, 25 aa, synthetic construct
  source 1..25: note = Seed: QTVHSIPLTINKEEALQRPVASDFE
QTVHSIPLTINKEFALMRVVAKDFE

SEQ ID NO: 45704 - protein, 25 aa, synthetic construct
  source 1..25: note = Seed: QTVHSIPLTINKEEALQRPVASDFE
QTVHSIPLTINKEFALMRVVALDFE

SEQ ID NO: 45705 - protein, 25 aa, synthetic construct
  source 1..25: note = Seed: QTVHSIPLTINKEEALQRPVASDFE
QTVHSIPLTINKEFALMRVVAMDFE

SEQ ID NO: 45706 - protein, 25 aa, synthetic construct
  source 1..25: note = Seed: QTVHSIPLTINKEEALQRPVASDFE
QTVHSIPLTINKEFALMRVVANDFE

SEQ ID NO: 45707 - protein, 25 aa, synthetic construct
  source 1..25: note = Seed: QTVHSIPLTINKEEALQRPVASDFE
QTVHSIPLTINKEFALMRVVAPDFE

SEQ ID NO: 45708 - protein, 25 aa, synthetic construct
  source 1..25: note = Seed: QTVHSIPLTINKEEALQRPVASDFE
QTVHSIPLTINKEFALMRVVAQDFE

SEQ ID NO: 45709 - protein, 25 aa, synthetic construct
  source 1..25: note = Seed: QTVHSIPLTINKEEALQRPVASDFE
QTVHSIPLTINKEFALMRVVARDFE

SEQ ID NO: 45710 - protein, 25 aa, synthetic construct
  source 1..25: note = Seed: QTVHSIPLTINKEEALQRPVASDFE
QTVHSIPLTINKEFALMRVVASDFE

SEQ ID NO: 45711 - protein, 25 aa, synthetic construct
  source 1..25: note = Seed: QTVHSIPLTINKEEALQRPVASDFE
QTVHSIPLTINKEFALMRVVATDFE

SEQ ID NO: 45712 - protein, 25 aa, synthetic construct
  source 1..25: note = Seed: QTVHSIPLTINKEEALQRPVASDFE
QTVHSIPLTINKEFALMRVVAVDFE

SEQ ID NO: 45713 - protein, 25 aa, synthetic construct
  source 1..25: note = Seed: QTVHSIPLTINKEEALQRPVASDFE
QTVHSIPLTINKEFALMRVVAYDFE

SEQ ID NO: 45714 - protein, 25 aa, synthetic construct
  source 1..25: note = Seed: QTVHSIPLTINKEEALQRPVASDFE
QTVHSIPLTINKEFALMRWVAHDFE

SEQ ID NO: 45715 - protein, 25 aa, synthetic construct
  source 1..25: note = Seed: QTVHSIPLTINKEEALQRPVASDFE
QTVHSIPLTINKEFALMRWVANDFE

SEQ ID NO: 45716 - protein, 25 aa, synthetic construct
  source 1..25: note = Seed: QTVHSIPLTINKEEALQRPVASDFE
QTVHSIPLTINKEFALMRYVAADFE

SEQ ID NO: 45717 - protein, 25 aa, synthetic construct
  source 1..25: note = Seed: QTVHSIPLTINKEEALQRPVASDFE
QTVHSIPLTINKEFALMRYVANDFE

SEQ ID NO: 45718 - protein, 25 aa, synthetic construct
  source 1..25: note = Seed: QTVHSIPLTINKEEALQRPVASDFE
QTVHSIPLTINKEFALMRYVASDFE

SEQ ID NO: 45719 - protein, 25 aa, synthetic construct
  source 1..25: note = Seed: QTVHSIPLTINKEEALQRPVASDFE
QTVHSIPLTINKEFALNRAVAADFE

SEQ ID NO: 45720 - protein, 25 aa, synthetic construct
  source 1..25: note = Seed: QTVHSIPLTINKEEALQRPVASDFE
QTVHSIPLTINKEFALNRAVAEDFE

SEQ ID NO: 45721 - protein, 25 aa, synthetic construct
  source 1..25: note = Seed: QTVHSIPLTINKEEALQRPVASDFE
QTVHSIPLTINKEFALNRAVAGDFE

SEQ ID NO: 45722 - protein, 25 aa, synthetic construct
  source 1..25: note = Seed: QTVHSIPLTINKEEALQRPVASDFE
QTVHSIPLTINKEFALNRAVAHDFE

SEQ ID NO: 45723 - protein, 25 aa, synthetic construct
  source 1..25: note = Seed: QTVHSIPLTINKEEALQRPVASDFE
QTVHSIPLTINKEFALNRAVAIDFE

SEQ ID NO: 45724 - protein, 25 aa, synthetic construct
  source 1..25: note = Seed: QTVHSIPLTINKEEALQRPVASDFE
QTVHSIPLTINKEFALNRAVALDFE

SEQ ID NO: 45725 - protein, 25 aa, synthetic construct
  source 1..25: note = Seed: QTVHSIPLTINKEEALQRPVASDFE
QTVHSIPLTINKEFALNRAVAMDFE

SEQ ID NO: 45726 - protein, 25 aa, synthetic construct
  source 1..25: note = Seed: QTVHSIPLTINKEEALQRPVASDFE
QTVHSIPLTINKEFALNRAVANDFE

SEQ ID NO: 45727 - protein, 25 aa, synthetic construct
  source 1..25: note = Seed: QTVHSIPLTINKEEALQRPVASDFE
QTVHSIPLTINKEFALNRAVAQDFE

SEQ ID NO: 45728 - protein, 25 aa, synthetic construct
  source 1..25: note = Seed: QTVHSIPLTINKEEALQRPVASDFE
QTVHSIPLTINKEFALNRAVASDFE

SEQ ID NO: 45729 - protein, 25 aa, synthetic construct
  source 1..25: note = Seed: QTVHSIPLTINKEEALQRPVASDFE
QTVHSIPLTINKEFALNRAVATDFE

SEQ ID NO: 45730 - protein, 25 aa, synthetic construct
  source 1..25: note = Seed: QTVHSIPLTINKEEALQRPVASDFE
QTVHSIPLTINKEFALNRAVAVDFE

SEQ ID NO: 45731 - protein, 25 aa, synthetic construct
  source 1..25: note = Seed: QTVHSIPLTINKEEALQRPVASDFE
QTVHSIPLTINKEFALNRGVAADFE

SEQ ID NO: 45732 - protein, 25 aa, synthetic construct
  source 1..25: note = Seed: QTVHSIPLTINKEEALQRPVASDFE
QTVHSIPLTINKEFALNRGVANDFE

SEQ ID NO: 45733 - protein, 25 aa, synthetic construct
  source 1..25: note = Seed: QTVHSIPLTINKEEALQRPVASDFE
QTVHSIPLTINKEFALNRGVASDFE

SEQ ID NO: 45734 - protein, 25 aa, synthetic construct
  source 1..25: note = Seed: QTVHSIPLTINKEEALQRPVASDFE
QTVHSIPLTINKEFALNRIVAADFE

SEQ ID NO: 45735 - protein, 25 aa, synthetic construct
  source 1..25: note = Seed: QTVHSIPLTINKEEALQRPVASDFE
QTVHSIPLTINKEFALNRIVANDFE

SEQ ID NO: 45736 - protein, 25 aa, synthetic construct
  source 1..25: note = Seed: QTVHSIPLTINKEEALQRPVASDFE
QTVHSIPLTINKEFALNRIVASDFE

SEQ ID NO: 45737 - protein, 25 aa, synthetic construct
  source 1..25: note = Seed: QTVHSIPLTINKEEALQRPVASDFE
QTVHSIPLTINKEFALNRIVAVDFE

SEQ ID NO: 45738 - protein, 25 aa, synthetic construct
  source 1..25: note = Seed: QTVHSIPLTINKEEALQRPVASDFE
QTVHSIPLTINKEFALNRNVAADFE

SEQ ID NO: 45739 - protein, 25 aa, synthetic construct
  source 1..25: note = Seed: QTVHSIPLTINKEEALQRPVASDFE
QTVHSIPLTINKEFALNRNVANDFE

SEQ ID NO: 45740 - protein, 25 aa, synthetic construct
  source 1..25: note = Seed: QTVHSIPLTINKEEALQRPVASDFE
QTVHSIPLTINKEFALNRNVASDFE

SEQ ID NO: 45741 - protein, 25 aa, synthetic construct
  source 1..25: note = Seed: QTVHSIPLTINKEEALQRPVASDFE
QTVHSIPLTINKEFALNRPVAADFE

SEQ ID NO: 45742 - protein, 25 aa, synthetic construct
  source 1..25: note = Seed: QTVHSIPLTINKEEALQRPVASDFE
QTVHSIPLTINKEFALNRPVAIDFE

SEQ ID NO: 45743 - protein, 25 aa, synthetic construct
  source 1..25: note = Seed: QTVHSIPLTINKEEALQRPVASDFE
QTVHSIPLTINKEFALNRPVALDFE

SEQ ID NO: 45744 - protein, 25 aa, synthetic construct
  source 1..25: note = Seed: QTVHSIPLTINKEEALQRPVASDFE
QTVHSIPLTINKEFALNRPVAMDFE

SEQ ID NO: 45745 - protein, 25 aa, synthetic construct
  source 1..25: note = Seed: QTVHSIPLTINKEEALQRPVASDFE
QTVHSIPLTINKEFALNRPVANDFE

SEQ ID NO: 45746 - protein, 25 aa, synthetic construct
  source 1..25: note = Seed: QTVHSIPLTINKEEALQRPVASDFE
QTVHSIPLTINKEFALNRPVASDFE

SEQ ID NO: 45747 - protein, 25 aa, synthetic construct
  source 1..25: note = Seed: QTVHSIPLTINKEEALQRPVASDFE
QTVHSIPLTINKEFALNRPVATDFE

SEQ ID NO: 45748 - protein, 25 aa, synthetic construct
  source 1..25: note = Seed: QTVHSIPLTINKEEALQRPVASDFE
QTVHSIPLTINKEFALNRPVAVDFE

SEQ ID NO: 45749 - protein, 25 aa, synthetic construct
  source 1..25: note = Seed: QTVHSIPLTINKEEALQRPVASDFE
QTVHSIPLTINKEFALNRSVAADFE

SEQ ID NO: 45750 - protein, 25 aa, synthetic construct
  source 1..25: note = Seed: QTVHSIPLTINKEEALQRPVASDFE
QTVHSIPLTINKEFALNRSVAIDFE

SEQ ID NO: 45751 - protein, 25 aa, synthetic construct
  source 1..25: note = Seed: QTVHSIPLTINKEEALQRPVASDFE
QTVHSIPLTINKEFALNRSVALDFE

SEQ ID NO: 45752 - protein, 25 aa, synthetic construct
  source 1..25: note = Seed: QTVHSIPLTINKEEALQRPVASDFE
QTVHSIPLTINKEFALNRSVAMDFE

SEQ ID NO: 45753 - protein, 25 aa, synthetic construct
  source 1..25: note = Seed: QTVHSIPLTINKEEALQRPVASDFE
QTVHSIPLTINKEFALNRSVANDFE

SEQ ID NO: 45754 - protein, 25 aa, synthetic construct
  source 1..25: note = Seed: QTVHSIPLTINKEEALQRPVASDFE
QTVHSIPLTINKEFALNRSVASDFE

SEQ ID NO: 45755 - protein, 25 aa, synthetic construct
  source 1..25: note = Seed: QTVHSIPLTINKEEALQRPVASDFE
QTVHSIPLTINKEFALNRSVATDFE

SEQ ID NO: 45756 - protein, 25 aa, synthetic construct
  source 1..25: note = Seed: QTVHSIPLTINKEEALQRPVASDFE
QTVHSIPLTINKEFALNRSVAVDFE

SEQ ID NO: 45757 - protein, 25 aa, synthetic construct
  source 1..25: note = Seed: QTVHSIPLTINKEEALQRPVASDFE
QTVHSIPLTINKEFALNRTVAADFE

SEQ ID NO: 45758 - protein, 25 aa, synthetic construct
  source 1..25: note = Seed: QTVHSIPLTINKEEALQRPVASDFE
QTVHSIPLTINKEFALNRTVAIDFE

SEQ ID NO: 45759 - protein, 25 aa, synthetic construct
  source 1..25: note = Seed: QTVHSIPLTINKEEALQRPVASDFE
QTVHSIPLTINKEFALNRTVALDFE

SEQ ID NO: 45760 - protein, 25 aa, synthetic construct
  source 1..25: note = Seed: QTVHSIPLTINKEEALQRPVASDFE
QTVHSIPLTINKEFALNRTVAMDFE

SEQ ID NO: 45761 - protein, 25 aa, synthetic construct
  source 1..25: note = Seed: QTVHSIPLTINKEEALQRPVASDFE
QTVHSIPLTINKEFALNRTVANDFE

SEQ ID NO: 45762 - protein, 25 aa, synthetic construct
  source 1..25: note = Seed: QTVHSIPLTINKEEALQRPVASDFE
QTVHSIPLTINKEFALNRTVASDFE

SEQ ID NO: 45763 - protein, 25 aa, synthetic construct
  source 1..25: note = Seed: QTVHSIPLTINKEEALQRPVASDFE
QTVHSIPLTINKEFALNRTVATDFE

SEQ ID NO: 45764 - protein, 25 aa, synthetic construct
  source 1..25: note = Seed: QTVHSIPLTINKEEALQRPVASDFE
QTVHSIPLTINKEFALNRTVAVDFE

SEQ ID NO: 45765 - protein, 25 aa, synthetic construct
  source 1..25: note = Seed: QTVHSIPLTINKEEALQRPVASDFE
QTVHSIPLTINKEFALNRVVAADFE

SEQ ID NO: 45766 - protein, 25 aa, synthetic construct
  source 1..25: note = Seed: QTVHSIPLTINKEEALQRPVASDFE
QTVHSIPLTINKEFALNRVVAHDFE

SEQ ID NO: 45767 - protein, 25 aa, synthetic construct
  source 1..25: note = Seed: QTVHSIPLTINKEEALQRPVASDFE
QTVHSIPLTINKEFALNRVVAIDFE

SEQ ID NO: 45768 - protein, 25 aa, synthetic construct
  source 1..25: note = Seed: QTVHSIPLTINKEEALQRPVASDFE
QTVHSIPLTINKEFALNRVVALDFE

SEQ ID NO: 45769 - protein, 25 aa, synthetic construct
  source 1..25: note = Seed: QTVHSIPLTINKEEALQRPVASDFE
QTVHSIPLTINKEFALNRVVAMDFE

SEQ ID NO: 45770 - protein, 25 aa, synthetic construct
  source 1..25: note = Seed: QTVHSIPLTINKEEALQRPVASDFE
QTVHSIPLTINKEFALNRVVANDFE

SEQ ID NO: 45771 - protein, 25 aa, synthetic construct
  source 1..25: note = Seed: QTVHSIPLTINKEEALQRPVASDFE
QTVHSIPLTINKEFALNRVVASDFE

SEQ ID NO: 45772 - protein, 25 aa, synthetic construct
  source 1..25: note = Seed: QTVHSIPLTINKEEALQRPVASDFE
QTVHSIPLTINKEFALNRVVATDFE

SEQ ID NO: 45773 - protein, 25 aa, synthetic construct
  source 1..25: note = Seed: QTVHSIPLTINKEEALQRPVASDFE
QTVHSIPLTINKEFALNRVVAVDFE

SEQ ID NO: 45774 - protein, 25 aa, synthetic construct
  source 1..25: note = Seed: QTVHSIPLTINKEEALQRPVASDFE
QTVHSIPLTINKEFALQRAVAADFE

SEQ ID NO: 45775 - protein, 25 aa, synthetic construct
  source 1..25: note = Seed: QTVHSIPLTINKEEALQRPVASDFE
QTVHSIPLTINKEFALQRAVACDFE

SEQ ID NO: 45776 - protein, 25 aa, synthetic construct
  source 1..25: note = Seed: QTVHSIPLTINKEEALQRPVASDFE
QTVHSIPLTINKEFALQRAVADDFE

SEQ ID NO: 45777 - protein, 25 aa, synthetic construct
  source 1..25: note = Seed: QTVHSIPLTINKEEALQRPVASDFE
QTVHSIPLTINKEFALQRAVAEDFE

SEQ ID NO: 45778 - protein, 25 aa, synthetic construct
  source 1..25: note = Seed: QTVHSIPLTINKEEALQRPVASDFE
QTVHSIPLTINKEFALQRAVAFDFE

SEQ ID NO: 45779 - protein, 25 aa, synthetic construct
  source 1..25: note = Seed: QTVHSIPLTINKEEALQRPVASDFE
QTVHSIPLTINKEFALQRAVAGDFE

SEQ ID NO: 45780 - protein, 25 aa, synthetic construct
  source 1..25: note = Seed: QTVHSIPLTINKEEALQRPVASDFE
QTVHSIPLTINKEFALQRAVAHDFE

SEQ ID NO: 45781 - protein, 25 aa, synthetic construct
  source 1..25: note = Seed: QTVHSIPLTINKEEALQRPVASDFE
QTVHSIPLTINKEFALQRAVAIDFE

SEQ ID NO: 45782 - protein, 25 aa, synthetic construct
  source 1..25: note = Seed: QTVHSIPLTINKEEALQRPVASDFE
QTVHSIPLTINKEFALQRAVAKDFE

SEQ ID NO: 45783 - protein, 25 aa, synthetic construct
  source 1..25: note = Seed: QTVHSIPLTINKEEALQRPVASDFE
QTVHSIPLTINKEFALQRAVALDFE

SEQ ID NO: 45784 - protein, 25 aa, synthetic construct
  source 1..25: note = Seed: QTVHSIPLTINKEEALQRPVASDFE
QTVHSIPLTINKEFALQRAVAMDFE

SEQ ID NO: 45785 - protein, 25 aa, synthetic construct
  source 1..25: note = Seed: QTVHSIPLTINKEEALQRPVASDFE
QTVHSIPLTINKEFALQRAVANDFE

SEQ ID NO: 45786 - protein, 25 aa, synthetic construct
  source 1..25: note = Seed: QTVHSIPLTINKEEALQRPVASDFE
QTVHSIPLTINKEFALQRAVAPDFE

SEQ ID NO: 45787 - protein, 25 aa, synthetic construct
  source 1..25: note = Seed: QTVHSIPLTINKEEALQRPVASDFE
QTVHSIPLTINKEFALQRAVAQDFE

SEQ ID NO: 45788 - protein, 25 aa, synthetic construct
  source 1..25: note = Seed: QTVHSIPLTINKEEALQRPVASDFE
QTVHSIPLTINKEFALQRAVASDFE

SEQ ID NO: 45789 - protein, 25 aa, synthetic construct
  source 1..25: note = Seed: QTVHSIPLTINKEEALQRPVASDFE
QTVHSIPLTINKEFALQRAVATDFE

SEQ ID NO: 45790 - protein, 25 aa, synthetic construct
  source 1..25: note = Seed: QTVHSIPLTINKEEALQRPVASDFE
QTVHSIPLTINKEFALQRAVAVDFE

SEQ ID NO: 45791 - protein, 25 aa, synthetic construct
  source 1..25: note = Seed: QTVHSIPLTINKEEALQRPVASDFE
QTVHSIPLTINKEFALQRAVAYDFE

SEQ ID NO: 45792 - protein, 25 aa, synthetic construct
  source 1..25: note = Seed: QTVHSIPLTINKEEALQRPVASDFE
QTVHSIPLTINKEFALQRCVAADFE

SEQ ID NO: 45793 - protein, 25 aa, synthetic construct
  source 1..25: note = Seed: QTVHSIPLTINKEEALQRPVASDFE
QTVHSIPLTINKEFALQRCVANDFE

SEQ ID NO: 45794 - protein, 25 aa, synthetic construct
  source 1..25: note = Seed: QTVHSIPLTINKEEALQRPVASDFE
QTVHSIPLTINKEFALQREVAADFE

SEQ ID NO: 45795 - protein, 25 aa, synthetic construct
  source 1..25: note = Seed: QTVHSIPLTINKEEALQRPVASDFE
QTVHSIPLTINKEFALQRGVAADFE

SEQ ID NO: 45796 - protein, 25 aa, synthetic construct
  source 1..25: note = Seed: QTVHSIPLTINKEEALQRPVASDFE
QTVHSIPLTINKEFALQRGVADDFE

SEQ ID NO: 45797 - protein, 25 aa, synthetic construct
  source 1..25: note = Seed: QTVHSIPLTINKEEALQRPVASDFE
QTVHSIPLTINKEFALQRGVAGDFE

SEQ ID NO: 45798 - protein, 25 aa, synthetic construct
  source 1..25: note = Seed: QTVHSIPLTINKEEALQRPVASDFE
QTVHSIPLTINKEFALQRGVAHDFE

SEQ ID NO: 45799 - protein, 25 aa, synthetic construct
  source 1..25: note = Seed: QTVHSIPLTINKEEALQRPVASDFE
QTVHSIPLTINKEFALQRGVAIDFE

SEQ ID NO: 45800 - protein, 25 aa, synthetic construct
  source 1..25: note = Seed: QTVHSIPLTINKEEALQRPVASDFE
QTVHSIPLTINKEFALQRGVALDFE

SEQ ID NO: 45801 - protein, 25 aa, synthetic construct
  source 1..25: note = Seed: QTVHSIPLTINKEEALQRPVASDFE
QTVHSIPLTINKEFALQRGVAMDFE

SEQ ID NO: 45802 - protein, 25 aa, synthetic construct
  source 1..25: note = Seed: QTVHSIPLTINKEEALQRPVASDFE
QTVHSIPLTINKEFALQRGVANDFE

SEQ ID NO: 45803 - protein, 25 aa, synthetic construct
  source 1..25: note = Seed: QTVHSIPLTINKEEALQRPVASDFE
QTVHSIPLTINKEFALQRGVAPDFE

SEQ ID NO: 45804 - protein, 25 aa, synthetic construct
  source 1..25: note = Seed: QTVHSIPLTINKEEALQRPVASDFE
QTVHSIPLTINKEFALQRGVAQDFE

SEQ ID NO: 45805 - protein, 25 aa, synthetic construct
  source 1..25: note = Seed: QTVHSIPLTINKEEALQRPVASDFE
QTVHSIPLTINKEFALQRGVASDFE

SEQ ID NO: 45806 - protein, 25 aa, synthetic construct
  source 1..25: note = Seed: QTVHSIPLTINKEEALQRPVASDFE
QTVHSIPLTINKEFALQRGVATDFE

SEQ ID NO: 45807 - protein, 25 aa, synthetic construct
  source 1..25: note = Seed: QTVHSIPLTINKEEALQRPVASDFE
QTVHSIPLTINKEFALQRGVAVDFE

SEQ ID NO: 45808 - protein, 25 aa, synthetic construct
  source 1..25: note = Seed: QTVHSIPLTINKEEALQRPVASDFE
QTVHSIPLTINKEFALQRIVAADFE

SEQ ID NO: 45809 - protein, 25 aa, synthetic construct
  source 1..25: note = Seed: QTVHSIPLTINKEEALQRPVASDFE
QTVHSIPLTINKEFALQRIVADDFE

SEQ ID NO: 45810 - protein, 25 aa, synthetic construct
  source 1..25: note = Seed: QTVHSIPLTINKEEALQRPVASDFE
QTVHSIPLTINKEFALQRIVAGDFE

SEQ ID NO: 45811 - protein, 25 aa, synthetic construct
  source 1..25: note = Seed: QTVHSIPLTINKEEALQRPVASDFE
QTVHSIPLTINKEFALQRIVAHDFE

SEQ ID NO: 45812 - protein, 25 aa, synthetic construct
  source 1..25: note = Seed: QTVHSIPLTINKEEALQRPVASDFE
QTVHSIPLTINKEFALQRIVAIDFE

SEQ ID NO: 45813 - protein, 25 aa, synthetic construct
  source 1..25: note = Seed: QTVHSIPLTINKEEALQRPVASDFE
QTVHSIPLTINKEFALQRIVALDFE

SEQ ID NO: 45814 - protein, 25 aa, synthetic construct
  source 1..25: note = Seed: QTVHSIPLTINKEEALQRPVASDFE
QTVHSIPLTINKEFALQRIVAMDFE

SEQ ID NO: 45815 - protein, 25 aa, synthetic construct
  source 1..25: note = Seed: QTVHSIPLTINKEEALQRPVASDFE
QTVHSIPLTINKEFALQRIVANDFE

SEQ ID NO: 45816 - protein, 25 aa, synthetic construct
  source 1..25: note = Seed: QTVHSIPLTINKEEALQRPVASDFE
QTVHSIPLTINKEFALQRIVAQDFE

SEQ ID NO: 45817 - protein, 25 aa, synthetic construct
  source 1..25: note = Seed: QTVHSIPLTINKEEALQRPVASDFE
QTVHSIPLTINKEFALQRIVASDFE

SEQ ID NO: 45818 - protein, 25 aa, synthetic construct
  source 1..25: note = Seed: QTVHSIPLTINKEEALQRPVASDFE
QTVHSIPLTINKEFALQRIVATDFE

SEQ ID NO: 45819 - protein, 25 aa, synthetic construct
  source 1..25: note = Seed: QTVHSIPLTINKEEALQRPVASDFE
QTVHSIPLTINKEFALQRIVAVDFE

SEQ ID NO: 45820 - protein, 25 aa, synthetic construct
  source 1..25: note = Seed: QTVHSIPLTINKEEALQRPVASDFE
QTVHSIPLTINKEFALQRLVAADFE

SEQ ID NO: 45821 - protein, 25 aa, synthetic construct
  source 1..25: note = Seed: QTVHSIPLTINKEEALQRPVASDFE
QTVHSIPLTINKEFALQRLVANDFE

SEQ ID NO: 45822 - protein, 25 aa, synthetic construct
  source 1..25: note = Seed: QTVHSIPLTINKEEALQRPVASDFE
QTVHSIPLTINKEFALQRLVASDFE

SEQ ID NO: 45823 - protein, 25 aa, synthetic construct
  source 1..25: note = Seed: QTVHSIPLTINKEEALQRPVASDFE
QTVHSIPLTINKEFALQRLVATDFE

SEQ ID NO: 45824 - protein, 25 aa, synthetic construct
  source 1..25: note = Seed: QTVHSIPLTINKEEALQRPVASDFE
QTVHSIPLTINKEFALQRMVAADFE

SEQ ID NO: 45825 - protein, 25 aa, synthetic construct
  source 1..25: note = Seed: QTVHSIPLTINKEEALQRPVASDFE
QTVHSIPLTINKEFALQRMVANDFE

SEQ ID NO: 45826 - protein, 25 aa, synthetic construct
  source 1..25: note = Seed: QTVHSIPLTINKEEALQRPVASDFE
QTVHSIPLTINKEFALQRMVASDFE

SEQ ID NO: 45827 - protein, 25 aa, synthetic construct
  source 1..25: note = Seed: QTVHSIPLTINKEEALQRPVASDFE
QTVHSIPLTINKEFALQRMVATDFE

SEQ ID NO: 45828 - protein, 25 aa, synthetic construct
  source 1..25: note = Seed: QTVHSIPLTINKEEALQRPVASDFE
QTVHSIPLTINKEFALQRNVAADFE

SEQ ID NO: 45829 - protein, 25 aa, synthetic construct
  source 1..25: note = Seed: QTVHSIPLTINKEEALQRPVASDFE
QTVHSIPLTINKEFALQRNVAGDFE

SEQ ID NO: 45830 - protein, 25 aa, synthetic construct
  source 1..25: note = Seed: QTVHSIPLTINKEEALQRPVASDFE
QTVHSIPLTINKEFALQRNVAHDFE

SEQ ID NO: 45831 - protein, 25 aa, synthetic construct
  source 1..25: note = Seed: QTVHSIPLTINKEEALQRPVASDFE
QTVHSIPLTINKEFALQRNVAIDFE

SEQ ID NO: 45832 - protein, 25 aa, synthetic construct
  source 1..25: note = Seed: QTVHSIPLTINKEEALQRPVASDFE
QTVHSIPLTINKEFALQRNVALDFE

SEQ ID NO: 45833 - protein, 25 aa, synthetic construct
  source 1..25: note = Seed: QTVHSIPLTINKEEALQRPVASDFE
QTVHSIPLTINKEFALQRNVAMDFE

SEQ ID NO: 45834 - protein, 25 aa, synthetic construct
  source 1..25: note = Seed: QTVHSIPLTINKEEALQRPVASDFE
QTVHSIPLTINKEFALQRNVANDFE

SEQ ID NO: 45835 - protein, 25 aa, synthetic construct
  source 1..25: note = Seed: QTVHSIPLTINKEEALQRPVASDFE
QTVHSIPLTINKEFALQRNVAPDFE

SEQ ID NO: 45836 - protein, 25 aa, synthetic construct
  source 1..25: note = Seed: QTVHSIPLTINKEEALQRPVASDFE
QTVHSIPLTINKEFALQRNVAQDFE

SEQ ID NO: 45837 - protein, 25 aa, synthetic construct
  source 1..25: note = Seed: QTVHSIPLTINKEEALQRPVASDFE
QTVHSIPLTINKEFALQRNVASDFE

SEQ ID NO: 45838 - protein, 25 aa, synthetic construct
  source 1..25: note = Seed: QTVHSIPLTINKEEALQRPVASDFE
QTVHSIPLTINKEFALQRNVATDFE

SEQ ID NO: 45839 - protein, 25 aa, synthetic construct
  source 1..25: note = Seed: QTVHSIPLTINKEEALQRPVASDFE
QTVHSIPLTINKEFALQRNVAVDFE

SEQ ID NO: 45840 - protein, 25 aa, synthetic construct
  source 1..25: note = Seed: QTVHSIPLTINKEEALQRPVASDFE
QTVHSIPLTINKEFALQRPVAADFE

SEQ ID NO: 45841 - protein, 25 aa, synthetic construct
  source 1..25: note = Seed: QTVHSIPLTINKEEALQRPVASDFE
QTVHSIPLTINKEFALQRPVACDFE

SEQ ID NO: 45842 - protein, 25 aa, synthetic construct
  source 1..25: note = Seed: QTVHSIPLTINKEEALQRPVASDFE
QTVHSIPLTINKEFALQRPVADDFE

SEQ ID NO: 45843 - protein, 25 aa, synthetic construct
  source 1..25: note = Seed: QTVHSIPLTINKEEALQRPVASDFE
QTVHSIPLTINKEFALQRPVAEDFE

SEQ ID NO: 45844 - protein, 25 aa, synthetic construct
  source 1..25: note = Seed: QTVHSIPLTINKEEALQRPVASDFE
QTVHSIPLTINKEFALQRPVAFDFE

SEQ ID NO: 45845 - protein, 25 aa, synthetic construct
  source 1..25: note = Seed: QTVHSIPLTINKEEALQRPVASDFE
QTVHSIPLTINKEFALQRPVAGDFE

SEQ ID NO: 45846 - protein, 25 aa, synthetic construct
  source 1..25: note = Seed: QTVHSIPLTINKEEALQRPVASDFE
QTVHSIPLTINKEFALQRPVAHDFE

SEQ ID NO: 45847 - protein, 25 aa, synthetic construct
  source 1..25: note = Seed: QTVHSIPLTINKEEALQRPVASDFE
QTVHSIPLTINKEFALQRPVAIDFE

SEQ ID NO: 45848 - protein, 25 aa, synthetic construct
  source 1..25: note = Seed: QTVHSIPLTINKEEALQRPVASDFE
QTVHSIPLTINKEFALQRPVALDFE

SEQ ID NO: 45849 - protein, 25 aa, synthetic construct
  source 1..25: note = Seed: QTVHSIPLTINKEEALQRPVASDFE
QTVHSIPLTINKEFALQRPVAMDFE

SEQ ID NO: 45850 - protein, 25 aa, synthetic construct
  source 1..25: note = Seed: QTVHSIPLTINKEEALQRPVASDFE
QTVHSIPLTINKEFALQRPVANDFE

SEQ ID NO: 45851 - protein, 25 aa, synthetic construct
  source 1..25: note = Seed: QTVHSIPLTINKEEALQRPVASDFE
QTVHSIPLTINKEFALQRPVAPDFE

SEQ ID NO: 45852 - protein, 25 aa, synthetic construct
  source 1..25: note = Seed: QTVHSIPLTINKEEALQRPVASDFE
QTVHSIPLTINKEFALQRPVAQDFE

SEQ ID NO: 45853 - protein, 25 aa, synthetic construct
  source 1..25: note = Seed: QTVHSIPLTINKEEALQRPVASDFE
QTVHSIPLTINKEFALQRPVASDFE

SEQ ID NO: 45854 - protein, 25 aa, synthetic construct
  source 1..25: note = Seed: QTVHSIPLTINKEEALQRPVASDFE
QTVHSIPLTINKEFALQRPVATDFE

SEQ ID NO: 45855 - protein, 25 aa, synthetic construct
  source 1..25: note = Seed: QTVHSIPLTINKEEALQRPVASDFE
QTVHSIPLTINKEFALQRPVAVDFE

SEQ ID NO: 45856 - protein, 25 aa, synthetic construct
  source 1..25: note = Seed: QTVHSIPLTINKEEALQRPVASDFE
QTVHSIPLTINKEFALQRPVAWDFE

SEQ ID NO: 45857 - protein, 25 aa, synthetic construct
  source 1..25: note = Seed: QTVHSIPLTINKEEALQRPVASDFE
QTVHSIPLTINKEFALQRPVAYDFE

SEQ ID NO: 45858 - protein, 25 aa, synthetic construct
  source 1..25: note = Seed: QTVHSIPLTINKEEALQRPVASDFE
QTVHSIPLTINKEFALQRSVAADFE

SEQ ID NO: 45859 - protein, 25 aa, synthetic construct
  source 1..25: note = Seed: QTVHSIPLTINKEEALQRPVASDFE
QTVHSIPLTINKEFALQRSVACDFE

SEQ ID NO: 45860 - protein, 25 aa, synthetic construct
  source 1..25: note = Seed: QTVHSIPLTINKEEALQRPVASDFE
QTVHSIPLTINKEFALQRSVADDFE

SEQ ID NO: 45861 - protein, 25 aa, synthetic construct
  source 1..25: note = Seed: QTVHSIPLTINKEEALQRPVASDFE
QTVHSIPLTINKEFALQRSVAEDFE

SEQ ID NO: 45862 - protein, 25 aa, synthetic construct
  source 1..25: note = Seed: QTVHSIPLTINKEEALQRPVASDFE
QTVHSIPLTINKEFALQRSVAFDFE

SEQ ID NO: 45863 - protein, 25 aa, synthetic construct
  source 1..25: note = Seed: QTVHSIPLTINKEEALQRPVASDFE
QTVHSIPLTINKEFALQRSVAGDFE

SEQ ID NO: 45864 - protein, 25 aa, synthetic construct
  source 1..25: note = Seed: QTVHSIPLTINKEEALQRPVASDFE
QTVHSIPLTINKEFALQRSVAHDFE

SEQ ID NO: 45865 - protein, 25 aa, synthetic construct
  source 1..25: note = Seed: QTVHSIPLTINKEEALQRPVASDFE
QTVHSIPLTINKEFALQRSVAIDFE

SEQ ID NO: 45866 - protein, 25 aa, synthetic construct
  source 1..25: note = Seed: QTVHSIPLTINKEEALQRPVASDFE
QTVHSIPLTINKEFALQRSVALDFE

SEQ ID NO: 45867 - protein, 25 aa, synthetic construct
  source 1..25: note = Seed: QTVHSIPLTINKEEALQRPVASDFE
QTVHSIPLTINKEFALQRSVAMDFE

SEQ ID NO: 45868 - protein, 25 aa, synthetic construct
  source 1..25: note = Seed: QTVHSIPLTINKEEALQRPVASDFE
QTVHSIPLTINKEFALQRSVANDFE

SEQ ID NO: 45869 - protein, 25 aa, synthetic construct
  source 1..25: note = Seed: QTVHSIPLTINKEEALQRPVASDFE
QTVHSIPLTINKEFALQRSVAPDFE

SEQ ID NO: 45870 - protein, 25 aa, synthetic construct
  source 1..25: note = Seed: QTVHSIPLTINKEEALQRPVASDFE
QTVHSIPLTINKEFALQRSVAQDFE

SEQ ID NO: 45871 - protein, 25 aa, synthetic construct
  source 1..25: note = Seed: QTVHSIPLTINKEEALQRPVASDFE
QTVHSIPLTINKEFALQRSVASDFE

SEQ ID NO: 45872 - protein, 25 aa, synthetic construct
  source 1..25: note = Seed: QTVHSIPLTINKEEALQRPVASDFE
QTVHSIPLTINKEFALQRSVATDFE

SEQ ID NO: 45873 - protein, 25 aa, synthetic construct
  source 1..25: note = Seed: QTVHSIPLTINKEEALQRPVASDFE
QTVHSIPLTINKEFALQRSVAVDFE

SEQ ID NO: 45874 - protein, 25 aa, synthetic construct
  source 1..25: note = Seed: QTVHSIPLTINKEEALQRPVASDFE
QTVHSIPLTINKEFALQRSVAYDFE

SEQ ID NO: 45875 - protein, 25 aa, synthetic construct
  source 1..25: note = Seed: QTVHSIPLTINKEEALQRPVASDFE
QTVHSIPLTINKEFALQRTVAADFE

SEQ ID NO: 45876 - protein, 25 aa, synthetic construct
  source 1..25: note = Seed: QTVHSIPLTINKEEALQRPVASDFE
QTVHSIPLTINKEFALQRTVACDFE

SEQ ID NO: 45877 - protein, 25 aa, synthetic construct
  source 1..25: note = Seed: QTVHSIPLTINKEEALQRPVASDFE
QTVHSIPLTINKEFALQRTVADDFE

SEQ ID NO: 45878 - protein, 25 aa, synthetic construct
  source 1..25: note = Seed: QTVHSIPLTINKEEALQRPVASDFE
QTVHSIPLTINKEFALQRTVAEDFE

SEQ ID NO: 45879 - protein, 25 aa, synthetic construct
  source 1..25: note = Seed: QTVHSIPLTINKEEALQRPVASDFE
QTVHSIPLTINKEFALQRTVAFDFE

SEQ ID NO: 45880 - protein, 25 aa, synthetic construct
  source 1..25: note = Seed: QTVHSIPLTINKEEALQRPVASDFE
QTVHSIPLTINKEFALQRTVAGDFE

SEQ ID NO: 45881 - protein, 25 aa, synthetic construct
  source 1..25: note = Seed: QTVHSIPLTINKEEALQRPVASDFE
QTVHSIPLTINKEFALQRTVAHDFE

SEQ ID NO: 45882 - protein, 25 aa, synthetic construct
  source 1..25: note = Seed: QTVHSIPLTINKEEALQRPVASDFE
QTVHSIPLTINKEFALQRTVAIDFE

SEQ ID NO: 45883 - protein, 25 aa, synthetic construct
  source 1..25: note = Seed: QTVHSIPLTINKEEALQRPVASDFE
QTVHSIPLTINKEFALQRTVALDFE

SEQ ID NO: 45884 - protein, 25 aa, synthetic construct
  source 1..25: note = Seed: QTVHSIPLTINKEEALQRPVASDFE
QTVHSIPLTINKEFALQRTVAMDFE

SEQ ID NO: 45885 - protein, 25 aa, synthetic construct
  source 1..25: note = Seed: QTVHSIPLTINKEEALQRPVASDFE
QTVHSIPLTINKEFALQRTVANDFE

SEQ ID NO: 45886 - protein, 25 aa, synthetic construct
  source 1..25: note = Seed: QTVHSIPLTINKEEALQRPVASDFE
QTVHSIPLTINKEFALQRTVAPDFE

SEQ ID NO: 45887 - protein, 25 aa, synthetic construct
  source 1..25: note = Seed: QTVHSIPLTINKEEALQRPVASDFE
QTVHSIPLTINKEFALQRTVAQDFE

SEQ ID NO: 45888 - protein, 25 aa, synthetic construct
  source 1..25: note = Seed: QTVHSIPLTINKEEALQRPVASDFE
QTVHSIPLTINKEFALQRTVASDFE

SEQ ID NO: 45889 - protein, 25 aa, synthetic construct
  source 1..25: note = Seed: QTVHSIPLTINKEEALQRPVASDFE
QTVHSIPLTINKEFALQRTVATDFE

SEQ ID NO: 45890 - protein, 25 aa, synthetic construct
  source 1..25: note = Seed: QTVHSIPLTINKEEALQRPVASDFE
QTVHSIPLTINKEFALQRTVAVDFE

SEQ ID NO: 45891 - protein, 25 aa, synthetic construct
  source 1..25: note = Seed: QTVHSIPLTINKEEALQRPVASDFE
QTVHSIPLTINKEFALQRTVAYDFE

SEQ ID NO: 45892 - protein, 25 aa, synthetic construct
  source 1..25: note = Seed: QTVHSIPLTINKEEALQRPVASDFE
QTVHSIPLTINKEFALQRVVAADFE

SEQ ID NO: 45893 - protein, 25 aa, synthetic construct
  source 1..25: note = Seed: QTVHSIPLTINKEEALQRPVASDFE
QTVHSIPLTINKEFALQRVVADDFE

SEQ ID NO: 45894 - protein, 25 aa, synthetic construct
  source 1..25: note = Seed: QTVHSIPLTINKEEALQRPVASDFE
QTVHSIPLTINKEFALQRVVAEDFE

SEQ ID NO: 45895 - protein, 25 aa, synthetic construct
  source 1..25: note = Seed: QTVHSIPLTINKEEALQRPVASDFE
QTVHSIPLTINKEFALQRVVAGDFE

SEQ ID NO: 45896 - protein, 25 aa, synthetic construct
  source 1..25: note = Seed: QTVHSIPLTINKEEALQRPVASDFE
QTVHSIPLTINKEFALQRVVAHDFE

SEQ ID NO: 45897 - protein, 25 aa, synthetic construct
  source 1..25: note = Seed: QTVHSIPLTINKEEALQRPVASDFE
QTVHSIPLTINKEFALQRVVAIDFE

SEQ ID NO: 45898 - protein, 25 aa, synthetic construct
  source 1..25: note = Seed: QTVHSIPLTINKEEALQRPVASDFE
QTVHSIPLTINKEFALQRVVALDFE

SEQ ID NO: 45899 - protein, 25 aa, synthetic construct
  source 1..25: note = Seed: QTVHSIPLTINKEEALQRPVASDFE
QTVHSIPLTINKEFALQRVVAMDFE

SEQ ID NO: 45900 - protein, 25 aa, synthetic construct
  source 1..25: note = Seed: QTVHSIPLTINKEEALQRPVASDFE
QTVHSIPLTINKEFALQRVVANDFE

SEQ ID NO: 45901 - protein, 25 aa, synthetic construct
  source 1..25: note = Seed: QTVHSIPLTINKEEALQRPVASDFE
QTVHSIPLTINKEFALQRVVAPDFE

SEQ ID NO: 45902 - protein, 25 aa, synthetic construct
  source 1..25: note = Seed: QTVHSIPLTINKEEALQRPVASDFE
QTVHSIPLTINKEFALQRVVAQDFE

SEQ ID NO: 45903 - protein, 25 aa, synthetic construct
  source 1..25: note = Seed: QTVHSIPLTINKEEALQRPVASDFE
QTVHSIPLTINKEFALQRVVASDFE

SEQ ID NO: 45904 - protein, 25 aa, synthetic construct
  source 1..25: note = Seed: QTVHSIPLTINKEEALQRPVASDFE
QTVHSIPLTINKEFALQRVVATDFE

SEQ ID NO: 45905 - protein, 25 aa, synthetic construct
  source 1..25: note = Seed: QTVHSIPLTINKEEALQRPVASDFE
QTVHSIPLTINKEFALQRVVAVDFE

SEQ ID NO: 45906 - protein, 25 aa, synthetic construct
  source 1..25: note = Seed: QTVHSIPLTINKEEALQRPVASDFE
QTVHSIPLTINKEFALSRAVAADFE

SEQ ID NO: 45907 - protein, 25 aa, synthetic construct
  source 1..25: note = Seed: QTVHSIPLTINKEEALQRPVASDFE
QTVHSIPLTINKEFALSRAVACDFE

SEQ ID NO: 45908 - protein, 25 aa, synthetic construct
  source 1..25: note = Seed: QTVHSIPLTINKEEALQRPVASDFE
QTVHSIPLTINKEFALSRAVADDFE

SEQ ID NO: 45909 - protein, 25 aa, synthetic construct
  source 1..25: note = Seed: QTVHSIPLTINKEEALQRPVASDFE
QTVHSIPLTINKEFALSRAVAEDFE

SEQ ID NO: 45910 - protein, 25 aa, synthetic construct
  source 1..25: note = Seed: QTVHSIPLTINKEEALQRPVASDFE
QTVHSIPLTINKEFALSRAVAFDFE

SEQ ID NO: 45911 - protein, 25 aa, synthetic construct
  source 1..25: note = Seed: QTVHSIPLTINKEEALQRPVASDFE
QTVHSIPLTINKEFALSRAVAGDFE

SEQ ID NO: 45912 - protein, 25 aa, synthetic construct
  source 1..25: note = Seed: QTVHSIPLTINKEEALQRPVASDFE
QTVHSIPLTINKEFALSRAVAHDFE

SEQ ID NO: 45913 - protein, 25 aa, synthetic construct
  source 1..25: note = Seed: QTVHSIPLTINKEEALQRPVASDFE
QTVHSIPLTINKEFALSRAVAIDFE

SEQ ID NO: 45914 - protein, 25 aa, synthetic construct
  source 1..25: note = Seed: QTVHSIPLTINKEEALQRPVASDFE
QTVHSIPLTINKEFALSRAVAKDFE

SEQ ID NO: 45915 - protein, 25 aa, synthetic construct
  source 1..25: note = Seed: QTVHSIPLTINKEEALQRPVASDFE
QTVHSIPLTINKEFALSRAVALDFE

SEQ ID NO: 45916 - protein, 25 aa, synthetic construct
  source 1..25: note = Seed: QTVHSIPLTINKEEALQRPVASDFE
QTVHSIPLTINKEFALSRAVAMDFE

SEQ ID NO: 45917 - protein, 25 aa, synthetic construct
  source 1..25: note = Seed: QTVHSIPLTINKEEALQRPVASDFE
QTVHSIPLTINKEFALSRAVANDFE

SEQ ID NO: 45918 - protein, 25 aa, synthetic construct
  source 1..25: note = Seed: QTVHSIPLTINKEEALQRPVASDFE
QTVHSIPLTINKEFALSRAVAPDFE

SEQ ID NO: 45919 - protein, 25 aa, synthetic construct
  source 1..25: note = Seed: QTVHSIPLTINKEEALQRPVASDFE
QTVHSIPLTINKEFALSRAVAQDFE

SEQ ID NO: 45920 - protein, 25 aa, synthetic construct
  source 1..25: note = Seed: QTVHSIPLTINKEEALQRPVASDFE
QTVHSIPLTINKEFALSRAVARDFE

SEQ ID NO: 45921 - protein, 25 aa, synthetic construct
  source 1..25: note = Seed: QTVHSIPLTINKEEALQRPVASDFE
QTVHSIPLTINKEFALSRAVASDFE

SEQ ID NO: 45922 - protein, 25 aa, synthetic construct
  source 1..25: note = Seed: QTVHSIPLTINKEEALQRPVASDFE
QTVHSIPLTINKEFALSRAVATDFE

SEQ ID NO: 45923 - protein, 25 aa, synthetic construct
  source 1..25: note = Seed: QTVHSIPLTINKEEALQRPVASDFE
QTVHSIPLTINKEFALSRAVAVDFE

SEQ ID NO: 45924 - protein, 25 aa, synthetic construct
  source 1..25: note = Seed: QTVHSIPLTINKEEALQRPVASDFE
QTVHSIPLTINKEFALSRAVAYDFE

SEQ ID NO: 45925 - protein, 25 aa, synthetic construct
  source 1..25: note = Seed: QTVHSIPLTINKEEALQRPVASDFE
QTVHSIPLTINKEFALSRGVAADFE

SEQ ID NO: 45926 - protein, 25 aa, synthetic construct
  source 1..25: note = Seed: QTVHSIPLTINKEEALQRPVASDFE
QTVHSIPLTINKEFALSRGVAGDFE

SEQ ID NO: 45927 - protein, 25 aa, synthetic construct
  source 1..25: note = Seed: QTVHSIPLTINKEEALQRPVASDFE
QTVHSIPLTINKEFALSRGVAHDFE

SEQ ID NO: 45928 - protein, 25 aa, synthetic construct
  source 1..25: note = Seed: QTVHSIPLTINKEEALQRPVASDFE
QTVHSIPLTINKEFALSRGVAIDFE

SEQ ID NO: 45929 - protein, 25 aa, synthetic construct
  source 1..25: note = Seed: QTVHSIPLTINKEEALQRPVASDFE
QTVHSIPLTINKEFALSRGVALDFE

SEQ ID NO: 45930 - protein, 25 aa, synthetic construct
  source 1..25: note = Seed: QTVHSIPLTINKEEALQRPVASDFE
QTVHSIPLTINKEFALSRGVAMDFE

SEQ ID NO: 45931 - protein, 25 aa, synthetic construct
  source 1..25: note = Seed: QTVHSIPLTINKEEALQRPVASDFE
QTVHSIPLTINKEFALSRGVANDFE

SEQ ID NO: 45932 - protein, 25 aa, synthetic construct
  source 1..25: note = Seed: QTVHSIPLTINKEEALQRPVASDFE
QTVHSIPLTINKEFALSRGVAQDFE

SEQ ID NO: 45933 - protein, 25 aa, synthetic construct
  source 1..25: note = Seed: QTVHSIPLTINKEEALQRPVASDFE
QTVHSIPLTINKEFALSRGVASDFE

SEQ ID NO: 45934 - protein, 25 aa, synthetic construct
  source 1..25: note = Seed: QTVHSIPLTINKEEALQRPVASDFE
QTVHSIPLTINKEFALSRGVATDFE

SEQ ID NO: 45935 - protein, 25 aa, synthetic construct
  source 1..25: note = Seed: QTVHSIPLTINKEEALQRPVASDFE
QTVHSIPLTINKEFALSRGVAVDFE

SEQ ID NO: 45936 - protein, 25 aa, synthetic construct
  source 1..25: note = Seed: QTVHSIPLTINKEEALQRPVASDFE
QTVHSIPLTINKEFALSRIVAADFE

SEQ ID NO: 45937 - protein, 25 aa, synthetic construct
  source 1..25: note = Seed: QTVHSIPLTINKEEALQRPVASDFE
QTVHSIPLTINKEFALSRIVAGDFE

SEQ ID NO: 45938 - protein, 25 aa, synthetic construct
  source 1..25: note = Seed: QTVHSIPLTINKEEALQRPVASDFE
QTVHSIPLTINKEFALSRIVAHDFE

SEQ ID NO: 45939 - protein, 25 aa, synthetic construct
  source 1..25: note = Seed: QTVHSIPLTINKEEALQRPVASDFE
QTVHSIPLTINKEFALSRIVAIDFE

SEQ ID NO: 45940 - protein, 25 aa, synthetic construct
  source 1..25: note = Seed: QTVHSIPLTINKEEALQRPVASDFE
QTVHSIPLTINKEFALSRIVALDFE

SEQ ID NO: 45941 - protein, 25 aa, synthetic construct
  source 1..25: note = Seed: QTVHSIPLTINKEEALQRPVASDFE
QTVHSIPLTINKEFALSRIVAMDFE

SEQ ID NO: 45942 - protein, 25 aa, synthetic construct
  source 1..25: note = Seed: QTVHSIPLTINKEEALQRPVASDFE
QTVHSIPLTINKEFALSRIVANDFE

SEQ ID NO: 45943 - protein, 25 aa, synthetic construct
  source 1..25: note = Seed: QTVHSIPLTINKEEALQRPVASDFE
QTVHSIPLTINKEFALSRIVAQDFE

SEQ ID NO: 45944 - protein, 25 aa, synthetic construct
  source 1..25: note = Seed: QTVHSIPLTINKEEALQRPVASDFE
QTVHSIPLTINKEFALSRIVASDFE

SEQ ID NO: 45945 - protein, 25 aa, synthetic construct
  source 1..25: note = Seed: QTVHSIPLTINKEEALQRPVASDFE
QTVHSIPLTINKEFALSRIVATDFE

SEQ ID NO: 45946 - protein, 25 aa, synthetic construct
  source 1..25: note = Seed: QTVHSIPLTINKEEALQRPVASDFE
QTVHSIPLTINKEFALSRIVAVDFE

SEQ ID NO: 45947 - protein, 25 aa, synthetic construct
  source 1..25: note = Seed: QTVHSIPLTINKEEALQRPVASDFE
QTVHSIPLTINKEFALSRLVAADFE

SEQ ID NO: 45948 - protein, 25 aa, synthetic construct
  source 1..25: note = Seed: QTVHSIPLTINKEEALQRPVASDFE
QTVHSIPLTINKEFALSRLVANDFE

SEQ ID NO: 45949 - protein, 25 aa, synthetic construct
  source 1..25: note = Seed: QTVHSIPLTINKEEALQRPVASDFE
QTVHSIPLTINKEFALSRLVASDFE

SEQ ID NO: 45950 - protein, 25 aa, synthetic construct
  source 1..25: note = Seed: QTVHSIPLTINKEEALQRPVASDFE
QTVHSIPLTINKEFALSRMVAADFE

SEQ ID NO: 45951 - protein, 25 aa, synthetic construct
  source 1..25: note = Seed: QTVHSIPLTINKEEALQRPVASDFE
QTVHSIPLTINKEFALSRMVANDFE

SEQ ID NO: 45952 - protein, 25 aa, synthetic construct
  source 1..25: note = Seed: QTVHSIPLTINKEEALQRPVASDFE
QTVHSIPLTINKEFALSRMVASDFE

SEQ ID NO: 45953 - protein, 25 aa, synthetic construct
  source 1..25: note = Seed: QTVHSIPLTINKEEALQRPVASDFE
QTVHSIPLTINKEFALSRNVAADFE

SEQ ID NO: 45954 - protein, 25 aa, synthetic construct
  source 1..25: note = Seed: QTVHSIPLTINKEEALQRPVASDFE
QTVHSIPLTINKEFALSRNVAGDFE

SEQ ID NO: 45955 - protein, 25 aa, synthetic construct
  source 1..25: note = Seed: QTVHSIPLTINKEEALQRPVASDFE
QTVHSIPLTINKEFALSRNVAHDFE

SEQ ID NO: 45956 - protein, 25 aa, synthetic construct
  source 1..25: note = Seed: QTVHSIPLTINKEEALQRPVASDFE
QTVHSIPLTINKEFALSRNVAIDFE

SEQ ID NO: 45957 - protein, 25 aa, synthetic construct
  source 1..25: note = Seed: QTVHSIPLTINKEEALQRPVASDFE
QTVHSIPLTINKEFALSRNVALDFE

SEQ ID NO: 45958 - protein, 25 aa, synthetic construct
  source 1..25: note = Seed: QTVHSIPLTINKEEALQRPVASDFE
QTVHSIPLTINKEFALSRNVAMDFE

SEQ ID NO: 45959 - protein, 25 aa, synthetic construct
  source 1..25: note = Seed: QTVHSIPLTINKEEALQRPVASDFE
QTVHSIPLTINKEFALSRNVANDFE

SEQ ID NO: 45960 - protein, 25 aa, synthetic construct
  source 1..25: note = Seed: QTVHSIPLTINKEEALQRPVASDFE
QTVHSIPLTINKEFALSRNVAQDFE

SEQ ID NO: 45961 - protein, 25 aa, synthetic construct
  source 1..25: note = Seed: QTVHSIPLTINKEEALQRPVASDFE
QTVHSIPLTINKEFALSRNVASDFE

SEQ ID NO: 45962 - protein, 25 aa, synthetic construct
  source 1..25: note = Seed: QTVHSIPLTINKEEALQRPVASDFE
QTVHSIPLTINKEFALSRNVATDFE

SEQ ID NO: 45963 - protein, 25 aa, synthetic construct
  source 1..25: note = Seed: QTVHSIPLTINKEEALQRPVASDFE
QTVHSIPLTINKEFALSRNVAVDFE

SEQ ID NO: 45964 - protein, 25 aa, synthetic construct
  source 1..25: note = Seed: QTVHSIPLTINKEEALQRPVASDFE
QTVHSIPLTINKEFALSRPVAADFE

SEQ ID NO: 45965 - protein, 25 aa, synthetic construct
  source 1..25: note = Seed: QTVHSIPLTINKEEALQRPVASDFE
QTVHSIPLTINKEFALSRPVACDFE

SEQ ID NO: 45966 - protein, 25 aa, synthetic construct
  source 1..25: note = Seed: QTVHSIPLTINKEEALQRPVASDFE
QTVHSIPLTINKEFALSRPVAFDFE

SEQ ID NO: 45967 - protein, 25 aa, synthetic construct
  source 1..25: note = Seed: QTVHSIPLTINKEEALQRPVASDFE
QTVHSIPLTINKEFALSRPVAGDFE

SEQ ID NO: 45968 - protein, 25 aa, synthetic construct
  source 1..25: note = Seed: QTVHSIPLTINKEEALQRPVASDFE
QTVHSIPLTINKEFALSRPVAHDFE

SEQ ID NO: 45969 - protein, 25 aa, synthetic construct
  source 1..25: note = Seed: QTVHSIPLTINKEEALQRPVASDFE
QTVHSIPLTINKEFALSRPVAIDFE

SEQ ID NO: 45970 - protein, 25 aa, synthetic construct
  source 1..25: note = Seed: QTVHSIPLTINKEEALQRPVASDFE
QTVHSIPLTINKEFALSRPVALDFE

SEQ ID NO: 45971 - protein, 25 aa, synthetic construct
  source 1..25: note = Seed: QTVHSIPLTINKEEALQRPVASDFE
QTVHSIPLTINKEFALSRPVAMDFE

SEQ ID NO: 45972 - protein, 25 aa, synthetic construct
  source 1..25: note = Seed: QTVHSIPLTINKEEALQRPVASDFE
QTVHSIPLTINKEFALSRPVANDFE

SEQ ID NO: 45973 - protein, 25 aa, synthetic construct
  source 1..25: note = Seed: QTVHSIPLTINKEEALQRPVASDFE
QTVHSIPLTINKEFALSRPVAPDFE

SEQ ID NO: 45974 - protein, 25 aa, synthetic construct
  source 1..25: note = Seed: QTVHSIPLTINKEEALQRPVASDFE
QTVHSIPLTINKEFALSRPVAQDFE

SEQ ID NO: 45975 - protein, 25 aa, synthetic construct
  source 1..25: note = Seed: QTVHSIPLTINKEEALQRPVASDFE
QTVHSIPLTINKEFALSRPVASDFE

SEQ ID NO: 45976 - protein, 25 aa, synthetic construct
  source 1..25: note = Seed: QTVHSIPLTINKEEALQRPVASDFE
QTVHSIPLTINKEFALSRPVATDFE

SEQ ID NO: 45977 - protein, 25 aa, synthetic construct
  source 1..25: note = Seed: QTVHSIPLTINKEEALQRPVASDFE
QTVHSIPLTINKEFALSRPVAVDFE

SEQ ID NO: 45978 - protein, 25 aa, synthetic construct
  source 1..25: note = Seed: QTVHSIPLTINKEEALQRPVASDFE
QTVHSIPLTINKEFALSRPVAYDFE

SEQ ID NO: 45979 - protein, 25 aa, synthetic construct
  source 1..25: note = Seed: QTVHSIPLTINKEEALQRPVASDFE
QTVHSIPLTINKEFALSRSVAADFE

SEQ ID NO: 45980 - protein, 25 aa, synthetic construct
  source 1..25: note = Seed: QTVHSIPLTINKEEALQRPVASDFE
QTVHSIPLTINKEFALSRSVADDFE

SEQ ID NO: 45981 - protein, 25 aa, synthetic construct
  source 1..25: note = Seed: QTVHSIPLTINKEEALQRPVASDFE
QTVHSIPLTINKEFALSRSVAFDFE

SEQ ID NO: 45982 - protein, 25 aa, synthetic construct
  source 1..25: note = Seed: QTVHSIPLTINKEEALQRPVASDFE
QTVHSIPLTINKEFALSRSVAGDFE

SEQ ID NO: 45983 - protein, 25 aa, synthetic construct
  source 1..25: note = Seed: QTVHSIPLTINKEEALQRPVASDFE
QTVHSIPLTINKEFALSRSVAHDFE

SEQ ID NO: 45984 - protein, 25 aa, synthetic construct
  source 1..25: note = Seed: QTVHSIPLTINKEEALQRPVASDFE
QTVHSIPLTINKEFALSRSVAIDFE

SEQ ID NO: 45985 - protein, 25 aa, synthetic construct
  source 1..25: note = Seed: QTVHSIPLTINKEEALQRPVASDFE
QTVHSIPLTINKEFALSRSVALDFE

SEQ ID NO: 45986 - protein, 25 aa, synthetic construct
  source 1..25: note = Seed: QTVHSIPLTINKEEALQRPVASDFE
QTVHSIPLTINKEFALSRSVAMDFE

SEQ ID NO: 45987 - protein, 25 aa, synthetic construct
  source 1..25: note = Seed: QTVHSIPLTINKEEALQRPVASDFE
QTVHSIPLTINKEFALSRSVANDFE

SEQ ID NO: 45988 - protein, 25 aa, synthetic construct
  source 1..25: note = Seed: QTVHSIPLTINKEEALQRPVASDFE
QTVHSIPLTINKEFALSRSVAPDFE

SEQ ID NO: 45989 - protein, 25 aa, synthetic construct
  source 1..25: note = Seed: QTVHSIPLTINKEEALQRPVASDFE
QTVHSIPLTINKEFALSRSVAQDFE

SEQ ID NO: 45990 - protein, 25 aa, synthetic construct
  source 1..25: note = Seed: QTVHSIPLTINKEEALQRPVASDFE
QTVHSIPLTINKEFALSRSVASDFE

SEQ ID NO: 45991 - protein, 25 aa, synthetic construct
  source 1..25: note = Seed: QTVHSIPLTINKEEALQRPVASDFE
QTVHSIPLTINKEFALSRSVATDFE

SEQ ID NO: 45992 - protein, 25 aa, synthetic construct
  source 1..25: note = Seed: QTVHSIPLTINKEEALQRPVASDFE
QTVHSIPLTINKEFALSRSVAVDFE

SEQ ID NO: 45993 - protein, 25 aa, synthetic construct
  source 1..25: note = Seed: QTVHSIPLTINKEEALQRPVASDFE
QTVHSIPLTINKEFALSRSVAYDFE

SEQ ID NO: 45994 - protein, 25 aa, synthetic construct
  source 1..25: note = Seed: QTVHSIPLTINKEEALQRPVASDFE
QTVHSIPLTINKEFALSRTVAADFE

SEQ ID NO: 45995 - protein, 25 aa, synthetic construct
  source 1..25: note = Seed: QTVHSIPLTINKEEALQRPVASDFE
QTVHSIPLTINKEFALSRTVAFDFE

SEQ ID NO: 45996 - protein, 25 aa, synthetic construct
  source 1..25: note = Seed: QTVHSIPLTINKEEALQRPVASDFE
QTVHSIPLTINKEFALSRTVAGDFE

SEQ ID NO: 45997 - protein, 25 aa, synthetic construct
  source 1..25: note = Seed: QTVHSIPLTINKEEALQRPVASDFE
QTVHSIPLTINKEFALSRTVAHDFE

SEQ ID NO: 45998 - protein, 25 aa, synthetic construct
  source 1..25: note = Seed: QTVHSIPLTINKEEALQRPVASDFE
QTVHSIPLTINKEFALSRTVAIDFE

SEQ ID NO: 45999 - protein, 25 aa, synthetic construct
  source 1..25: note = Seed: QTVHSIPLTINKEEALQRPVASDFE
QTVHSIPLTINKEFALSRTVALDFE

SEQ ID NO: 46000 - protein, 25 aa, synthetic construct
  source 1..25: note = Seed: QTVHSIPLTINKEEALQRPVASDFE
QTVHSIPLTINKEFALSRTVAMDFE

SEQ ID NO: 46001 - protein, 25 aa, synthetic construct
  source 1..25: note = Seed: QTVHSIPLTINKEEALQRPVASDFE
QTVHSIPLTINKEFALSRTVANDFE

SEQ ID NO: 46002 - protein, 25 aa, synthetic construct
  source 1..25: note = Seed: QTVHSIPLTINKEEALQRPVASDFE
QTVHSIPLTINKEFALSRTVAPDFE

SEQ ID NO: 46003 - protein, 25 aa, synthetic construct
  source 1..25: note = Seed: QTVHSIPLTINKEEALQRPVASDFE
QTVHSIPLTINKEFALSRTVAQDFE

SEQ ID NO: 46004 - protein, 25 aa, synthetic construct
  source 1..25: note = Seed: QTVHSIPLTINKEEALQRPVASDFE
QTVHSIPLTINKEFALSRTVASDFE

SEQ ID NO: 46005 - protein, 25 aa, synthetic construct
  source 1..25: note = Seed: QTVHSIPLTINKEEALQRPVASDFE
QTVHSIPLTINKEFALSRTVATDFE

SEQ ID NO: 46006 - protein, 25 aa, synthetic construct
  source 1..25: note = Seed: QTVHSIPLTINKEEALQRPVASDFE
QTVHSIPLTINKEFALSRTVAVDFE

SEQ ID NO: 46007 - protein, 25 aa, synthetic construct
  source 1..25: note = Seed: QTVHSIPLTINKEEALQRPVASDFE
QTVHSIPLTINKEFALSRTVAYDFE

SEQ ID NO: 46008 - protein, 25 aa, synthetic construct
  source 1..25: note = Seed: QTVHSIPLTINKEEALQRPVASDFE
QTVHSIPLTINKEFALSRVVAADFE

SEQ ID NO: 46009 - protein, 25 aa, synthetic construct
  source 1..25: note = Seed: QTVHSIPLTINKEEALQRPVASDFE
QTVHSIPLTINKEFALSRVVAGDFE

SEQ ID NO: 46010 - protein, 25 aa, synthetic construct
  source 1..25: note = Seed: QTVHSIPLTINKEEALQRPVASDFE
QTVHSIPLTINKEFALSRVVAHDFE

SEQ ID NO: 46011 - protein, 25 aa, synthetic construct
  source 1..25: note = Seed: QTVHSIPLTINKEEALQRPVASDFE
QTVHSIPLTINKEFALSRVVAIDFE

SEQ ID NO: 46012 - protein, 25 aa, synthetic construct
  source 1..25: note = Seed: QTVHSIPLTINKEEALQRPVASDFE
QTVHSIPLTINKEFALSRVVALDFE

SEQ ID NO: 46013 - protein, 25 aa, synthetic construct
  source 1..25: note = Seed: QTVHSIPLTINKEEALQRPVASDFE
QTVHSIPLTINKEFALSRVVAMDFE

SEQ ID NO: 46014 - protein, 25 aa, synthetic construct
  source 1..25: note = Seed: QTVHSIPLTINKEEALQRPVASDFE
QTVHSIPLTINKEFALSRVVANDFE

SEQ ID NO: 46015 - protein, 25 aa, synthetic construct
  source 1..25: note = Seed: QTVHSIPLTINKEEALQRPVASDFE
QTVHSIPLTINKEFALSRVVAQDFE

SEQ ID NO: 46016 - protein, 25 aa, synthetic construct
  source 1..25: note = Seed: QTVHSIPLTINKEEALQRPVASDFE
QTVHSIPLTINKEFALSRVVASDFE

SEQ ID NO: 46017 - protein, 25 aa, synthetic construct
  source 1..25: note = Seed: QTVHSIPLTINKEEALQRPVASDFE
QTVHSIPLTINKEFALSRVVATDFE

SEQ ID NO: 46018 - protein, 25 aa, synthetic construct
  source 1..25: note = Seed: QTVHSIPLTINKEEALQRPVASDFE
QTVHSIPLTINKEFALSRVVAVDFE

SEQ ID NO: 46019 - protein, 25 aa, synthetic construct
  source 1..25: note = Seed: QTVHSIPLTINKEEALQRPVASDFE
QTVHSIPLTINKEFALTRAVAADFE

SEQ ID NO: 46020 - protein, 25 aa, synthetic construct
  source 1..25: note = Seed: QTVHSIPLTINKEEALQRPVASDFE
QTVHSIPLTINKEFALTRAVADDFE

SEQ ID NO: 46021 - protein, 25 aa, synthetic construct
  source 1..25: note = Seed: QTVHSIPLTINKEEALQRPVASDFE
QTVHSIPLTINKEFALTRAVAEDFE

SEQ ID NO: 46022 - protein, 25 aa, synthetic construct
  source 1..25: note = Seed: QTVHSIPLTINKEEALQRPVASDFE
QTVHSIPLTINKEFALTRAVAFDFE

SEQ ID NO: 46023 - protein, 25 aa, synthetic construct
  source 1..25: note = Seed: QTVHSIPLTINKEEALQRPVASDFE
QTVHSIPLTINKEFALTRAVAGDFE

SEQ ID NO: 46024 - protein, 25 aa, synthetic construct
  source 1..25: note = Seed: QTVHSIPLTINKEEALQRPVASDFE
QTVHSIPLTINKEFALTRAVAHDFE

SEQ ID NO: 46025 - protein, 25 aa, synthetic construct
  source 1..25: note = Seed: QTVHSIPLTINKEEALQRPVASDFE
QTVHSIPLTINKEFALTRAVAIDFE

SEQ ID NO: 46026 - protein, 25 aa, synthetic construct
  source 1..25: note = Seed: QTVHSIPLTINKEEALQRPVASDFE
QTVHSIPLTINKEFALTRAVALDFE

SEQ ID NO: 46027 - protein, 25 aa, synthetic construct
  source 1..25: note = Seed: QTVHSIPLTINKEEALQRPVASDFE
QTVHSIPLTINKEFALTRAVAMDFE

SEQ ID NO: 46028 - protein, 25 aa, synthetic construct
  source 1..25: note = Seed: QTVHSIPLTINKEEALQRPVASDFE
QTVHSIPLTINKEFALTRAVANDFE

SEQ ID NO: 46029 - protein, 25 aa, synthetic construct
  source 1..25: note = Seed: QTVHSIPLTINKEEALQRPVASDFE
QTVHSIPLTINKEFALTRAVAPDFE

SEQ ID NO: 46030 - protein, 25 aa, synthetic construct
  source 1..25: note = Seed: QTVHSIPLTINKEEALQRPVASDFE
QTVHSIPLTINKEFALTRAVAQDFE

SEQ ID NO: 46031 - protein, 25 aa, synthetic construct
  source 1..25: note = Seed: QTVHSIPLTINKEEALQRPVASDFE
QTVHSIPLTINKEFALTRAVASDFE

SEQ ID NO: 46032 - protein, 25 aa, synthetic construct
  source 1..25: note = Seed: QTVHSIPLTINKEEALQRPVASDFE
QTVHSIPLTINKEFALTRAVATDFE

SEQ ID NO: 46033 - protein, 25 aa, synthetic construct
  source 1..25: note = Seed: QTVHSIPLTINKEEALQRPVASDFE
QTVHSIPLTINKEFALTRAVAVDFE

SEQ ID NO: 46034 - protein, 25 aa, synthetic construct
  source 1..25: note = Seed: QTVHSIPLTINKEEALQRPVASDFE
QTVHSIPLTINKEFALTRAVAYDFE

SEQ ID NO: 46035 - protein, 25 aa, synthetic construct
  source 1..25: note = Seed: QTVHSIPLTINKEEALQRPVASDFE
QTVHSIPLTINKEFALTRGVAADFE

SEQ ID NO: 46036 - protein, 25 aa, synthetic construct
  source 1..25: note = Seed: QTVHSIPLTINKEEALQRPVASDFE
QTVHSIPLTINKEFALTRGVAGDFE

SEQ ID NO: 46037 - protein, 25 aa, synthetic construct
  source 1..25: note = Seed: QTVHSIPLTINKEEALQRPVASDFE
QTVHSIPLTINKEFALTRGVAHDFE

SEQ ID NO: 46038 - protein, 25 aa, synthetic construct
  source 1..25: note = Seed: QTVHSIPLTINKEEALQRPVASDFE
QTVHSIPLTINKEFALTRGVAIDFE

SEQ ID NO: 46039 - protein, 25 aa, synthetic construct
  source 1..25: note = Seed: QTVHSIPLTINKEEALQRPVASDFE
QTVHSIPLTINKEFALTRGVALDFE

SEQ ID NO: 46040 - protein, 25 aa, synthetic construct
  source 1..25: note = Seed: QTVHSIPLTINKEEALQRPVASDFE
QTVHSIPLTINKEFALTRGVAMDFE

SEQ ID NO: 46041 - protein, 25 aa, synthetic construct
  source 1..25: note = Seed: QTVHSIPLTINKEEALQRPVASDFE
QTVHSIPLTINKEFALTRGVANDFE

SEQ ID NO: 46042 - protein, 25 aa, synthetic construct
  source 1..25: note = Seed: QTVHSIPLTINKEEALQRPVASDFE
QTVHSIPLTINKEFALTRGVAQDFE

SEQ ID NO: 46043 - protein, 25 aa, synthetic construct
  source 1..25: note = Seed: QTVHSIPLTINKEEALQRPVASDFE
QTVHSIPLTINKEFALTRGVASDFE

SEQ ID NO: 46044 - protein, 25 aa, synthetic construct
  source 1..25: note = Seed: QTVHSIPLTINKEEALQRPVASDFE
QTVHSIPLTINKEFALTRGVATDFE

SEQ ID NO: 46045 - protein, 25 aa, synthetic construct
  source 1..25: note = Seed: QTVHSIPLTINKEEALQRPVASDFE
QTVHSIPLTINKEFALTRGVAVDFE

SEQ ID NO: 46046 - protein, 25 aa, synthetic construct
  source 1..25: note = Seed: QTVHSIPLTINKEEALQRPVASDFE
QTVHSIPLTINKEFALTRIVAADFE

SEQ ID NO: 46047 - protein, 25 aa, synthetic construct
  source 1..25: note = Seed: QTVHSIPLTINKEEALQRPVASDFE
QTVHSIPLTINKEFALTRIVAGDFE

SEQ ID NO: 46048 - protein, 25 aa, synthetic construct
  source 1..25: note = Seed: QTVHSIPLTINKEEALQRPVASDFE
QTVHSIPLTINKEFALTRIVAHDFE

SEQ ID NO: 46049 - protein, 25 aa, synthetic construct
  source 1..25: note = Seed: QTVHSIPLTINKEEALQRPVASDFE
QTVHSIPLTINKEFALTRIVANDFE

SEQ ID NO: 46050 - protein, 25 aa, synthetic construct
  source 1..25: note = Seed: QTVHSIPLTINKEEALQRPVASDFE
QTVHSIPLTINKEFALTRIVASDFE

SEQ ID NO: 46051 - protein, 25 aa, synthetic construct
  source 1..25: note = Seed: QTVHSIPLTINKEEALQRPVASDFE
QTVHSIPLTINKEFALTRIVATDFE

SEQ ID NO: 46052 - protein, 25 aa, synthetic construct
  source 1..25: note = Seed: QTVHSIPLTINKEEALQRPVASDFE
QTVHSIPLTINKEFALTRIVAVDFE

SEQ ID NO: 46053 - protein, 25 aa, synthetic construct
  source 1..25: note = Seed: QTVHSIPLTINKEEALQRPVASDFE
QTVHSIPLTINKEFALTRLVANDFE

SEQ ID NO: 46054 - protein, 25 aa, synthetic construct
  source 1..25: note = Seed: QTVHSIPLTINKEEALQRPVASDFE
QTVHSIPLTINKEFALTRMVANDFE

SEQ ID NO: 46055 - protein, 25 aa, synthetic construct
  source 1..25: note = Seed: QTVHSIPLTINKEEALQRPVASDFE
QTVHSIPLTINKEFALTRNVAADFE

SEQ ID NO: 46056 - protein, 25 aa, synthetic construct
  source 1..25: note = Seed: QTVHSIPLTINKEEALQRPVASDFE
QTVHSIPLTINKEFALTRNVAGDFE

SEQ ID NO: 46057 - protein, 25 aa, synthetic construct
  source 1..25: note = Seed: QTVHSIPLTINKEEALQRPVASDFE
QTVHSIPLTINKEFALTRNVAIDFE

SEQ ID NO: 46058 - protein, 25 aa, synthetic construct
  source 1..25: note = Seed: QTVHSIPLTINKEEALQRPVASDFE
QTVHSIPLTINKEFALTRNVALDFE

SEQ ID NO: 46059 - protein, 25 aa, synthetic construct
  source 1..25: note = Seed: QTVHSIPLTINKEEALQRPVASDFE
QTVHSIPLTINKEFALTRNVAMDFE

SEQ ID NO: 46060 - protein, 25 aa, synthetic construct
  source 1..25: note = Seed: QTVHSIPLTINKEEALQRPVASDFE
QTVHSIPLTINKEFALTRNVANDFE

SEQ ID NO: 46061 - protein, 25 aa, synthetic construct
  source 1..25: note = Seed: QTVHSIPLTINKEEALQRPVASDFE
QTVHSIPLTINKEFALTRNVASDFE

SEQ ID NO: 46062 - protein, 25 aa, synthetic construct
  source 1..25: note = Seed: QTVHSIPLTINKEEALQRPVASDFE
QTVHSIPLTINKEFALTRNVATDFE

SEQ ID NO: 46063 - protein, 25 aa, synthetic construct
  source 1..25: note = Seed: QTVHSIPLTINKEEALQRPVASDFE
QTVHSIPLTINKEFALTRNVAVDFE

SEQ ID NO: 46064 - protein, 25 aa, synthetic construct
  source 1..25: note = Seed: QTVHSIPLTINKEEALQRPVASDFE
QTVHSIPLTINKEFALTRPVAADFE

SEQ ID NO: 46065 - protein, 25 aa, synthetic construct
  source 1..25: note = Seed: QTVHSIPLTINKEEALQRPVASDFE
QTVHSIPLTINKEFALTRPVAFDFE

SEQ ID NO: 46066 - protein, 25 aa, synthetic construct
  source 1..25: note = Seed: QTVHSIPLTINKEEALQRPVASDFE
QTVHSIPLTINKEFALTRPVAGDFE

SEQ ID NO: 46067 - protein, 25 aa, synthetic construct
  source 1..25: note = Seed: QTVHSIPLTINKEEALQRPVASDFE
QTVHSIPLTINKEFALTRPVAHDFE

SEQ ID NO: 46068 - protein, 25 aa, synthetic construct
  source 1..25: note = Seed: QTVHSIPLTINKEEALQRPVASDFE
QTVHSIPLTINKEFALTRPVAIDFE

SEQ ID NO: 46069 - protein, 25 aa, synthetic construct
  source 1..25: note = Seed: QTVHSIPLTINKEEALQRPVASDFE
QTVHSIPLTINKEFALTRPVALDFE

SEQ ID NO: 46070 - protein, 25 aa, synthetic construct
  source 1..25: note = Seed: QTVHSIPLTINKEEALQRPVASDFE
QTVHSIPLTINKEFALTRPVAMDFE

SEQ ID NO: 46071 - protein, 25 aa, synthetic construct
  source 1..25: note = Seed: QTVHSIPLTINKEEALQRPVASDFE
QTVHSIPLTINKEFALTRPVANDFE

SEQ ID NO: 46072 - protein, 25 aa, synthetic construct
  source 1..25: note = Seed: QTVHSIPLTINKEEALQRPVASDFE
QTVHSIPLTINKEFALTRPVAPDFE

SEQ ID NO: 46073 - protein, 25 aa, synthetic construct
  source 1..25: note = Seed: QTVHSIPLTINKEEALQRPVASDFE
QTVHSIPLTINKEFALTRPVAQDFE

SEQ ID NO: 46074 - protein, 25 aa, synthetic construct
  source 1..25: note = Seed: QTVHSIPLTINKEEALQRPVASDFE
QTVHSIPLTINKEFALTRPVASDFE

SEQ ID NO: 46075 - protein, 25 aa, synthetic construct
  source 1..25: note = Seed: QTVHSIPLTINKEEALQRPVASDFE
QTVHSIPLTINKEFALTRPVATDFE

SEQ ID NO: 46076 - protein, 25 aa, synthetic construct
  source 1..25: note = Seed: QTVHSIPLTINKEEALQRPVASDFE
QTVHSIPLTINKEFALTRPVAVDFE

SEQ ID NO: 46077 - protein, 25 aa, synthetic construct
  source 1..25: note = Seed: QTVHSIPLTINKEEALQRPVASDFE
QTVHSIPLTINKEFALTRSVAADFE

SEQ ID NO: 46078 - protein, 25 aa, synthetic construct
  source 1..25: note = Seed: QTVHSIPLTINKEEALQRPVASDFE
QTVHSIPLTINKEFALTRSVAGDFE

SEQ ID NO: 46079 - protein, 25 aa, synthetic construct
  source 1..25: note = Seed: QTVHSIPLTINKEEALQRPVASDFE
QTVHSIPLTINKEFALTRSVAHDFE

SEQ ID NO: 46080 - protein, 25 aa, synthetic construct
  source 1..25: note = Seed: QTVHSIPLTINKEEALQRPVASDFE
QTVHSIPLTINKEFALTRSVAIDFE

SEQ ID NO: 46081 - protein, 25 aa, synthetic construct
  source 1..25: note = Seed: QTVHSIPLTINKEEALQRPVASDFE
QTVHSIPLTINKEFALTRSVALDFE

SEQ ID NO: 46082 - protein, 25 aa, synthetic construct
  source 1..25: note = Seed: QTVHSIPLTINKEEALQRPVASDFE
QTVHSIPLTINKEFALTRSVAMDFE

SEQ ID NO: 46083 - protein, 25 aa, synthetic construct
  source 1..25: note = Seed: QTVHSIPLTINKEEALQRPVASDFE
QTVHSIPLTINKEFALTRSVANDFE

SEQ ID NO: 46084 - protein, 25 aa, synthetic construct
  source 1..25: note = Seed: QTVHSIPLTINKEEALQRPVASDFE
QTVHSIPLTINKEFALTRSVAQDFE

SEQ ID NO: 46085 - protein, 25 aa, synthetic construct
  source 1..25: note = Seed: QTVHSIPLTINKEEALQRPVASDFE
QTVHSIPLTINKEFALTRSVASDFE

SEQ ID NO: 46086 - protein, 25 aa, synthetic construct
  source 1..25: note = Seed: QTVHSIPLTINKEEALQRPVASDFE
QTVHSIPLTINKEFALTRSVATDFE

SEQ ID NO: 46087 - protein, 25 aa, synthetic construct
  source 1..25: note = Seed: QTVHSIPLTINKEEALQRPVASDFE
QTVHSIPLTINKEFALTRSVAVDFE

SEQ ID NO: 46088 - protein, 25 aa, synthetic construct
  source 1..25: note = Seed: QTVHSIPLTINKEEALQRPVASDFE
QTVHSIPLTINKEFALTRSVAYDFE

SEQ ID NO: 46089 - protein, 25 aa, synthetic construct
  source 1..25: note = Seed: QTVHSIPLTINKEEALQRPVASDFE
QTVHSIPLTINKEFALTRTVAADFE

SEQ ID NO: 46090 - protein, 25 aa, synthetic construct
  source 1..25: note = Seed: QTVHSIPLTINKEEALQRPVASDFE
QTVHSIPLTINKEFALTRTVAGDFE

SEQ ID NO: 46091 - protein, 25 aa, synthetic construct
  source 1..25: note = Seed: QTVHSIPLTINKEEALQRPVASDFE
QTVHSIPLTINKEFALTRTVAHDFE

SEQ ID NO: 46092 - protein, 25 aa, synthetic construct
  source 1..25: note = Seed: QTVHSIPLTINKEEALQRPVASDFE
QTVHSIPLTINKEFALTRTVAIDFE

SEQ ID NO: 46093 - protein, 25 aa, synthetic construct
  source 1..25: note = Seed: QTVHSIPLTINKEEALQRPVASDFE
QTVHSIPLTINKEFALTRTVALDFE

SEQ ID NO: 46094 - protein, 25 aa, synthetic construct
  source 1..25: note = Seed: QTVHSIPLTINKEEALQRPVASDFE
QTVHSIPLTINKEFALTRTVAMDFE

SEQ ID NO: 46095 - protein, 25 aa, synthetic construct
  source 1..25: note = Seed: QTVHSIPLTINKEEALQRPVASDFE
QTVHSIPLTINKEFALTRTVANDFE

SEQ ID NO: 46096 - protein, 25 aa, synthetic construct
  source 1..25: note = Seed: QTVHSIPLTINKEEALQRPVASDFE
QTVHSIPLTINKEFALTRTVAQDFE

SEQ ID NO: 46097 - protein, 25 aa, synthetic construct
  source 1..25: note = Seed: QTVHSIPLTINKEEALQRPVASDFE
QTVHSIPLTINKEFALTRTVASDFE

SEQ ID NO: 46098 - protein, 25 aa, synthetic construct
  source 1..25: note = Seed: QTVHSIPLTINKEEALQRPVASDFE
QTVHSIPLTINKEFALTRTVATDFE

SEQ ID NO: 46099 - protein, 25 aa, synthetic construct
  source 1..25: note = Seed: QTVHSIPLTINKEEALQRPVASDFE
QTVHSIPLTINKEFALTRTVAVDFE

SEQ ID NO: 46100 - protein, 25 aa, synthetic construct
  source 1..25: note = Seed: QTVHSIPLTINKEEALQRPVASDFE
QTVHSIPLTINKEFALTRVVAADFE

SEQ ID NO: 46101 - protein, 25 aa, synthetic construct
  source 1..25: note = Seed: QTVHSIPLTINKEEALQRPVASDFE
QTVHSIPLTINKEFALTRVVAGDFE

SEQ ID NO: 46102 - protein, 25 aa, synthetic construct
  source 1..25: note = Seed: QTVHSIPLTINKEEALQRPVASDFE
QTVHSIPLTINKEFALTRVVAHDFE

SEQ ID NO: 46103 - protein, 25 aa, synthetic construct
  source 1..25: note = Seed: QTVHSIPLTINKEEALQRPVASDFE
QTVHSIPLTINKEFALTRVVAIDFE

SEQ ID NO: 46104 - protein, 25 aa, synthetic construct
  source 1..25: note = Seed: QTVHSIPLTINKEEALQRPVASDFE
QTVHSIPLTINKEFALTRVVALDFE

SEQ ID NO: 46105 - protein, 25 aa, synthetic construct
  source 1..25: note = Seed: QTVHSIPLTINKEEALQRPVASDFE
QTVHSIPLTINKEFALTRVVAMDFE

SEQ ID NO: 46106 - protein, 25 aa, synthetic construct
  source 1..25: note = Seed: QTVHSIPLTINKEEALQRPVASDFE
QTVHSIPLTINKEFALTRVVANDFE

SEQ ID NO: 46107 - protein, 25 aa, synthetic construct
  source 1..25: note = Seed: QTVHSIPLTINKEEALQRPVASDFE
QTVHSIPLTINKEFALTRVVAQDFE

SEQ ID NO: 46108 - protein, 25 aa, synthetic construct
  source 1..25: note = Seed: QTVHSIPLTINKEEALQRPVASDFE
QTVHSIPLTINKEFALTRVVASDFE

SEQ ID NO: 46109 - protein, 25 aa, synthetic construct
  source 1..25: note = Seed: QTVHSIPLTINKEEALQRPVASDFE
QTVHSIPLTINKEFALTRVVATDFE

SEQ ID NO: 46110 - protein, 25 aa, synthetic construct
  source 1..25: note = Seed: QTVHSIPLTINKEEALQRPVASDFE
QTVHSIPLTINKEFALTRVVAVDFE

SEQ ID NO: 46111 - protein, 25 aa, synthetic construct
  source 1..25: note = Seed: QTVHSIPLTINKEEALQRPVASDFE
QTVHSIPLTINKEFALVRAVAADFE

SEQ ID NO: 46112 - protein, 25 aa, synthetic construct
  source 1..25: note = Seed: QTVHSIPLTINKEEALQRPVASDFE
QTVHSIPLTINKEFALVRAVACDFE

SEQ ID NO: 46113 - protein, 25 aa, synthetic construct
  source 1..25: note = Seed: QTVHSIPLTINKEEALQRPVASDFE
QTVHSIPLTINKEFALVRAVADDFE

SEQ ID NO: 46114 - protein, 25 aa, synthetic construct
  source 1..25: note = Seed: QTVHSIPLTINKEEALQRPVASDFE
QTVHSIPLTINKEFALVRAVAEDFE

SEQ ID NO: 46115 - protein, 25 aa, synthetic construct
  source 1..25: note = Seed: QTVHSIPLTINKEEALQRPVASDFE
QTVHSIPLTINKEFALVRAVAGDFE

SEQ ID NO: 46116 - protein, 25 aa, synthetic construct
  source 1..25: note = Seed: QTVHSIPLTINKEEALQRPVASDFE
QTVHSIPLTINKEFALVRAVAHDFE

SEQ ID NO: 46117 - protein, 25 aa, synthetic construct
  source 1..25: note = Seed: QTVHSIPLTINKEEALQRPVASDFE
QTVHSIPLTINKEFALVRAVAIDFE

SEQ ID NO: 46118 - protein, 25 aa, synthetic construct
  source 1..25: note = Seed: QTVHSIPLTINKEEALQRPVASDFE
QTVHSIPLTINKEFALVRAVAKDFE

SEQ ID NO: 46119 - protein, 25 aa, synthetic construct
  source 1..25: note = Seed: QTVHSIPLTINKEEALQRPVASDFE
QTVHSIPLTINKEFALVRAVALDFE

SEQ ID NO: 46120 - protein, 25 aa, synthetic construct
  source 1..25: note = Seed: QTVHSIPLTINKEEALQRPVASDFE
QTVHSIPLTINKEFALVRAVAMDFE

SEQ ID NO: 46121 - protein, 25 aa, synthetic construct
  source 1..25: note = Seed: QTVHSIPLTINKEEALQRPVASDFE
QTVHSIPLTINKEFALVRAVANDFE

SEQ ID NO: 46122 - protein, 25 aa, synthetic construct
  source 1..25: note = Seed: QTVHSIPLTINKEEALQRPVASDFE
QTVHSIPLTINKEFALVRAVAPDFE

SEQ ID NO: 46123 - protein, 25 aa, synthetic construct
  source 1..25: note = Seed: QTVHSIPLTINKEEALQRPVASDFE
QTVHSIPLTINKEFALVRAVAQDFE

SEQ ID NO: 46124 - protein, 25 aa, synthetic construct
  source 1..25: note = Seed: QTVHSIPLTINKEEALQRPVASDFE
QTVHSIPLTINKEFALVRAVARDFE

SEQ ID NO: 46125 - protein, 25 aa, synthetic construct
  source 1..25: note = Seed: QTVHSIPLTINKEEALQRPVASDFE
QTVHSIPLTINKEFALVRAVASDFE

SEQ ID NO: 46126 - protein, 25 aa, synthetic construct
  source 1..25: note = Seed: QTVHSIPLTINKEEALQRPVASDFE
QTVHSIPLTINKEFALVRAVATDFE

SEQ ID NO: 46127 - protein, 25 aa, synthetic construct
  source 1..25: note = Seed: QTVHSIPLTINKEEALQRPVASDFE
QTVHSIPLTINKEFALVRAVAVDFE

SEQ ID NO: 46128 - protein, 25 aa, synthetic construct
  source 1..25: note = Seed: QTVHSIPLTINKEEALQRPVASDFE
QTVHSIPLTINKEFALVRAVAYDFE

SEQ ID NO: 46129 - protein, 25 aa, synthetic construct
  source 1..25: note = Seed: QTVHSIPLTINKEEALQRPVASDFE
QTVHSIPLTINKEFALVRDVAADFE

SEQ ID NO: 46130 - protein, 25 aa, synthetic construct
  source 1..25: note = Seed: QTVHSIPLTINKEEALQRPVASDFE
QTVHSIPLTINKEFALVREVAADFE

SEQ ID NO: 46131 - protein, 25 aa, synthetic construct
  source 1..25: note = Seed: QTVHSIPLTINKEEALQRPVASDFE
QTVHSIPLTINKEFALVREVANDFE

SEQ ID NO: 46132 - protein, 25 aa, synthetic construct
  source 1..25: note = Seed: QTVHSIPLTINKEEALQRPVASDFE
QTVHSIPLTINKEFALVRGVAADFE

SEQ ID NO: 46133 - protein, 25 aa, synthetic construct
  source 1..25: note = Seed: QTVHSIPLTINKEEALQRPVASDFE
QTVHSIPLTINKEFALVRGVADDFE

SEQ ID NO: 46134 - protein, 25 aa, synthetic construct
  source 1..25: note = Seed: QTVHSIPLTINKEEALQRPVASDFE
QTVHSIPLTINKEFALVRGVAEDFE

SEQ ID NO: 46135 - protein, 25 aa, synthetic construct
  source 1..25: note = Seed: QTVHSIPLTINKEEALQRPVASDFE
QTVHSIPLTINKEFALVRGVAGDFE

SEQ ID NO: 46136 - protein, 25 aa, synthetic construct
  source 1..25: note = Seed: QTVHSIPLTINKEEALQRPVASDFE
QTVHSIPLTINKEFALVRGVAHDFE

SEQ ID NO: 46137 - protein, 25 aa, synthetic construct
  source 1..25: note = Seed: QTVHSIPLTINKEEALQRPVASDFE
QTVHSIPLTINKEFALVRGVAIDFE

SEQ ID NO: 46138 - protein, 25 aa, synthetic construct
  source 1..25: note = Seed: QTVHSIPLTINKEEALQRPVASDFE
QTVHSIPLTINKEFALVRGVALDFE

SEQ ID NO: 46139 - protein, 25 aa, synthetic construct
  source 1..25: note = Seed: QTVHSIPLTINKEEALQRPVASDFE
QTVHSIPLTINKEFALVRGVAMDFE

SEQ ID NO: 46140 - protein, 25 aa, synthetic construct
  source 1..25: note = Seed: QTVHSIPLTINKEEALQRPVASDFE
QTVHSIPLTINKEFALVRGVANDFE

SEQ ID NO: 46141 - protein, 25 aa, synthetic construct
  source 1..25: note = Seed: QTVHSIPLTINKEEALQRPVASDFE
QTVHSIPLTINKEFALVRGVAPDFE

SEQ ID NO: 46142 - protein, 25 aa, synthetic construct
  source 1..25: note = Seed: QTVHSIPLTINKEEALQRPVASDFE
QTVHSIPLTINKEFALVRGVAQDFE

SEQ ID NO: 46143 - protein, 25 aa, synthetic construct
  source 1..25: note = Seed: QTVHSIPLTINKEEALQRPVASDFE
QTVHSIPLTINKEFALVRGVASDFE

SEQ ID NO: 46144 - protein, 25 aa, synthetic construct
  source 1..25: note = Seed: QTVHSIPLTINKEEALQRPVASDFE
QTVHSIPLTINKEFALVRGVATDFE

SEQ ID NO: 46145 - protein, 25 aa, synthetic construct
  source 1..25: note = Seed: QTVHSIPLTINKEEALQRPVASDFE
QTVHSIPLTINKEFALVRGVAVDFE

SEQ ID NO: 46146 - protein, 25 aa, synthetic construct
  source 1..25: note = Seed: QTVHSIPLTINKEEALQRPVASDFE
QTVHSIPLTINKEFALVRHVAADFE

SEQ ID NO: 46147 - protein, 25 aa, synthetic construct
  source 1..25: note = Seed: QTVHSIPLTINKEEALQRPVASDFE
QTVHSIPLTINKEFALVRHVANDFE

SEQ ID NO: 46148 - protein, 25 aa, synthetic construct
  source 1..25: note = Seed: QTVHSIPLTINKEEALQRPVASDFE
QTVHSIPLTINKEFALVRHVASDFE

SEQ ID NO: 46149 - protein, 25 aa, synthetic construct
  source 1..25: note = Seed: QTVHSIPLTINKEEALQRPVASDFE
QTVHSIPLTINKEFALVRIVAADFE

SEQ ID NO: 46150 - protein, 25 aa, synthetic construct
  source 1..25: note = Seed: QTVHSIPLTINKEEALQRPVASDFE
QTVHSIPLTINKEFALVRIVADDFE

SEQ ID NO: 46151 - protein, 25 aa, synthetic construct
  source 1..25: note = Seed: QTVHSIPLTINKEEALQRPVASDFE
QTVHSIPLTINKEFALVRIVAGDFE

SEQ ID NO: 46152 - protein, 25 aa, synthetic construct
  source 1..25: note = Seed: QTVHSIPLTINKEEALQRPVASDFE
QTVHSIPLTINKEFALVRIVAHDFE

SEQ ID NO: 46153 - protein, 25 aa, synthetic construct
  source 1..25: note = Seed: QTVHSIPLTINKEEALQRPVASDFE
QTVHSIPLTINKEFALVRIVANDFE

SEQ ID NO: 46154 - protein, 25 aa, synthetic construct
  source 1..25: note = Seed: QTVHSIPLTINKEEALQRPVASDFE
QTVHSIPLTINKEFALVRIVASDFE

SEQ ID NO: 46155 - protein, 25 aa, synthetic construct
  source 1..25: note = Seed: QTVHSIPLTINKEEALQRPVASDFE
QTVHSIPLTINKEFALVRIVATDFE

SEQ ID NO: 46156 - protein, 25 aa, synthetic construct
  source 1..25: note = Seed: QTVHSIPLTINKEEALQRPVASDFE
QTVHSIPLTINKEFALVRLVANDFE

SEQ ID NO: 46157 - protein, 25 aa, synthetic construct
  source 1..25: note = Seed: QTVHSIPLTINKEEALQRPVASDFE
QTVHSIPLTINKEFALVRMVANDFE

SEQ ID NO: 46158 - protein, 25 aa, synthetic construct
  source 1..25: note = Seed: QTVHSIPLTINKEEALQRPVASDFE
QTVHSIPLTINKEFALVRNVAADFE

SEQ ID NO: 46159 - protein, 25 aa, synthetic construct
  source 1..25: note = Seed: QTVHSIPLTINKEEALQRPVASDFE
QTVHSIPLTINKEFALVRNVADDFE

SEQ ID NO: 46160 - protein, 25 aa, synthetic construct
  source 1..25: note = Seed: QTVHSIPLTINKEEALQRPVASDFE
QTVHSIPLTINKEFALVRNVAEDFE

SEQ ID NO: 46161 - protein, 25 aa, synthetic construct
  source 1..25: note = Seed: QTVHSIPLTINKEEALQRPVASDFE
QTVHSIPLTINKEFALVRNVAGDFE

SEQ ID NO: 46162 - protein, 25 aa, synthetic construct
  source 1..25: note = Seed: QTVHSIPLTINKEEALQRPVASDFE
QTVHSIPLTINKEFALVRNVAHDFE

SEQ ID NO: 46163 - protein, 25 aa, synthetic construct
  source 1..25: note = Seed: QTVHSIPLTINKEEALQRPVASDFE
QTVHSIPLTINKEFALVRNVAIDFE

SEQ ID NO: 46164 - protein, 25 aa, synthetic construct
  source 1..25: note = Seed: QTVHSIPLTINKEEALQRPVASDFE
QTVHSIPLTINKEFALVRNVALDFE

SEQ ID NO: 46165 - protein, 25 aa, synthetic construct
  source 1..25: note = Seed: QTVHSIPLTINKEEALQRPVASDFE
QTVHSIPLTINKEFALVRNVAMDFE

SEQ ID NO: 46166 - protein, 25 aa, synthetic construct
  source 1..25: note = Seed: QTVHSIPLTINKEEALQRPVASDFE
QTVHSIPLTINKEFALVRNVANDFE

SEQ ID NO: 46167 - protein, 25 aa, synthetic construct
  source 1..25: note = Seed: QTVHSIPLTINKEEALQRPVASDFE
QTVHSIPLTINKEFALVRNVAPDFE

SEQ ID NO: 46168 - protein, 25 aa, synthetic construct
  source 1..25: note = Seed: QTVHSIPLTINKEEALQRPVASDFE
QTVHSIPLTINKEFALVRNVAQDFE

SEQ ID NO: 46169 - protein, 25 aa, synthetic construct
  source 1..25: note = Seed: QTVHSIPLTINKEEALQRPVASDFE
QTVHSIPLTINKEFALVRNVASDFE

SEQ ID NO: 46170 - protein, 25 aa, synthetic construct
  source 1..25: note = Seed: QTVHSIPLTINKEEALQRPVASDFE
QTVHSIPLTINKEFALVRNVATDFE

SEQ ID NO: 46171 - protein, 25 aa, synthetic construct
  source 1..25: note = Seed: QTVHSIPLTINKEEALQRPVASDFE
QTVHSIPLTINKEFALVRNVAVDFE

SEQ ID NO: 46172 - protein, 25 aa, synthetic construct
  source 1..25: note = Seed: QTVHSIPLTINKEEALQRPVASDFE
QTVHSIPLTINKEFALVRPVAADFE

SEQ ID NO: 46173 - protein, 25 aa, synthetic construct
  source 1..25: note = Seed: QTVHSIPLTINKEEALQRPVASDFE
QTVHSIPLTINKEFALVRPVACDFE

SEQ ID NO: 46174 - protein, 25 aa, synthetic construct
  source 1..25: note = Seed: QTVHSIPLTINKEEALQRPVASDFE
QTVHSIPLTINKEFALVRPVADDFE

SEQ ID NO: 46175 - protein, 25 aa, synthetic construct
  source 1..25: note = Seed: QTVHSIPLTINKEEALQRPVASDFE
QTVHSIPLTINKEFALVRPVAEDFE

SEQ ID NO: 46176 - protein, 25 aa, synthetic construct
  source 1..25: note = Seed: QTVHSIPLTINKEEALQRPVASDFE
QTVHSIPLTINKEFALVRPVAFDFE

SEQ ID NO: 46177 - protein, 25 aa, synthetic construct
  source 1..25: note = Seed: QTVHSIPLTINKEEALQRPVASDFE
QTVHSIPLTINKEFALVRPVAGDFE

SEQ ID NO: 46178 - protein, 25 aa, synthetic construct
  source 1..25: note = Seed: QTVHSIPLTINKEEALQRPVASDFE
QTVHSIPLTINKEFALVRPVAHDFE

SEQ ID NO: 46179 - protein, 25 aa, synthetic construct
  source 1..25: note = Seed: QTVHSIPLTINKEEALQRPVASDFE
QTVHSIPLTINKEFALVRPVAIDFE

SEQ ID NO: 46180 - protein, 25 aa, synthetic construct
  source 1..25: note = Seed: QTVHSIPLTINKEEALQRPVASDFE
QTVHSIPLTINKEFALVRPVAKDFE

SEQ ID NO: 46181 - protein, 25 aa, synthetic construct
  source 1..25: note = Seed: QTVHSIPLTINKEEALQRPVASDFE
QTVHSIPLTINKEFALVRPVALDFE

SEQ ID NO: 46182 - protein, 25 aa, synthetic construct
  source 1..25: note = Seed: QTVHSIPLTINKEEALQRPVASDFE
QTVHSIPLTINKEFALVRPVAMDFE

SEQ ID NO: 46183 - protein, 25 aa, synthetic construct
  source 1..25: note = Seed: QTVHSIPLTINKEEALQRPVASDFE
QTVHSIPLTINKEFALVRPVANDFE

SEQ ID NO: 46184 - protein, 25 aa, synthetic construct
  source 1..25: note = Seed: QTVHSIPLTINKEEALQRPVASDFE
QTVHSIPLTINKEFALVRPVAPDFE

SEQ ID NO: 46185 - protein, 25 aa, synthetic construct
  source 1..25: note = Seed: QTVHSIPLTINKEEALQRPVASDFE
QTVHSIPLTINKEFALVRPVAQDFE

SEQ ID NO: 46186 - protein, 25 aa, synthetic construct
  source 1..25: note = Seed: QTVHSIPLTINKEEALQRPVASDFE
QTVHSIPLTINKEFALVRPVARDFE

SEQ ID NO: 46187 - protein, 25 aa, synthetic construct
  source 1..25: note = Seed: QTVHSIPLTINKEEALQRPVASDFE
QTVHSIPLTINKEFALVRPVASDFE

SEQ ID NO: 46188 - protein, 25 aa, synthetic construct
  source 1..25: note = Seed: QTVHSIPLTINKEEALQRPVASDFE
QTVHSIPLTINKEFALVRPVATDFE

SEQ ID NO: 46189 - protein, 25 aa, synthetic construct
  source 1..25: note = Seed: QTVHSIPLTINKEEALQRPVASDFE
QTVHSIPLTINKEFALVRPVAVDFE

SEQ ID NO: 46190 - protein, 25 aa, synthetic construct
  source 1..25: note = Seed: QTVHSIPLTINKEEALQRPVASDFE
QTVHSIPLTINKEFALVRPVAYDFE

SEQ ID NO: 46191 - protein, 25 aa, synthetic construct
  source 1..25: note = Seed: QTVHSIPLTINKEEALQRPVASDFE
QTVHSIPLTINKEFALVRQVAADFE

SEQ ID NO: 46192 - protein, 25 aa, synthetic construct
  source 1..25: note = Seed: QTVHSIPLTINKEEALQRPVASDFE
QTVHSIPLTINKEFALVRQVANDFE

SEQ ID NO: 46193 - protein, 25 aa, synthetic construct
  source 1..25: note = Seed: QTVHSIPLTINKEEALQRPVASDFE
QTVHSIPLTINKEFALVRQVASDFE

SEQ ID NO: 46194 - protein, 25 aa, synthetic construct
  source 1..25: note = Seed: QTVHSIPLTINKEEALQRPVASDFE
QTVHSIPLTINKEFALVRSVAADFE

SEQ ID NO: 46195 - protein, 25 aa, synthetic construct
  source 1..25: note = Seed: QTVHSIPLTINKEEALQRPVASDFE
QTVHSIPLTINKEFALVRSVADDFE

SEQ ID NO: 46196 - protein, 25 aa, synthetic construct
  source 1..25: note = Seed: QTVHSIPLTINKEEALQRPVASDFE
QTVHSIPLTINKEFALVRSVAEDFE

SEQ ID NO: 46197 - protein, 25 aa, synthetic construct
  source 1..25: note = Seed: QTVHSIPLTINKEEALQRPVASDFE
QTVHSIPLTINKEFALVRSVAGDFE

SEQ ID NO: 46198 - protein, 25 aa, synthetic construct
  source 1..25: note = Seed: QTVHSIPLTINKEEALQRPVASDFE
QTVHSIPLTINKEFALVRSVAHDFE

SEQ ID NO: 46199 - protein, 25 aa, synthetic construct
  source 1..25: note = Seed: QTVHSIPLTINKEEALQRPVASDFE
QTVHSIPLTINKEFALVRSVAIDFE

SEQ ID NO: 46200 - protein, 25 aa, synthetic construct
  source 1..25: note = Seed: QTVHSIPLTINKEEALQRPVASDFE
QTVHSIPLTINKEFALVRSVAKDFE

SEQ ID NO: 46201 - protein, 25 aa, synthetic construct
  source 1..25: note = Seed: QTVHSIPLTINKEEALQRPVASDFE
QTVHSIPLTINKEFALVRSVALDFE

SEQ ID NO: 46202 - protein, 25 aa, synthetic construct
  source 1..25: note = Seed: QTVHSIPLTINKEEALQRPVASDFE
QTVHSIPLTINKEFALVRSVAMDFE

SEQ ID NO: 46203 - protein, 25 aa, synthetic construct
  source 1..25: note = Seed: QTVHSIPLTINKEEALQRPVASDFE
QTVHSIPLTINKEFALVRSVANDFE

SEQ ID NO: 46204 - protein, 25 aa, synthetic construct
  source 1..25: note = Seed: QTVHSIPLTINKEEALQRPVASDFE
QTVHSIPLTINKEFALVRSVAPDFE

SEQ ID NO: 46205 - protein, 25 aa, synthetic construct
  source 1..25: note = Seed: QTVHSIPLTINKEEALQRPVASDFE
QTVHSIPLTINKEFALVRSVAQDFE

SEQ ID NO: 46206 - protein, 25 aa, synthetic construct
  source 1..25: note = Seed: QTVHSIPLTINKEEALQRPVASDFE
QTVHSIPLTINKEFALVRSVARDFE

SEQ ID NO: 46207 - protein, 25 aa, synthetic construct
  source 1..25: note = Seed: QTVHSIPLTINKEEALQRPVASDFE
QTVHSIPLTINKEFALVRSVASDFE

SEQ ID NO: 46208 - protein, 25 aa, synthetic construct
  source 1..25: note = Seed: QTVHSIPLTINKEEALQRPVASDFE
QTVHSIPLTINKEFALVRSVATDFE

SEQ ID NO: 46209 - protein, 25 aa, synthetic construct
  source 1..25: note = Seed: QTVHSIPLTINKEEALQRPVASDFE
QTVHSIPLTINKEFALVRSVAVDFE

SEQ ID NO: 46210 - protein, 25 aa, synthetic construct
  source 1..25: note = Seed: QTVHSIPLTINKEEALQRPVASDFE
QTVHSIPLTINKEFALVRSVAYDFE

SEQ ID NO: 46211 - protein, 25 aa, synthetic construct
  source 1..25: note = Seed: QTVHSIPLTINKEEALQRPVASDFE
QTVHSIPLTINKEFALVRTVAADFE

SEQ ID NO: 46212 - protein, 25 aa, synthetic construct
  source 1..25: note = Seed: QTVHSIPLTINKEEALQRPVASDFE
QTVHSIPLTINKEFALVRTVADDFE

SEQ ID NO: 46213 - protein, 25 aa, synthetic construct
  source 1..25: note = Seed: QTVHSIPLTINKEEALQRPVASDFE
QTVHSIPLTINKEFALVRTVAEDFE

SEQ ID NO: 46214 - protein, 25 aa, synthetic construct
  source 1..25: note = Seed: QTVHSIPLTINKEEALQRPVASDFE
QTVHSIPLTINKEFALVRTVAGDFE

SEQ ID NO: 46215 - protein, 25 aa, synthetic construct
  source 1..25: note = Seed: QTVHSIPLTINKEEALQRPVASDFE
QTVHSIPLTINKEFALVRTVAHDFE

SEQ ID NO: 46216 - protein, 25 aa, synthetic construct
  source 1..25: note = Seed: QTVHSIPLTINKEEALQRPVASDFE
QTVHSIPLTINKEFALVRTVAIDFE

SEQ ID NO: 46217 - protein, 25 aa, synthetic construct
  source 1..25: note = Seed: QTVHSIPLTINKEEALQRPVASDFE
QTVHSIPLTINKEFALVRTVAKDFE

SEQ ID NO: 46218 - protein, 25 aa, synthetic construct
  source 1..25: note = Seed: QTVHSIPLTINKEEALQRPVASDFE
QTVHSIPLTINKEFALVRTVALDFE

SEQ ID NO: 46219 - protein, 25 aa, synthetic construct
  source 1..25: note = Seed: QTVHSIPLTINKEEALQRPVASDFE
QTVHSIPLTINKEFALVRTVAMDFE

SEQ ID NO: 46220 - protein, 25 aa, synthetic construct
  source 1..25: note = Seed: QTVHSIPLTINKEEALQRPVASDFE
QTVHSIPLTINKEFALVRTVANDFE

SEQ ID NO: 46221 - protein, 25 aa, synthetic construct
  source 1..25: note = Seed: QTVHSIPLTINKEEALQRPVASDFE
QTVHSIPLTINKEFALVRTVAPDFE

SEQ ID NO: 46222 - protein, 25 aa, synthetic construct
  source 1..25: note = Seed: QTVHSIPLTINKEEALQRPVASDFE
QTVHSIPLTINKEFALVRTVAQDFE

SEQ ID NO: 46223 - protein, 25 aa, synthetic construct
  source 1..25: note = Seed: QTVHSIPLTINKEEALQRPVASDFE
QTVHSIPLTINKEFALVRTVARDFE

SEQ ID NO: 46224 - protein, 25 aa, synthetic construct
  source 1..25: note = Seed: QTVHSIPLTINKEEALQRPVASDFE
QTVHSIPLTINKEFALVRTVASDFE

SEQ ID NO: 46225 - protein, 25 aa, synthetic construct
  source 1..25: note = Seed: QTVHSIPLTINKEEALQRPVASDFE
QTVHSIPLTINKEFALVRTVATDFE

SEQ ID NO: 46226 - protein, 25 aa, synthetic construct
  source 1..25: note = Seed: QTVHSIPLTINKEEALQRPVASDFE
QTVHSIPLTINKEFALVRTVAVDFE

SEQ ID NO: 46227 - protein, 25 aa, synthetic construct
  source 1..25: note = Seed: QTVHSIPLTINKEEALQRPVASDFE
QTVHSIPLTINKEFALVRTVAYDFE

SEQ ID NO: 46228 - protein, 25 aa, synthetic construct
  source 1..25: note = Seed: QTVHSIPLTINKEEALQRPVASDFE
QTVHSIPLTINKEFALVRVVAADFE

SEQ ID NO: 46229 - protein, 25 aa, synthetic construct
  source 1..25: note = Seed: QTVHSIPLTINKEEALQRPVASDFE
QTVHSIPLTINKEFALVRVVADDFE

SEQ ID NO: 46230 - protein, 25 aa, synthetic construct
  source 1..25: note = Seed: QTVHSIPLTINKEEALQRPVASDFE
QTVHSIPLTINKEFALVRVVAEDFE

SEQ ID NO: 46231 - protein, 25 aa, synthetic construct
  source 1..25: note = Seed: QTVHSIPLTINKEEALQRPVASDFE
QTVHSIPLTINKEFALVRVVAGDFE

SEQ ID NO: 46232 - protein, 25 aa, synthetic construct
  source 1..25: note = Seed: QTVHSIPLTINKEEALQRPVASDFE
QTVHSIPLTINKEFALVRVVAHDFE

SEQ ID NO: 46233 - protein, 25 aa, synthetic construct
  source 1..25: note = Seed: QTVHSIPLTINKEEALQRPVASDFE
QTVHSIPLTINKEFALVRVVAKDFE

SEQ ID NO: 46234 - protein, 25 aa, synthetic construct
  source 1..25: note = Seed: QTVHSIPLTINKEEALQRPVASDFE
QTVHSIPLTINKEFALVRVVAMDFE

SEQ ID NO: 46235 - protein, 25 aa, synthetic construct
  source 1..25: note = Seed: QTVHSIPLTINKEEALQRPVASDFE
QTVHSIPLTINKEFALVRVVANDFE

SEQ ID NO: 46236 - protein, 25 aa, synthetic construct
  source 1..25: note = Seed: QTVHSIPLTINKEEALQRPVASDFE
QTVHSIPLTINKEFALVRVVAPDFE

SEQ ID NO: 46237 - protein, 25 aa, synthetic construct
  source 1..25: note = Seed: QTVHSIPLTINKEEALQRPVASDFE
QTVHSIPLTINKEFALVRVVAQDFE

SEQ ID NO: 46238 - protein, 25 aa, synthetic construct
  source 1..25: note = Seed: QTVHSIPLTINKEEALQRPVASDFE
QTVHSIPLTINKEFALVRVVASDFE

SEQ ID NO: 46239 - protein, 25 aa, synthetic construct
  source 1..25: note = Seed: QTVHSIPLTINKEEALQRPVASDFE
QTVHSIPLTINKEFALVRVVATDFE

SEQ ID NO: 46240 - protein, 25 aa, synthetic construct
  source 1..25: note = Seed: QTVHSIPLTINKEEALQRPVASDFE
QTVHSIPLTINKEFALWRAVAADFE

SEQ ID NO: 46241 - protein, 25 aa, synthetic construct
  source 1..25: note = Seed: QTVHSIPLTINKEEALQRPVASDFE
QTVHSIPLTINKEFALWRAVAGDFE

SEQ ID NO: 46242 - protein, 25 aa, synthetic construct
  source 1..25: note = Seed: QTVHSIPLTINKEEALQRPVASDFE
QTVHSIPLTINKEFALWRAVAHDFE

SEQ ID NO: 46243 - protein, 25 aa, synthetic construct
  source 1..25: note = Seed: QTVHSIPLTINKEEALQRPVASDFE
QTVHSIPLTINKEFALWRAVAIDFE

SEQ ID NO: 46244 - protein, 25 aa, synthetic construct
  source 1..25: note = Seed: QTVHSIPLTINKEEALQRPVASDFE
QTVHSIPLTINKEFALWRAVALDFE

SEQ ID NO: 46245 - protein, 25 aa, synthetic construct
  source 1..25: note = Seed: QTVHSIPLTINKEEALQRPVASDFE
QTVHSIPLTINKEFALWRAVAMDFE

SEQ ID NO: 46246 - protein, 25 aa, synthetic construct
  source 1..25: note = Seed: QTVHSIPLTINKEEALQRPVASDFE
QTVHSIPLTINKEFALWRAVANDFE

SEQ ID NO: 46247 - protein, 25 aa, synthetic construct
  source 1..25: note = Seed: QTVHSIPLTINKEEALQRPVASDFE
QTVHSIPLTINKEFALWRAVAQDFE

SEQ ID NO: 46248 - protein, 25 aa, synthetic construct
  source 1..25: note = Seed: QTVHSIPLTINKEEALQRPVASDFE
QTVHSIPLTINKEFALWRAVASDFE

SEQ ID NO: 46249 - protein, 25 aa, synthetic construct
  source 1..25: note = Seed: QTVHSIPLTINKEEALQRPVASDFE
QTVHSIPLTINKEFALWRAVATDFE

SEQ ID NO: 46250 - protein, 25 aa, synthetic construct
  source 1..25: note = Seed: QTVHSIPLTINKEEALQRPVASDFE
QTVHSIPLTINKEFALWRAVAVDFE

SEQ ID NO: 46251 - protein, 25 aa, synthetic construct
  source 1..25: note = Seed: QTVHSIPLTINKEEALQRPVASDFE
QTVHSIPLTINKEFALWRGVAADFE

SEQ ID NO: 46252 - protein, 25 aa, synthetic construct
  source 1..25: note = Seed: QTVHSIPLTINKEEALQRPVASDFE
QTVHSIPLTINKEFALWRIVANDFE

SEQ ID NO: 46253 - protein, 25 aa, synthetic construct
  source 1..25: note = Seed: QTVHSIPLTINKEEALQRPVASDFE
QTVHSIPLTINKEFALWRNVAADFE

SEQ ID NO: 46254 - protein, 25 aa, synthetic construct
  source 1..25: note = Seed: QTVHSIPLTINKEEALQRPVASDFE
QTVHSIPLTINKEFALWRPVAADFE

SEQ ID NO: 46255 - protein, 25 aa, synthetic construct
  source 1..25: note = Seed: QTVHSIPLTINKEEALQRPVASDFE
QTVHSIPLTINKEFALWRPVAIDFE

SEQ ID NO: 46256 - protein, 25 aa, synthetic construct
  source 1..25: note = Seed: QTVHSIPLTINKEEALQRPVASDFE
QTVHSIPLTINKEFALWRPVAMDFE

SEQ ID NO: 46257 - protein, 25 aa, synthetic construct
  source 1..25: note = Seed: QTVHSIPLTINKEEALQRPVASDFE
QTVHSIPLTINKEFALWRPVANDFE

SEQ ID NO: 46258 - protein, 25 aa, synthetic construct
  source 1..25: note = Seed: QTVHSIPLTINKEEALQRPVASDFE
QTVHSIPLTINKEFALWRPVASDFE

SEQ ID NO: 46259 - protein, 25 aa, synthetic construct
  source 1..25: note = Seed: QTVHSIPLTINKEEALQRPVASDFE
QTVHSIPLTINKEFALWRPVATDFE

SEQ ID NO: 46260 - protein, 25 aa, synthetic construct
  source 1..25: note = Seed: QTVHSIPLTINKEEALQRPVASDFE
QTVHSIPLTINKEFALWRPVAVDFE

SEQ ID NO: 46261 - protein, 25 aa, synthetic construct
  source 1..25: note = Seed: QTVHSIPLTINKEEALQRPVASDFE
QTVHSIPLTINKEFALWRSVAADFE

SEQ ID NO: 46262 - protein, 25 aa, synthetic construct
  source 1..25: note = Seed: QTVHSIPLTINKEEALQRPVASDFE
QTVHSIPLTINKEFALWRSVANDFE

SEQ ID NO: 46263 - protein, 25 aa, synthetic construct
  source 1..25: note = Seed: QTVHSIPLTINKEEALQRPVASDFE
QTVHSIPLTINKEFALWRSVASDFE

SEQ ID NO: 46264 - protein, 25 aa, synthetic construct
  source 1..25: note = Seed: QTVHSIPLTINKEEALQRPVASDFE
QTVHSIPLTINKEFALWRSVATDFE

SEQ ID NO: 46265 - protein, 25 aa, synthetic construct
  source 1..25: note = Seed: QTVHSIPLTINKEEALQRPVASDFE
QTVHSIPLTINKEFALWRSVAVDFE

SEQ ID NO: 46266 - protein, 25 aa, synthetic construct
  source 1..25: note = Seed: QTVHSIPLTINKEEALQRPVASDFE
QTVHSIPLTINKEFALWRTVAADFE

SEQ ID NO: 46267 - protein, 25 aa, synthetic construct
  source 1..25: note = Seed: QTVHSIPLTINKEEALQRPVASDFE
QTVHSIPLTINKEFALWRTVANDFE

SEQ ID NO: 46268 - protein, 25 aa, synthetic construct
  source 1..25: note = Seed: QTVHSIPLTINKEEALQRPVASDFE
QTVHSIPLTINKEFALWRTVASDFE

SEQ ID NO: 46269 - protein, 25 aa, synthetic construct
  source 1..25: note = Seed: QTVHSIPLTINKEEALQRPVASDFE
QTVHSIPLTINKEFALWRTVATDFE

SEQ ID NO: 46270 - protein, 25 aa, synthetic construct
  source 1..25: note = Seed: QTVHSIPLTINKEEALQRPVASDFE
QTVHSIPLTINKEFALWRTVAVDFE

SEQ ID NO: 46271 - protein, 25 aa, synthetic construct
  source 1..25: note = Seed: QTVHSIPLTINKEEALQRPVASDFE
QTVHSIPLTINKEFALWRVVAADFE

SEQ ID NO: 46272 - protein, 25 aa, synthetic construct
  source 1..25: note = Seed: QTVHSIPLTINKEEALQRPVASDFE
QTVHSIPLTINKEFALWRVVAHDFE

SEQ ID NO: 46273 - protein, 25 aa, synthetic construct
  source 1..25: note = Seed: QTVHSIPLTINKEEALQRPVASDFE
QTVHSIPLTINKEFALWRVVANDFE

SEQ ID NO: 46274 - protein, 25 aa, synthetic construct
  source 1..25: note = Seed: QTVHSIPLTINKEEALQRPVASDFE
QTVHSIPLTINKEFALWRVVASDFE

SEQ ID NO: 46275 - protein, 25 aa, synthetic construct
  source 1..25: note = Seed: QTVHSIPLTINKEEALQRPVASDFE
QTVHSIPLTINKEFALYRAVAADFE

SEQ ID NO: 46276 - protein, 25 aa, synthetic construct
  source 1..25: note = Seed: QTVHSIPLTINKEEALQRPVASDFE
QTVHSIPLTINKEFALYRAVANDFE

SEQ ID NO: 46277 - protein, 25 aa, synthetic construct
  source 1..25: note = Seed: QTVHSIPLTINKEEALQRPVASDFE
QTVHSIPLTINKEFALYRAVASDFE

SEQ ID NO: 46278 - protein, 25 aa, synthetic construct
  source 1..25: note = Seed: QTVHSIPLTINKEEALQRPVASDFE
QTVHSIPLTINKEFALYRPVAADFE

SEQ ID NO: 46279 - protein, 25 aa, synthetic construct
  source 1..25: note = Seed: QTVHSIPLTINKEEALQRPVASDFE
QTVHSIPLTINKEFALYRPVANDFE

SEQ ID NO: 46280 - protein, 25 aa, synthetic construct
  source 1..25: note = Seed: QTVHSIPLTINKEEALQRPVASDFE
QTVHSIPLTINKEFALYRSVAADFE

SEQ ID NO: 46281 - protein, 25 aa, synthetic construct
  source 1..25: note = Seed: QTVHSIPLTINKEEALQRPVASDFE
QTVHSIPLTINKEFALYRTVAADFE

SEQ ID NO: 46282 - protein, 25 aa, synthetic construct
  source 1..25: note = Seed: QTVHSIPLTINKEEALQRPVASDFE
QTVHSIPLTINKEFALYRTVANDFE

SEQ ID NO: 46283 - protein, 25 aa, synthetic construct
  source 1..25: note = Seed: QTVHSIPLTINKEEALQRPVASDFE
QTVHSIPLTINKEIALARAVAADFE

SEQ ID NO: 46284 - protein, 25 aa, synthetic construct
  source 1..25: note = Seed: QTVHSIPLTINKEEALQRPVASDFE
QTVHSIPLTINKEIALARAVAGDFE

SEQ ID NO: 46285 - protein, 25 aa, synthetic construct
  source 1..25: note = Seed: QTVHSIPLTINKEEALQRPVASDFE
QTVHSIPLTINKEIALARAVAHDFE

SEQ ID NO: 46286 - protein, 25 aa, synthetic construct
  source 1..25: note = Seed: QTVHSIPLTINKEEALQRPVASDFE
QTVHSIPLTINKEIALARAVAIDFE

SEQ ID NO: 46287 - protein, 25 aa, synthetic construct
  source 1..25: note = Seed: QTVHSIPLTINKEEALQRPVASDFE
QTVHSIPLTINKEIALARAVALDFE

SEQ ID NO: 46288 - protein, 25 aa, synthetic construct
  source 1..25: note = Seed: QTVHSIPLTINKEEALQRPVASDFE
QTVHSIPLTINKEIALARAVAMDFE

SEQ ID NO: 46289 - protein, 25 aa, synthetic construct
  source 1..25: note = Seed: QTVHSIPLTINKEEALQRPVASDFE
QTVHSIPLTINKEIALARAVANDFE

SEQ ID NO: 46290 - protein, 25 aa, synthetic construct
  source 1..25: note = Seed: QTVHSIPLTINKEEALQRPVASDFE
QTVHSIPLTINKEIALARAVAQDFE

SEQ ID NO: 46291 - protein, 25 aa, synthetic construct
  source 1..25: note = Seed: QTVHSIPLTINKEEALQRPVASDFE
QTVHSIPLTINKEIALARAVASDFE

SEQ ID NO: 46292 - protein, 25 aa, synthetic construct
  source 1..25: note = Seed: QTVHSIPLTINKEEALQRPVASDFE
QTVHSIPLTINKEIALARAVATDFE

SEQ ID NO: 46293 - protein, 25 aa, synthetic construct
  source 1..25: note = Seed: QTVHSIPLTINKEEALQRPVASDFE
QTVHSIPLTINKEIALARAVAVDFE

SEQ ID NO: 46294 - protein, 25 aa, synthetic construct
  source 1..25: note = Seed: QTVHSIPLTINKEEALQRPVASDFE
QTVHSIPLTINKEIALARGVAADFE

SEQ ID NO: 46295 - protein, 25 aa, synthetic construct
  source 1..25: note = Seed: QTVHSIPLTINKEEALQRPVASDFE
QTVHSIPLTINKEIALARGVANDFE

SEQ ID NO: 46296 - protein, 25 aa, synthetic construct
  source 1..25: note = Seed: QTVHSIPLTINKEEALQRPVASDFE
QTVHSIPLTINKEIALARGVASDFE

SEQ ID NO: 46297 - protein, 25 aa, synthetic construct
  source 1..25: note = Seed: QTVHSIPLTINKEEALQRPVASDFE
QTVHSIPLTINKEIALARGVAVDFE

SEQ ID NO: 46298 - protein, 25 aa, synthetic construct
  source 1..25: note = Seed: QTVHSIPLTINKEEALQRPVASDFE
QTVHSIPLTINKEIALARIVAADFE

SEQ ID NO: 46299 - protein, 25 aa, synthetic construct
  source 1..25: note = Seed: QTVHSIPLTINKEEALQRPVASDFE
QTVHSIPLTINKEIALARIVANDFE

SEQ ID NO: 46300 - protein, 25 aa, synthetic construct
  source 1..25: note = Seed: QTVHSIPLTINKEEALQRPVASDFE
QTVHSIPLTINKEIALARIVASDFE

SEQ ID NO: 46301 - protein, 25 aa, synthetic construct
  source 1..25: note = Seed: QTVHSIPLTINKEEALQRPVASDFE
QTVHSIPLTINKEIALARNVAADFE

SEQ ID NO: 46302 - protein, 25 aa, synthetic construct
  source 1..25: note = Seed: QTVHSIPLTINKEEALQRPVASDFE
QTVHSIPLTINKEIALARNVANDFE

SEQ ID NO: 46303 - protein, 25 aa, synthetic construct
  source 1..25: note = Seed: QTVHSIPLTINKEEALQRPVASDFE
QTVHSIPLTINKEIALARNVASDFE

SEQ ID NO: 46304 - protein, 25 aa, synthetic construct
  source 1..25: note = Seed: QTVHSIPLTINKEEALQRPVASDFE
QTVHSIPLTINKEIALARPVAADFE

SEQ ID NO: 46305 - protein, 25 aa, synthetic construct
  source 1..25: note = Seed: QTVHSIPLTINKEEALQRPVASDFE
QTVHSIPLTINKEIALARPVAGDFE

SEQ ID NO: 46306 - protein, 25 aa, synthetic construct
  source 1..25: note = Seed: QTVHSIPLTINKEEALQRPVASDFE
QTVHSIPLTINKEIALARPVAHDFE

SEQ ID NO: 46307 - protein, 25 aa, synthetic construct
  source 1..25: note = Seed: QTVHSIPLTINKEEALQRPVASDFE
QTVHSIPLTINKEIALARPVAIDFE

SEQ ID NO: 46308 - protein, 25 aa, synthetic construct
  source 1..25: note = Seed: QTVHSIPLTINKEEALQRPVASDFE
QTVHSIPLTINKEIALARPVALDFE

SEQ ID NO: 46309 - protein, 25 aa, synthetic construct
  source 1..25: note = Seed: QTVHSIPLTINKEEALQRPVASDFE
QTVHSIPLTINKEIALARPVAMDFE

SEQ ID NO: 46310 - protein, 25 aa, synthetic construct
  source 1..25: note = Seed: QTVHSIPLTINKEEALQRPVASDFE
QTVHSIPLTINKEIALARPVANDFE

SEQ ID NO: 46311 - protein, 25 aa, synthetic construct
  source 1..25: note = Seed: QTVHSIPLTINKEEALQRPVASDFE
QTVHSIPLTINKEIALARPVAQDFE

SEQ ID NO: 46312 - protein, 25 aa, synthetic construct
  source 1..25: note = Seed: QTVHSIPLTINKEEALQRPVASDFE
QTVHSIPLTINKEIALARPVASDFE

SEQ ID NO: 46313 - protein, 25 aa, synthetic construct
  source 1..25: note = Seed: QTVHSIPLTINKEEALQRPVASDFE
QTVHSIPLTINKEIALARPVATDFE

SEQ ID NO: 46314 - protein, 25 aa, synthetic construct
  source 1..25: note = Seed: QTVHSIPLTINKEEALQRPVASDFE
QTVHSIPLTINKEIALARPVAVDFE

SEQ ID NO: 46315 - protein, 25 aa, synthetic construct
  source 1..25: note = Seed: QTVHSIPLTINKEEALQRPVASDFE
QTVHSIPLTINKEIALARSVAADFE

SEQ ID NO: 46316 - protein, 25 aa, synthetic construct
  source 1..25: note = Seed: QTVHSIPLTINKEEALQRPVASDFE
QTVHSIPLTINKEIALARSVAGDFE

SEQ ID NO: 46317 - protein, 25 aa, synthetic construct
  source 1..25: note = Seed: QTVHSIPLTINKEEALQRPVASDFE
QTVHSIPLTINKEIALARSVAHDFE

SEQ ID NO: 46318 - protein, 25 aa, synthetic construct
  source 1..25: note = Seed: QTVHSIPLTINKEEALQRPVASDFE
QTVHSIPLTINKEIALARSVAIDFE

SEQ ID NO: 46319 - protein, 25 aa, synthetic construct
  source 1..25: note = Seed: QTVHSIPLTINKEEALQRPVASDFE
QTVHSIPLTINKEIALARSVAMDFE

SEQ ID NO: 46320 - protein, 25 aa, synthetic construct
  source 1..25: note = Seed: QTVHSIPLTINKEEALQRPVASDFE
QTVHSIPLTINKEIALARSVANDFE

SEQ ID NO: 46321 - protein, 25 aa, synthetic construct
  source 1..25: note = Seed: QTVHSIPLTINKEEALQRPVASDFE
QTVHSIPLTINKEIALARSVASDFE

SEQ ID NO: 46322 - protein, 25 aa, synthetic construct
  source 1..25: note = Seed: QTVHSIPLTINKEEALQRPVASDFE
QTVHSIPLTINKEIALARSVATDFE

SEQ ID NO: 46323 - protein, 25 aa, synthetic construct
  source 1..25: note = Seed: QTVHSIPLTINKEEALQRPVASDFE
QTVHSIPLTINKEIALARSVAVDFE

SEQ ID NO: 46324 - protein, 25 aa, synthetic construct
  source 1..25: note = Seed: QTVHSIPLTINKEEALQRPVASDFE
QTVHSIPLTINKEIALARTVAADFE

SEQ ID NO: 46325 - protein, 25 aa, synthetic construct
  source 1..25: note = Seed: QTVHSIPLTINKEEALQRPVASDFE
QTVHSIPLTINKEIALARTVAGDFE

SEQ ID NO: 46326 - protein, 25 aa, synthetic construct
  source 1..25: note = Seed: QTVHSIPLTINKEEALQRPVASDFE
QTVHSIPLTINKEIALARTVAHDFE

SEQ ID NO: 46327 - protein, 25 aa, synthetic construct
  source 1..25: note = Seed: QTVHSIPLTINKEEALQRPVASDFE
QTVHSIPLTINKEIALARTVAIDFE

SEQ ID NO: 46328 - protein, 25 aa, synthetic construct
  source 1..25: note = Seed: QTVHSIPLTINKEEALQRPVASDFE
QTVHSIPLTINKEIALARTVALDFE

SEQ ID NO: 46329 - protein, 25 aa, synthetic construct
  source 1..25: note = Seed: QTVHSIPLTINKEEALQRPVASDFE
QTVHSIPLTINKEIALARTVAMDFE

SEQ ID NO: 46330 - protein, 25 aa, synthetic construct
  source 1..25: note = Seed: QTVHSIPLTINKEEALQRPVASDFE
QTVHSIPLTINKEIALARTVANDFE

SEQ ID NO: 46331 - protein, 25 aa, synthetic construct
  source 1..25: note = Seed: QTVHSIPLTINKEEALQRPVASDFE
QTVHSIPLTINKEIALARTVASDFE

SEQ ID NO: 46332 - protein, 25 aa, synthetic construct
  source 1..25: note = Seed: QTVHSIPLTINKEEALQRPVASDFE
QTVHSIPLTINKEIALARTVATDFE

SEQ ID NO: 46333 - protein, 25 aa, synthetic construct
  source 1..25: note = Seed: QTVHSIPLTINKEEALQRPVASDFE
QTVHSIPLTINKEIALARTVAVDFE

SEQ ID NO: 46334 - protein, 25 aa, synthetic construct
  source 1..25: note = Seed: QTVHSIPLTINKEEALQRPVASDFE
QTVHSIPLTINKEIALARVVAADFE

SEQ ID NO: 46335 - protein, 25 aa, synthetic construct
  source 1..25: note = Seed: QTVHSIPLTINKEEALQRPVASDFE
QTVHSIPLTINKEIALARVVAHDFE

SEQ ID NO: 46336 - protein, 25 aa, synthetic construct
  source 1..25: note = Seed: QTVHSIPLTINKEEALQRPVASDFE
QTVHSIPLTINKEIALARVVANDFE

SEQ ID NO: 46337 - protein, 25 aa, synthetic construct
  source 1..25: note = Seed: QTVHSIPLTINKEEALQRPVASDFE
QTVHSIPLTINKEIALARVVASDFE

SEQ ID NO: 46338 - protein, 25 aa, synthetic construct
  source 1..25: note = Seed: QTVHSIPLTINKEEALQRPVASDFE
QTVHSIPLTINKEIALARVVATDFE

SEQ ID NO: 46339 - protein, 25 aa, synthetic construct
  source 1..25: note = Seed: QTVHSIPLTINKEEALQRPVASDFE
QTVHSIPLTINKEIALERAVAADFE

SEQ ID NO: 46340 - protein, 25 aa, synthetic construct
  source 1..25: note = Seed: QTVHSIPLTINKEEALQRPVASDFE
QTVHSIPLTINKEIALERAVANDFE

SEQ ID NO: 46341 - protein, 25 aa, synthetic construct
  source 1..25: note = Seed: QTVHSIPLTINKEEALQRPVASDFE
QTVHSIPLTINKEIALERAVASDFE

SEQ ID NO: 46342 - protein, 25 aa, synthetic construct
  source 1..25: note = Seed: QTVHSIPLTINKEEALQRPVASDFE
QTVHSIPLTINKEIALFRAVAADFE

SEQ ID NO: 46343 - protein, 25 aa, synthetic construct
  source 1..25: note = Seed: QTVHSIPLTINKEEALQRPVASDFE
QTVHSIPLTINKEIALFRPVAADFE

SEQ ID NO: 46344 - protein, 25 aa, synthetic construct
  source 1..25: note = Seed: QTVHSIPLTINKEEALQRPVASDFE
QTVHSIPLTINKEIALFRPVANDFE

SEQ ID NO: 46345 - protein, 25 aa, synthetic construct
  source 1..25: note = Seed: QTVHSIPLTINKEEALQRPVASDFE
QTVHSIPLTINKEIALFRPVASDFE

SEQ ID NO: 46346 - protein, 25 aa, synthetic construct
  source 1..25: note = Seed: QTVHSIPLTINKEEALQRPVASDFE
QTVHSIPLTINKEIALIRAVAADFE

SEQ ID NO: 46347 - protein, 25 aa, synthetic construct
  source 1..25: note = Seed: QTVHSIPLTINKEEALQRPVASDFE
QTVHSIPLTINKEIALIRAVAGDFE

SEQ ID NO: 46348 - protein, 25 aa, synthetic construct
  source 1..25: note = Seed: QTVHSIPLTINKEEALQRPVASDFE
QTVHSIPLTINKEIALIRAVAHDFE

SEQ ID NO: 46349 - protein, 25 aa, synthetic construct
  source 1..25: note = Seed: QTVHSIPLTINKEEALQRPVASDFE
QTVHSIPLTINKEIALIRAVANDFE

SEQ ID NO: 46350 - protein, 25 aa, synthetic construct
  source 1..25: note = Seed: QTVHSIPLTINKEEALQRPVASDFE
QTVHSIPLTINKEIALIRAVASDFE

SEQ ID NO: 46351 - protein, 25 aa, synthetic construct
  source 1..25: note = Seed: QTVHSIPLTINKEEALQRPVASDFE
QTVHSIPLTINKEIALIRAVATDFE

SEQ ID NO: 46352 - protein, 25 aa, synthetic construct
  source 1..25: note = Seed: QTVHSIPLTINKEEALQRPVASDFE
QTVHSIPLTINKEIALIRAVAVDFE

SEQ ID NO: 46353 - protein, 25 aa, synthetic construct
  source 1..25: note = Seed: QTVHSIPLTINKEEALQRPVASDFE
QTVHSIPLTINKEIALIRGVAADFE

SEQ ID NO: 46354 - protein, 25 aa, synthetic construct
  source 1..25: note = Seed: QTVHSIPLTINKEEALQRPVASDFE
QTVHSIPLTINKEIALIRGVANDFE

SEQ ID NO: 46355 - protein, 25 aa, synthetic construct
  source 1..25: note = Seed: QTVHSIPLTINKEEALQRPVASDFE
QTVHSIPLTINKEIALIRGVASDFE

SEQ ID NO: 46356 - protein, 25 aa, synthetic construct
  source 1..25: note = Seed: QTVHSIPLTINKEEALQRPVASDFE
QTVHSIPLTINKEIALIRNVAADFE

SEQ ID NO: 46357 - protein, 25 aa, synthetic construct
  source 1..25: note = Seed: QTVHSIPLTINKEEALQRPVASDFE
QTVHSIPLTINKEIALIRNVANDFE

SEQ ID NO: 46358 - protein, 25 aa, synthetic construct
  source 1..25: note = Seed: QTVHSIPLTINKEEALQRPVASDFE
QTVHSIPLTINKEIALIRNVASDFE

SEQ ID NO: 46359 - protein, 25 aa, synthetic construct
  source 1..25: note = Seed: QTVHSIPLTINKEEALQRPVASDFE
QTVHSIPLTINKEIALIRPVAADFE

SEQ ID NO: 46360 - protein, 25 aa, synthetic construct
  source 1..25: note = Seed: QTVHSIPLTINKEEALQRPVASDFE
QTVHSIPLTINKEIALIRPVAGDFE

SEQ ID NO: 46361 - protein, 25 aa, synthetic construct
  source 1..25: note = Seed: QTVHSIPLTINKEEALQRPVASDFE
QTVHSIPLTINKEIALIRPVAHDFE

SEQ ID NO: 46362 - protein, 25 aa, synthetic construct
  source 1..25: note = Seed: QTVHSIPLTINKEEALQRPVASDFE
QTVHSIPLTINKEIALIRPVAIDFE

SEQ ID NO: 46363 - protein, 25 aa, synthetic construct
  source 1..25: note = Seed: QTVHSIPLTINKEEALQRPVASDFE
QTVHSIPLTINKEIALIRPVALDFE

SEQ ID NO: 46364 - protein, 25 aa, synthetic construct
  source 1..25: note = Seed: QTVHSIPLTINKEEALQRPVASDFE
QTVHSIPLTINKEIALIRPVAMDFE

SEQ ID NO: 46365 - protein, 25 aa, synthetic construct
  source 1..25: note = Seed: QTVHSIPLTINKEEALQRPVASDFE
QTVHSIPLTINKEIALIRPVANDFE

SEQ ID NO: 46366 - protein, 25 aa, synthetic construct
  source 1..25: note = Seed: QTVHSIPLTINKEEALQRPVASDFE
QTVHSIPLTINKEIALIRPVAQDFE

SEQ ID NO: 46367 - protein, 25 aa, synthetic construct
  source 1..25: note = Seed: QTVHSIPLTINKEEALQRPVASDFE
QTVHSIPLTINKEIALIRPVASDFE

SEQ ID NO: 46368 - protein, 25 aa, synthetic construct
  source 1..25: note = Seed: QTVHSIPLTINKEEALQRPVASDFE
QTVHSIPLTINKEIALIRPVATDFE

SEQ ID NO: 46369 - protein, 25 aa, synthetic construct
  source 1..25: note = Seed: QTVHSIPLTINKEEALQRPVASDFE
QTVHSIPLTINKEIALIRPVAVDFE

SEQ ID NO: 46370 - protein, 25 aa, synthetic construct
  source 1..25: note = Seed: QTVHSIPLTINKEEALQRPVASDFE
QTVHSIPLTINKEIALIRSVAADFE

SEQ ID NO: 46371 - protein, 25 aa, synthetic construct
  source 1..25: note = Seed: QTVHSIPLTINKEEALQRPVASDFE
QTVHSIPLTINKEIALIRSVAGDFE

SEQ ID NO: 46372 - protein, 25 aa, synthetic construct
  source 1..25: note = Seed: QTVHSIPLTINKEEALQRPVASDFE
QTVHSIPLTINKEIALIRSVAHDFE

SEQ ID NO: 46373 - protein, 25 aa, synthetic construct
  source 1..25: note = Seed: QTVHSIPLTINKEEALQRPVASDFE
QTVHSIPLTINKEIALIRSVANDFE

SEQ ID NO: 46374 - protein, 25 aa, synthetic construct
  source 1..25: note = Seed: QTVHSIPLTINKEEALQRPVASDFE
QTVHSIPLTINKEIALIRSVASDFE

SEQ ID NO: 46375 - protein, 25 aa, synthetic construct
  source 1..25: note = Seed: QTVHSIPLTINKEEALQRPVASDFE
QTVHSIPLTINKEIALIRSVATDFE

SEQ ID NO: 46376 - protein, 25 aa, synthetic construct
  source 1..25: note = Seed: QTVHSIPLTINKEEALQRPVASDFE
QTVHSIPLTINKEIALIRTVAADFE

SEQ ID NO: 46377 - protein, 25 aa, synthetic construct
  source 1..25: note = Seed: QTVHSIPLTINKEEALQRPVASDFE
QTVHSIPLTINKEIALIRTVAGDFE

SEQ ID NO: 46378 - protein, 25 aa, synthetic construct
  source 1..25: note = Seed: QTVHSIPLTINKEEALQRPVASDFE
QTVHSIPLTINKEIALIRTVAHDFE

SEQ ID NO: 46379 - protein, 25 aa, synthetic construct
  source 1..25: note = Seed: QTVHSIPLTINKEEALQRPVASDFE
QTVHSIPLTINKEIALIRTVANDFE

SEQ ID NO: 46380 - protein, 25 aa, synthetic construct
  source 1..25: note = Seed: QTVHSIPLTINKEEALQRPVASDFE
QTVHSIPLTINKEIALIRTVASDFE

SEQ ID NO: 46381 - protein, 25 aa, synthetic construct
  source 1..25: note = Seed: QTVHSIPLTINKEEALQRPVASDFE
QTVHSIPLTINKEIALIRTVATDFE

SEQ ID NO: 46382 - protein, 25 aa, synthetic construct
  source 1..25: note = Seed: QTVHSIPLTINKEEALQRPVASDFE
QTVHSIPLTINKEIALIRVVANDFE

SEQ ID NO: 46383 - protein, 25 aa, synthetic construct
  source 1..25: note = Seed: QTVHSIPLTINKEEALQRPVASDFE
QTVHSIPLTINKEIALLRAVAADFE

SEQ ID NO: 46384 - protein, 25 aa, synthetic construct
  source 1..25: note = Seed: QTVHSIPLTINKEEALQRPVASDFE
QTVHSIPLTINKEIALLRAVADDFE

SEQ ID NO: 46385 - protein, 25 aa, synthetic construct
  source 1..25: note = Seed: QTVHSIPLTINKEEALQRPVASDFE
QTVHSIPLTINKEIALLRAVAGDFE

SEQ ID NO: 46386 - protein, 25 aa, synthetic construct
  source 1..25: note = Seed: QTVHSIPLTINKEEALQRPVASDFE
QTVHSIPLTINKEIALLRAVAHDFE

SEQ ID NO: 46387 - protein, 25 aa, synthetic construct
  source 1..25: note = Seed: QTVHSIPLTINKEEALQRPVASDFE
QTVHSIPLTINKEIALLRAVAIDFE

SEQ ID NO: 46388 - protein, 25 aa, synthetic construct
  source 1..25: note = Seed: QTVHSIPLTINKEEALQRPVASDFE
QTVHSIPLTINKEIALLRAVAMDFE

SEQ ID NO: 46389 - protein, 25 aa, synthetic construct
  source 1..25: note = Seed: QTVHSIPLTINKEEALQRPVASDFE
QTVHSIPLTINKEIALLRAVANDFE

SEQ ID NO: 46390 - protein, 25 aa, synthetic construct
  source 1..25: note = Seed: QTVHSIPLTINKEEALQRPVASDFE
QTVHSIPLTINKEIALLRAVAQDFE

SEQ ID NO: 46391 - protein, 25 aa, synthetic construct
  source 1..25: note = Seed: QTVHSIPLTINKEEALQRPVASDFE
QTVHSIPLTINKEIALLRAVASDFE

SEQ ID NO: 46392 - protein, 25 aa, synthetic construct
  source 1..25: note = Seed: QTVHSIPLTINKEEALQRPVASDFE
QTVHSIPLTINKEIALLRAVATDFE

SEQ ID NO: 46393 - protein, 25 aa, synthetic construct
  source 1..25: note = Seed: QTVHSIPLTINKEEALQRPVASDFE
QTVHSIPLTINKEIALLRAVAVDFE

SEQ ID NO: 46394 - protein, 25 aa, synthetic construct
  source 1..25: note = Seed: QTVHSIPLTINKEEALQRPVASDFE
QTVHSIPLTINKEIALLRGVAADFE

SEQ ID NO: 46395 - protein, 25 aa, synthetic construct
  source 1..25: note = Seed: QTVHSIPLTINKEEALQRPVASDFE
QTVHSIPLTINKEIALLRGVAHDFE

SEQ ID NO: 46396 - protein, 25 aa, synthetic construct
  source 1..25: note = Seed: QTVHSIPLTINKEEALQRPVASDFE
QTVHSIPLTINKEIALLRGVANDFE

SEQ ID NO: 46397 - protein, 25 aa, synthetic construct
  source 1..25: note = Seed: QTVHSIPLTINKEEALQRPVASDFE
QTVHSIPLTINKEIALLRGVASDFE

SEQ ID NO: 46398 - protein, 25 aa, synthetic construct
  source 1..25: note = Seed: QTVHSIPLTINKEEALQRPVASDFE
QTVHSIPLTINKEIALLRGVATDFE

SEQ ID NO: 46399 - protein, 25 aa, synthetic construct
  source 1..25: note = Seed: QTVHSIPLTINKEEALQRPVASDFE
QTVHSIPLTINKEIALLRGVAVDFE

SEQ ID NO: 46400 - protein, 25 aa, synthetic construct
  source 1..25: note = Seed: QTVHSIPLTINKEEALQRPVASDFE
QTVHSIPLTINKEIALLRIVANDFE

SEQ ID NO: 46401 - protein, 25 aa, synthetic construct
  source 1..25: note = Seed: QTVHSIPLTINKEEALQRPVASDFE
QTVHSIPLTINKEIALLRNVAADFE

SEQ ID NO: 46402 - protein, 25 aa, synthetic construct
  source 1..25: note = Seed: QTVHSIPLTINKEEALQRPVASDFE
QTVHSIPLTINKEIALLRNVAHDFE

SEQ ID NO: 46403 - protein, 25 aa, synthetic construct
  source 1..25: note = Seed: QTVHSIPLTINKEEALQRPVASDFE
QTVHSIPLTINKEIALLRNVANDFE

SEQ ID NO: 46404 - protein, 25 aa, synthetic construct
  source 1..25: note = Seed: QTVHSIPLTINKEEALQRPVASDFE
QTVHSIPLTINKEIALLRNVASDFE

SEQ ID NO: 46405 - protein, 25 aa, synthetic construct
  source 1..25: note = Seed: QTVHSIPLTINKEEALQRPVASDFE
QTVHSIPLTINKEIALLRNVATDFE

SEQ ID NO: 46406 - protein, 25 aa, synthetic construct
  source 1..25: note = Seed: QTVHSIPLTINKEEALQRPVASDFE
QTVHSIPLTINKEIALLRNVAVDFE

SEQ ID NO: 46407 - protein, 25 aa, synthetic construct
  source 1..25: note = Seed: QTVHSIPLTINKEEALQRPVASDFE
QTVHSIPLTINKEIALLRPVAADFE

SEQ ID NO: 46408 - protein, 25 aa, synthetic construct
  source 1..25: note = Seed: QTVHSIPLTINKEEALQRPVASDFE
QTVHSIPLTINKEIALLRPVADDFE

SEQ ID NO: 46409 - protein, 25 aa, synthetic construct
  source 1..25: note = Seed: QTVHSIPLTINKEEALQRPVASDFE
QTVHSIPLTINKEIALLRPVAGDFE

SEQ ID NO: 46410 - protein, 25 aa, synthetic construct
  source 1..25: note = Seed: QTVHSIPLTINKEEALQRPVASDFE
QTVHSIPLTINKEIALLRPVAHDFE

SEQ ID NO: 46411 - protein, 25 aa, synthetic construct
  source 1..25: note = Seed: QTVHSIPLTINKEEALQRPVASDFE
QTVHSIPLTINKEIALLRPVAIDFE

SEQ ID NO: 46412 - protein, 25 aa, synthetic construct
  source 1..25: note = Seed: QTVHSIPLTINKEEALQRPVASDFE
QTVHSIPLTINKEIALLRPVALDFE

SEQ ID NO: 46413 - protein, 25 aa, synthetic construct
  source 1..25: note = Seed: QTVHSIPLTINKEEALQRPVASDFE
QTVHSIPLTINKEIALLRPVAMDFE

SEQ ID NO: 46414 - protein, 25 aa, synthetic construct
  source 1..25: note = Seed: QTVHSIPLTINKEEALQRPVASDFE
QTVHSIPLTINKEIALLRPVANDFE

SEQ ID NO: 46415 - protein, 25 aa, synthetic construct
  source 1..25: note = Seed: QTVHSIPLTINKEEALQRPVASDFE
QTVHSIPLTINKEIALLRPVAQDFE

SEQ ID NO: 46416 - protein, 25 aa, synthetic construct
  source 1..25: note = Seed: QTVHSIPLTINKEEALQRPVASDFE
QTVHSIPLTINKEIALLRPVASDFE

SEQ ID NO: 46417 - protein, 25 aa, synthetic construct
  source 1..25: note = Seed: QTVHSIPLTINKEEALQRPVASDFE
QTVHSIPLTINKEIALLRPVATDFE

SEQ ID NO: 46418 - protein, 25 aa, synthetic construct
  source 1..25: note = Seed: QTVHSIPLTINKEEALQRPVASDFE
QTVHSIPLTINKEIALLRPVAVDFE

SEQ ID NO: 46419 - protein, 25 aa, synthetic construct
  source 1..25: note = Seed: QTVHSIPLTINKEEALQRPVASDFE
QTVHSIPLTINKEIALLRSVAADFE

SEQ ID NO: 46420 - protein, 25 aa, synthetic construct
  source 1..25: note = Seed: QTVHSIPLTINKEEALQRPVASDFE
QTVHSIPLTINKEIALLRSVAGDFE

SEQ ID NO: 46421 - protein, 25 aa, synthetic construct
  source 1..25: note = Seed: QTVHSIPLTINKEEALQRPVASDFE
QTVHSIPLTINKEIALLRSVAHDFE

SEQ ID NO: 46422 - protein, 25 aa, synthetic construct
  source 1..25: note = Seed: QTVHSIPLTINKEEALQRPVASDFE
QTVHSIPLTINKEIALLRSVAMDFE

SEQ ID NO: 46423 - protein, 25 aa, synthetic construct
  source 1..25: note = Seed: QTVHSIPLTINKEEALQRPVASDFE
QTVHSIPLTINKEIALLRSVANDFE

SEQ ID NO: 46424 - protein, 25 aa, synthetic construct
  source 1..25: note = Seed: QTVHSIPLTINKEEALQRPVASDFE
QTVHSIPLTINKEIALLRSVASDFE

SEQ ID NO: 46425 - protein, 25 aa, synthetic construct
  source 1..25: note = Seed: QTVHSIPLTINKEEALQRPVASDFE
QTVHSIPLTINKEIALLRSVATDFE

SEQ ID NO: 46426 - protein, 25 aa, synthetic construct
  source 1..25: note = Seed: QTVHSIPLTINKEEALQRPVASDFE
QTVHSIPLTINKEIALLRSVAVDFE

SEQ ID NO: 46427 - protein, 25 aa, synthetic construct
  source 1..25: note = Seed: QTVHSIPLTINKEEALQRPVASDFE
QTVHSIPLTINKEIALLRTVAADFE

SEQ ID NO: 46428 - protein, 25 aa, synthetic construct
  source 1..25: note = Seed: QTVHSIPLTINKEEALQRPVASDFE
QTVHSIPLTINKEIALLRTVAGDFE

SEQ ID NO: 46429 - protein, 25 aa, synthetic construct
  source 1..25: note = Seed: QTVHSIPLTINKEEALQRPVASDFE
QTVHSIPLTINKEIALLRTVAHDFE

SEQ ID NO: 46430 - protein, 25 aa, synthetic construct
  source 1..25: note = Seed: QTVHSIPLTINKEEALQRPVASDFE
QTVHSIPLTINKEIALLRTVAIDFE

SEQ ID NO: 46431 - protein, 25 aa, synthetic construct
  source 1..25: note = Seed: QTVHSIPLTINKEEALQRPVASDFE
QTVHSIPLTINKEIALLRTVAMDFE

SEQ ID NO: 46432 - protein, 25 aa, synthetic construct
  source 1..25: note = Seed: QTVHSIPLTINKEEALQRPVASDFE
QTVHSIPLTINKEIALLRTVANDFE

SEQ ID NO: 46433 - protein, 25 aa, synthetic construct
  source 1..25: note = Seed: QTVHSIPLTINKEEALQRPVASDFE
QTVHSIPLTINKEIALLRTVAQDFE

SEQ ID NO: 46434 - protein, 25 aa, synthetic construct
  source 1..25: note = Seed: QTVHSIPLTINKEEALQRPVASDFE
QTVHSIPLTINKEIALLRTVASDFE

SEQ ID NO: 46435 - protein, 25 aa, synthetic construct
  source 1..25: note = Seed: QTVHSIPLTINKEEALQRPVASDFE
QTVHSIPLTINKEIALLRTVATDFE

SEQ ID NO: 46436 - protein, 25 aa, synthetic construct
  source 1..25: note = Seed: QTVHSIPLTINKEEALQRPVASDFE
QTVHSIPLTINKEIALLRTVAVDFE

SEQ ID NO: 46437 - protein, 25 aa, synthetic construct
  source 1..25: note = Seed: QTVHSIPLTINKEEALQRPVASDFE
QTVHSIPLTINKEIALLRVVAHDFE

SEQ ID NO: 46438 - protein, 25 aa, synthetic construct
  source 1..25: note = Seed: QTVHSIPLTINKEEALQRPVASDFE
QTVHSIPLTINKEIALLRVVANDFE

SEQ ID NO: 46439 - protein, 25 aa, synthetic construct
  source 1..25: note = Seed: QTVHSIPLTINKEEALQRPVASDFE
QTVHSIPLTINKEIALLRVVASDFE

SEQ ID NO: 46440 - protein, 25 aa, synthetic construct
  source 1..25: note = Seed: QTVHSIPLTINKEEALQRPVASDFE
QTVHSIPLTINKEIALMRAVAADFE

SEQ ID NO: 46441 - protein, 25 aa, synthetic construct
  source 1..25: note = Seed: QTVHSIPLTINKEEALQRPVASDFE
QTVHSIPLTINKEIALMRAVADDFE

SEQ ID NO: 46442 - protein, 25 aa, synthetic construct
  source 1..25: note = Seed: QTVHSIPLTINKEEALQRPVASDFE
QTVHSIPLTINKEIALMRAVAEDFE

SEQ ID NO: 46443 - protein, 25 aa, synthetic construct
  source 1..25: note = Seed: QTVHSIPLTINKEEALQRPVASDFE
QTVHSIPLTINKEIALMRAVAGDFE

SEQ ID NO: 46444 - protein, 25 aa, synthetic construct
  source 1..25: note = Seed: QTVHSIPLTINKEEALQRPVASDFE
QTVHSIPLTINKEIALMRAVAHDFE

SEQ ID NO: 46445 - protein, 25 aa, synthetic construct
  source 1..25: note = Seed: QTVHSIPLTINKEEALQRPVASDFE
QTVHSIPLTINKEIALMRAVAIDFE

SEQ ID NO: 46446 - protein, 25 aa, synthetic construct
  source 1..25: note = Seed: QTVHSIPLTINKEEALQRPVASDFE
QTVHSIPLTINKEIALMRAVALDFE

SEQ ID NO: 46447 - protein, 25 aa, synthetic construct
  source 1..25: note = Seed: QTVHSIPLTINKEEALQRPVASDFE
QTVHSIPLTINKEIALMRAVAMDFE

SEQ ID NO: 46448 - protein, 25 aa, synthetic construct
  source 1..25: note = Seed: QTVHSIPLTINKEEALQRPVASDFE
QTVHSIPLTINKEIALMRAVANDFE

SEQ ID NO: 46449 - protein, 25 aa, synthetic construct
  source 1..25: note = Seed: QTVHSIPLTINKEEALQRPVASDFE
QTVHSIPLTINKEIALMRAVAPDFE

SEQ ID NO: 46450 - protein, 25 aa, synthetic construct
  source 1..25: note = Seed: QTVHSIPLTINKEEALQRPVASDFE
QTVHSIPLTINKEIALMRAVAQDFE

SEQ ID NO: 46451 - protein, 25 aa, synthetic construct
  source 1..25: note = Seed: QTVHSIPLTINKEEALQRPVASDFE
QTVHSIPLTINKEIALMRAVASDFE

SEQ ID NO: 46452 - protein, 25 aa, synthetic construct
  source 1..25: note = Seed: QTVHSIPLTINKEEALQRPVASDFE
QTVHSIPLTINKEIALMRAVATDFE

SEQ ID NO: 46453 - protein, 25 aa, synthetic construct
  source 1..25: note = Seed: QTVHSIPLTINKEEALQRPVASDFE
QTVHSIPLTINKEIALMRAVAVDFE

SEQ ID NO: 46454 - protein, 25 aa, synthetic construct
  source 1..25: note = Seed: QTVHSIPLTINKEEALQRPVASDFE
QTVHSIPLTINKEIALMRGVAADFE

SEQ ID NO: 46455 - protein, 25 aa, synthetic construct
  source 1..25: note = Seed: QTVHSIPLTINKEEALQRPVASDFE
QTVHSIPLTINKEIALMRGVAGDFE

SEQ ID NO: 46456 - protein, 25 aa, synthetic construct
  source 1..25: note = Seed: QTVHSIPLTINKEEALQRPVASDFE
QTVHSIPLTINKEIALMRGVAHDFE

SEQ ID NO: 46457 - protein, 25 aa, synthetic construct
  source 1..25: note = Seed: QTVHSIPLTINKEEALQRPVASDFE
QTVHSIPLTINKEIALMRGVAIDFE

SEQ ID NO: 46458 - protein, 25 aa, synthetic construct
  source 1..25: note = Seed: QTVHSIPLTINKEEALQRPVASDFE
QTVHSIPLTINKEIALMRGVALDFE

SEQ ID NO: 46459 - protein, 25 aa, synthetic construct
  source 1..25: note = Seed: QTVHSIPLTINKEEALQRPVASDFE
QTVHSIPLTINKEIALMRGVAMDFE

SEQ ID NO: 46460 - protein, 25 aa, synthetic construct
  source 1..25: note = Seed: QTVHSIPLTINKEEALQRPVASDFE
QTVHSIPLTINKEIALMRGVANDFE

SEQ ID NO: 46461 - protein, 25 aa, synthetic construct
  source 1..25: note = Seed: QTVHSIPLTINKEEALQRPVASDFE
QTVHSIPLTINKEIALMRGVAQDFE

SEQ ID NO: 46462 - protein, 25 aa, synthetic construct
  source 1..25: note = Seed: QTVHSIPLTINKEEALQRPVASDFE
QTVHSIPLTINKEIALMRGVASDFE

SEQ ID NO: 46463 - protein, 25 aa, synthetic construct
  source 1..25: note = Seed: QTVHSIPLTINKEEALQRPVASDFE
QTVHSIPLTINKEIALMRGVATDFE

SEQ ID NO: 46464 - protein, 25 aa, synthetic construct
  source 1..25: note = Seed: QTVHSIPLTINKEEALQRPVASDFE
QTVHSIPLTINKEIALMRGVAVDFE

SEQ ID NO: 46465 - protein, 25 aa, synthetic construct
  source 1..25: note = Seed: QTVHSIPLTINKEEALQRPVASDFE
QTVHSIPLTINKEIALMRIVAADFE

SEQ ID NO: 46466 - protein, 25 aa, synthetic construct
  source 1..25: note = Seed: QTVHSIPLTINKEEALQRPVASDFE
QTVHSIPLTINKEIALMRIVAHDFE

SEQ ID NO: 46467 - protein, 25 aa, synthetic construct
  source 1..25: note = Seed: QTVHSIPLTINKEEALQRPVASDFE
QTVHSIPLTINKEIALMRIVANDFE

SEQ ID NO: 46468 - protein, 25 aa, synthetic construct
  source 1..25: note = Seed: QTVHSIPLTINKEEALQRPVASDFE
QTVHSIPLTINKEIALMRIVASDFE

SEQ ID NO: 46469 - protein, 25 aa, synthetic construct
  source 1..25: note = Seed: QTVHSIPLTINKEEALQRPVASDFE
QTVHSIPLTINKEIALMRNVAADFE

SEQ ID NO: 46470 - protein, 25 aa, synthetic construct
  source 1..25: note = Seed: QTVHSIPLTINKEEALQRPVASDFE
QTVHSIPLTINKEIALMRNVAGDFE

SEQ ID NO: 46471 - protein, 25 aa, synthetic construct
  source 1..25: note = Seed: QTVHSIPLTINKEEALQRPVASDFE
QTVHSIPLTINKEIALMRNVAHDFE

SEQ ID NO: 46472 - protein, 25 aa, synthetic construct
  source 1..25: note = Seed: QTVHSIPLTINKEEALQRPVASDFE
QTVHSIPLTINKEIALMRNVAIDFE

SEQ ID NO: 46473 - protein, 25 aa, synthetic construct
  source 1..25: note = Seed: QTVHSIPLTINKEEALQRPVASDFE
QTVHSIPLTINKEIALMRNVALDFE

SEQ ID NO: 46474 - protein, 25 aa, synthetic construct
  source 1..25: note = Seed: QTVHSIPLTINKEEALQRPVASDFE
QTVHSIPLTINKEIALMRNVAMDFE

SEQ ID NO: 46475 - protein, 25 aa, synthetic construct
  source 1..25: note = Seed: QTVHSIPLTINKEEALQRPVASDFE
QTVHSIPLTINKEIALMRNVANDFE

SEQ ID NO: 46476 - protein, 25 aa, synthetic construct
  source 1..25: note = Seed: QTVHSIPLTINKEEALQRPVASDFE
QTVHSIPLTINKEIALMRNVASDFE

SEQ ID NO: 46477 - protein, 25 aa, synthetic construct
  source 1..25: note = Seed: QTVHSIPLTINKEEALQRPVASDFE
QTVHSIPLTINKEIALMRNVATDFE

SEQ ID NO: 46478 - protein, 25 aa, synthetic construct
  source 1..25: note = Seed: QTVHSIPLTINKEEALQRPVASDFE
QTVHSIPLTINKEIALMRNVAVDFE

SEQ ID NO: 46479 - protein, 25 aa, synthetic construct
  source 1..25: note = Seed: QTVHSIPLTINKEEALQRPVASDFE
QTVHSIPLTINKEIALMRPVAADFE

SEQ ID NO: 46480 - protein, 25 aa, synthetic construct
  source 1..25: note = Seed: QTVHSIPLTINKEEALQRPVASDFE
QTVHSIPLTINKEIALMRPVADDFE

SEQ ID NO: 46481 - protein, 25 aa, synthetic construct
  source 1..25: note = Seed: QTVHSIPLTINKEEALQRPVASDFE
QTVHSIPLTINKEIALMRPVAEDFE

SEQ ID NO: 46482 - protein, 25 aa, synthetic construct
  source 1..25: note = Seed: QTVHSIPLTINKEEALQRPVASDFE
QTVHSIPLTINKEIALMRPVAGDFE

SEQ ID NO: 46483 - protein, 25 aa, synthetic construct
  source 1..25: note = Seed: QTVHSIPLTINKEEALQRPVASDFE
QTVHSIPLTINKEIALMRPVAHDFE

SEQ ID NO: 46484 - protein, 25 aa, synthetic construct
  source 1..25: note = Seed: QTVHSIPLTINKEEALQRPVASDFE
QTVHSIPLTINKEIALMRPVAIDFE

SEQ ID NO: 46485 - protein, 25 aa, synthetic construct
  source 1..25: note = Seed: QTVHSIPLTINKEEALQRPVASDFE
QTVHSIPLTINKEIALMRPVALDFE

SEQ ID NO: 46486 - protein, 25 aa, synthetic construct
  source 1..25: note = Seed: QTVHSIPLTINKEEALQRPVASDFE
QTVHSIPLTINKEIALMRPVAMDFE

SEQ ID NO: 46487 - protein, 25 aa, synthetic construct
  source 1..25: note = Seed: QTVHSIPLTINKEEALQRPVASDFE
QTVHSIPLTINKEIALMRPVANDFE

SEQ ID NO: 46488 - protein, 25 aa, synthetic construct
  source 1..25: note = Seed: QTVHSIPLTINKEEALQRPVASDFE
QTVHSIPLTINKEIALMRPVAPDFE

SEQ ID NO: 46489 - protein, 25 aa, synthetic construct
  source 1..25: note = Seed: QTVHSIPLTINKEEALQRPVASDFE
QTVHSIPLTINKEIALMRPVAQDFE

SEQ ID NO: 46490 - protein, 25 aa, synthetic construct
  source 1..25: note = Seed: QTVHSIPLTINKEEALQRPVASDFE
QTVHSIPLTINKEIALMRPVASDFE

SEQ ID NO: 46491 - protein, 25 aa, synthetic construct
  source 1..25: note = Seed: QTVHSIPLTINKEEALQRPVASDFE
QTVHSIPLTINKEIALMRPVATDFE

SEQ ID NO: 46492 - protein, 25 aa, synthetic construct
  source 1..25: note = Seed: QTVHSIPLTINKEEALQRPVASDFE
QTVHSIPLTINKEIALMRPVAVDFE

SEQ ID NO: 46493 - protein, 25 aa, synthetic construct
  source 1..25: note = Seed: QTVHSIPLTINKEEALQRPVASDFE
QTVHSIPLTINKEIALMRSVAADFE

SEQ ID NO: 46494 - protein, 25 aa, synthetic construct
  source 1..25: note = Seed: QTVHSIPLTINKEEALQRPVASDFE
QTVHSIPLTINKEIALMRSVADDFE

SEQ ID NO: 46495 - protein, 25 aa, synthetic construct
  source 1..25: note = Seed: QTVHSIPLTINKEEALQRPVASDFE
QTVHSIPLTINKEIALMRSVAGDFE

SEQ ID NO: 46496 - protein, 25 aa, synthetic construct
  source 1..25: note = Seed: QTVHSIPLTINKEEALQRPVASDFE
QTVHSIPLTINKEIALMRSVAHDFE

SEQ ID NO: 46497 - protein, 25 aa, synthetic construct
  source 1..25: note = Seed: QTVHSIPLTINKEEALQRPVASDFE
QTVHSIPLTINKEIALMRSVAIDFE

SEQ ID NO: 46498 - protein, 25 aa, synthetic construct
  source 1..25: note = Seed: QTVHSIPLTINKEEALQRPVASDFE
QTVHSIPLTINKEIALMRSVALDFE

SEQ ID NO: 46499 - protein, 25 aa, synthetic construct
  source 1..25: note = Seed: QTVHSIPLTINKEEALQRPVASDFE
QTVHSIPLTINKEIALMRSVAMDFE

SEQ ID NO: 46500 - protein, 25 aa, synthetic construct
  source 1..25: note = Seed: QTVHSIPLTINKEEALQRPVASDFE
QTVHSIPLTINKEIALMRSVANDFE

SEQ ID NO: 46501 - protein, 25 aa, synthetic construct
  source 1..25: note = Seed: QTVHSIPLTINKEEALQRPVASDFE
QTVHSIPLTINKEIALMRSVAQDFE

SEQ ID NO: 46502 - protein, 25 aa, synthetic construct
  source 1..25: note = Seed: QTVHSIPLTINKEEALQRPVASDFE
QTVHSIPLTINKEIALMRSVASDFE

SEQ ID NO: 46503 - protein, 25 aa, synthetic construct
  source 1..25: note = Seed: QTVHSIPLTINKEEALQRPVASDFE
QTVHSIPLTINKEIALMRSVATDFE

SEQ ID NO: 46504 - protein, 25 aa, synthetic construct
  source 1..25: note = Seed: QTVHSIPLTINKEEALQRPVASDFE
QTVHSIPLTINKEIALMRSVAVDFE

SEQ ID NO: 46505 - protein, 25 aa, synthetic construct
  source 1..25: note = Seed: QTVHSIPLTINKEEALQRPVASDFE
QTVHSIPLTINKEIALMRTVAADFE

SEQ ID NO: 46506 - protein, 25 aa, synthetic construct
  source 1..25: note = Seed: QTVHSIPLTINKEEALQRPVASDFE
QTVHSIPLTINKEIALMRTVAGDFE

SEQ ID NO: 46507 - protein, 25 aa, synthetic construct
  source 1..25: note = Seed: QTVHSIPLTINKEEALQRPVASDFE
QTVHSIPLTINKEIALMRTVAHDFE

SEQ ID NO: 46508 - protein, 25 aa, synthetic construct
  source 1..25: note = Seed: QTVHSIPLTINKEEALQRPVASDFE
QTVHSIPLTINKEIALMRTVAIDFE

SEQ ID NO: 46509 - protein, 25 aa, synthetic construct
  source 1..25: note = Seed: QTVHSIPLTINKEEALQRPVASDFE
QTVHSIPLTINKEIALMRTVALDFE

SEQ ID NO: 46510 - protein, 25 aa, synthetic construct
  source 1..25: note = Seed: QTVHSIPLTINKEEALQRPVASDFE
QTVHSIPLTINKEIALMRTVAMDFE

SEQ ID NO: 46511 - protein, 25 aa, synthetic construct
  source 1..25: note = Seed: QTVHSIPLTINKEEALQRPVASDFE
QTVHSIPLTINKEIALMRTVANDFE

SEQ ID NO: 46512 - protein, 25 aa, synthetic construct
  source 1..25: note = Seed: QTVHSIPLTINKEEALQRPVASDFE
QTVHSIPLTINKEIALMRTVAQDFE

SEQ ID NO: 46513 - protein, 25 aa, synthetic construct
  source 1..25: note = Seed: QTVHSIPLTINKEEALQRPVASDFE
QTVHSIPLTINKEIALMRTVASDFE

SEQ ID NO: 46514 - protein, 25 aa, synthetic construct
  source 1..25: note = Seed: QTVHSIPLTINKEEALQRPVASDFE
QTVHSIPLTINKEIALMRTVATDFE

SEQ ID NO: 46515 - protein, 25 aa, synthetic construct
  source 1..25: note = Seed: QTVHSIPLTINKEEALQRPVASDFE
QTVHSIPLTINKEIALMRTVAVDFE

SEQ ID NO: 46516 - protein, 25 aa, synthetic construct
  source 1..25: note = Seed: QTVHSIPLTINKEEALQRPVASDFE
QTVHSIPLTINKEIALMRVVAADFE

SEQ ID NO: 46517 - protein, 25 aa, synthetic construct
  source 1..25: note = Seed: QTVHSIPLTINKEEALQRPVASDFE
QTVHSIPLTINKEIALMRVVAHDFE

SEQ ID NO: 46518 - protein, 25 aa, synthetic construct
  source 1..25: note = Seed: QTVHSIPLTINKEEALQRPVASDFE
QTVHSIPLTINKEIALMRVVANDFE

SEQ ID NO: 46519 - protein, 25 aa, synthetic construct
  source 1..25: note = Seed: QTVHSIPLTINKEEALQRPVASDFE
QTVHSIPLTINKEIALMRVVASDFE

SEQ ID NO: 46520 - protein, 25 aa, synthetic construct
  source 1..25: note = Seed: QTVHSIPLTINKEEALQRPVASDFE
QTVHSIPLTINKEIALMRVVATDFE

SEQ ID NO: 46521 - protein, 25 aa, synthetic construct
  source 1..25: note = Seed: QTVHSIPLTINKEEALQRPVASDFE
QTVHSIPLTINKEIALQRAVAADFE

SEQ ID NO: 46522 - protein, 25 aa, synthetic construct
  source 1..25: note = Seed: QTVHSIPLTINKEEALQRPVASDFE
QTVHSIPLTINKEIALQRAVAHDFE

SEQ ID NO: 46523 - protein, 25 aa, synthetic construct
  source 1..25: note = Seed: QTVHSIPLTINKEEALQRPVASDFE
QTVHSIPLTINKEIALQRAVAIDFE

SEQ ID NO: 46524 - protein, 25 aa, synthetic construct
  source 1..25: note = Seed: QTVHSIPLTINKEEALQRPVASDFE
QTVHSIPLTINKEIALQRAVALDFE

SEQ ID NO: 46525 - protein, 25 aa, synthetic construct
  source 1..25: note = Seed: QTVHSIPLTINKEEALQRPVASDFE
QTVHSIPLTINKEIALQRAVAMDFE

SEQ ID NO: 46526 - protein, 25 aa, synthetic construct
  source 1..25: note = Seed: QTVHSIPLTINKEEALQRPVASDFE
QTVHSIPLTINKEIALQRAVANDFE

SEQ ID NO: 46527 - protein, 25 aa, synthetic construct
  source 1..25: note = Seed: QTVHSIPLTINKEEALQRPVASDFE
QTVHSIPLTINKEIALQRAVASDFE

SEQ ID NO: 46528 - protein, 25 aa, synthetic construct
  source 1..25: note = Seed: QTVHSIPLTINKEEALQRPVASDFE
QTVHSIPLTINKEIALQRAVATDFE

SEQ ID NO: 46529 - protein, 25 aa, synthetic construct
  source 1..25: note = Seed: QTVHSIPLTINKEEALQRPVASDFE
QTVHSIPLTINKEIALQRAVAVDFE

SEQ ID NO: 46530 - protein, 25 aa, synthetic construct
  source 1..25: note = Seed: QTVHSIPLTINKEEALQRPVASDFE
QTVHSIPLTINKEIALQRGVAADFE

SEQ ID NO: 46531 - protein, 25 aa, synthetic construct
  source 1..25: note = Seed: QTVHSIPLTINKEEALQRPVASDFE
QTVHSIPLTINKEIALQRGVANDFE

SEQ ID NO: 46532 - protein, 25 aa, synthetic construct
  source 1..25: note = Seed: QTVHSIPLTINKEEALQRPVASDFE
QTVHSIPLTINKEIALQRGVASDFE

SEQ ID NO: 46533 - protein, 25 aa, synthetic construct
  source 1..25: note = Seed: QTVHSIPLTINKEEALQRPVASDFE
QTVHSIPLTINKEIALQRIVAADFE

SEQ ID NO: 46534 - protein, 25 aa, synthetic construct
  source 1..25: note = Seed: QTVHSIPLTINKEEALQRPVASDFE
QTVHSIPLTINKEIALQRIVANDFE

SEQ ID NO: 46535 - protein, 25 aa, synthetic construct
  source 1..25: note = Seed: QTVHSIPLTINKEEALQRPVASDFE
QTVHSIPLTINKEIALQRIVASDFE

SEQ ID NO: 46536 - protein, 25 aa, synthetic construct
  source 1..25: note = Seed: QTVHSIPLTINKEEALQRPVASDFE
QTVHSIPLTINKEIALQRNVAADFE

SEQ ID NO: 46537 - protein, 25 aa, synthetic construct
  source 1..25: note = Seed: QTVHSIPLTINKEEALQRPVASDFE
QTVHSIPLTINKEIALQRPVAADFE

SEQ ID NO: 46538 - protein, 25 aa, synthetic construct
  source 1..25: note = Seed: QTVHSIPLTINKEEALQRPVASDFE
QTVHSIPLTINKEIALQRPVANDFE

SEQ ID NO: 46539 - protein, 25 aa, synthetic construct
  source 1..25: note = Seed: QTVHSIPLTINKEEALQRPVASDFE
QTVHSIPLTINKEIALQRPVASDFE

SEQ ID NO: 46540 - protein, 25 aa, synthetic construct
  source 1..25: note = Seed: QTVHSIPLTINKEEALQRPVASDFE
QTVHSIPLTINKEIALQRPVAVDFE

SEQ ID NO: 46541 - protein, 25 aa, synthetic construct
  source 1..25: note = Seed: QTVHSIPLTINKEEALQRPVASDFE
QTVHSIPLTINKEIALQRSVAADFE

SEQ ID NO: 46542 - protein, 25 aa, synthetic construct
  source 1..25: note = Seed: QTVHSIPLTINKEEALQRPVASDFE
QTVHSIPLTINKEIALQRSVANDFE

SEQ ID NO: 46543 - protein, 25 aa, synthetic construct
  source 1..25: note = Seed: QTVHSIPLTINKEEALQRPVASDFE
QTVHSIPLTINKEIALQRSVASDFE

SEQ ID NO: 46544 - protein, 25 aa, synthetic construct
  source 1..25: note = Seed: QTVHSIPLTINKEEALQRPVASDFE
QTVHSIPLTINKEIALQRTVAADFE

SEQ ID NO: 46545 - protein, 25 aa, synthetic construct
  source 1..25: note = Seed: QTVHSIPLTINKEEALQRPVASDFE
QTVHSIPLTINKEIALQRTVANDFE

SEQ ID NO: 46546 - protein, 25 aa, synthetic construct
  source 1..25: note = Seed: QTVHSIPLTINKEEALQRPVASDFE
QTVHSIPLTINKEIALQRTVASDFE

SEQ ID NO: 46547 - protein, 25 aa, synthetic construct
  source 1..25: note = Seed: QTVHSIPLTINKEEALQRPVASDFE
QTVHSIPLTINKEIALQRTVAVDFE

SEQ ID NO: 46548 - protein, 25 aa, synthetic construct
  source 1..25: note = Seed: QTVHSIPLTINKEEALQRPVASDFE
QTVHSIPLTINKEIALQRVVAADFE

SEQ ID NO: 46549 - protein, 25 aa, synthetic construct
  source 1..25: note = Seed: QTVHSIPLTINKEEALQRPVASDFE
QTVHSIPLTINKEIALQRVVANDFE

SEQ ID NO: 46550 - protein, 25 aa, synthetic construct
  source 1..25: note = Seed: QTVHSIPLTINKEEALQRPVASDFE
QTVHSIPLTINKEIALQRVVASDFE

SEQ ID NO: 46551 - protein, 25 aa, synthetic construct
  source 1..25: note = Seed: QTVHSIPLTINKEEALQRPVASDFE
QTVHSIPLTINKEIALSRAVAADFE

SEQ ID NO: 46552 - protein, 25 aa, synthetic construct
  source 1..25: note = Seed: QTVHSIPLTINKEEALQRPVASDFE
QTVHSIPLTINKEIALSRAVAIDFE

SEQ ID NO: 46553 - protein, 25 aa, synthetic construct
  source 1..25: note = Seed: QTVHSIPLTINKEEALQRPVASDFE
QTVHSIPLTINKEIALSRAVANDFE

SEQ ID NO: 46554 - protein, 25 aa, synthetic construct
  source 1..25: note = Seed: QTVHSIPLTINKEEALQRPVASDFE
QTVHSIPLTINKEIALSRAVASDFE

SEQ ID NO: 46555 - protein, 25 aa, synthetic construct
  source 1..25: note = Seed: QTVHSIPLTINKEEALQRPVASDFE
QTVHSIPLTINKEIALSRAVAVDFE

SEQ ID NO: 46556 - protein, 25 aa, synthetic construct
  source 1..25: note = Seed: QTVHSIPLTINKEEALQRPVASDFE
QTVHSIPLTINKEIALSRPVAADFE

SEQ ID NO: 46557 - protein, 25 aa, synthetic construct
  source 1..25: note = Seed: QTVHSIPLTINKEEALQRPVASDFE
QTVHSIPLTINKEIALSRPVANDFE

SEQ ID NO: 46558 - protein, 25 aa, synthetic construct
  source 1..25: note = Seed: QTVHSIPLTINKEEALQRPVASDFE
QTVHSIPLTINKEIALSRPVASDFE

SEQ ID NO: 46559 - protein, 25 aa, synthetic construct
  source 1..25: note = Seed: QTVHSIPLTINKEEALQRPVASDFE
QTVHSIPLTINKEIALSRSVAADFE

SEQ ID NO: 46560 - protein, 25 aa, synthetic construct
  source 1..25: note = Seed: QTVHSIPLTINKEEALQRPVASDFE
QTVHSIPLTINKEIALSRSVASDFE

SEQ ID NO: 46561 - protein, 25 aa, synthetic construct
  source 1..25: note = Seed: QTVHSIPLTINKEEALQRPVASDFE
QTVHSIPLTINKEIALSRTVAADFE

SEQ ID NO: 46562 - protein, 25 aa, synthetic construct
  source 1..25: note = Seed: QTVHSIPLTINKEEALQRPVASDFE
QTVHSIPLTINKEIALTRAVAADFE

SEQ ID NO: 46563 - protein, 25 aa, synthetic construct
  source 1..25: note = Seed: QTVHSIPLTINKEEALQRPVASDFE
QTVHSIPLTINKEIALTRAVANDFE

SEQ ID NO: 46564 - protein, 25 aa, synthetic construct
  source 1..25: note = Seed: QTVHSIPLTINKEEALQRPVASDFE
QTVHSIPLTINKEIALTRAVASDFE

SEQ ID NO: 46565 - protein, 25 aa, synthetic construct
  source 1..25: note = Seed: QTVHSIPLTINKEEALQRPVASDFE
QTVHSIPLTINKEIALTRPVAADFE

SEQ ID NO: 46566 - protein, 25 aa, synthetic construct
  source 1..25: note = Seed: QTVHSIPLTINKEEALQRPVASDFE
QTVHSIPLTINKEIALTRPVASDFE

SEQ ID NO: 46567 - protein, 25 aa, synthetic construct
  source 1..25: note = Seed: QTVHSIPLTINKEEALQRPVASDFE
QTVHSIPLTINKEIALVRAVAADFE

SEQ ID NO: 46568 - protein, 25 aa, synthetic construct
  source 1..25: note = Seed: QTVHSIPLTINKEEALQRPVASDFE
QTVHSIPLTINKEIALVRAVAHDFE

SEQ ID NO: 46569 - protein, 25 aa, synthetic construct
  source 1..25: note = Seed: QTVHSIPLTINKEEALQRPVASDFE
QTVHSIPLTINKEIALVRAVANDFE

SEQ ID NO: 46570 - protein, 25 aa, synthetic construct
  source 1..25: note = Seed: QTVHSIPLTINKEEALQRPVASDFE
QTVHSIPLTINKEIALVRAVASDFE

SEQ ID NO: 46571 - protein, 25 aa, synthetic construct
  source 1..25: note = Seed: QTVHSIPLTINKEEALQRPVASDFE
QTVHSIPLTINKEIALVRGVAADFE

SEQ ID NO: 46572 - protein, 25 aa, synthetic construct
  source 1..25: note = Seed: QTVHSIPLTINKEEALQRPVASDFE
QTVHSIPLTINKEIALVRGVANDFE

SEQ ID NO: 46573 - protein, 25 aa, synthetic construct
  source 1..25: note = Seed: QTVHSIPLTINKEEALQRPVASDFE
QTVHSIPLTINKEIALVRGVASDFE

SEQ ID NO: 46574 - protein, 25 aa, synthetic construct
  source 1..25: note = Seed: QTVHSIPLTINKEEALQRPVASDFE
QTVHSIPLTINKEIALVRNVAADFE

SEQ ID NO: 46575 - protein, 25 aa, synthetic construct
  source 1..25: note = Seed: QTVHSIPLTINKEEALQRPVASDFE
QTVHSIPLTINKEIALVRPVAADFE

SEQ ID NO: 46576 - protein, 25 aa, synthetic construct
  source 1..25: note = Seed: QTVHSIPLTINKEEALQRPVASDFE
QTVHSIPLTINKEIALVRPVANDFE

SEQ ID NO: 46577 - protein, 25 aa, synthetic construct
  source 1..25: note = Seed: QTVHSIPLTINKEEALQRPVASDFE
QTVHSIPLTINKEIALVRPVASDFE

SEQ ID NO: 46578 - protein, 25 aa, synthetic construct
  source 1..25: note = Seed: QTVHSIPLTINKEEALQRPVASDFE
QTVHSIPLTINKEIALVRPVATDFE

SEQ ID NO: 46579 - protein, 25 aa, synthetic construct
  source 1..25: note = Seed: QTVHSIPLTINKEEALQRPVASDFE
QTVHSIPLTINKEIALVRPVAVDFE

SEQ ID NO: 46580 - protein, 25 aa, synthetic construct
  source 1..25: note = Seed: QTVHSIPLTINKEEALQRPVASDFE
QTVHSIPLTINKEIALVRSVAADFE

SEQ ID NO: 46581 - protein, 25 aa, synthetic construct
  source 1..25: note = Seed: QTVHSIPLTINKEEALQRPVASDFE
QTVHSIPLTINKEIALVRSVANDFE

SEQ ID NO: 46582 - protein, 25 aa, synthetic construct
  source 1..25: note = Seed: QTVHSIPLTINKEEALQRPVASDFE
QTVHSIPLTINKEIALVRSVASDFE

SEQ ID NO: 46583 - protein, 25 aa, synthetic construct
  source 1..25: note = Seed: QTVHSIPLTINKEEALQRPVASDFE
QTVHSIPLTINKEIALVRTVAADFE

SEQ ID NO: 46584 - protein, 25 aa, synthetic construct
  source 1..25: note = Seed: QTVHSIPLTINKEEALQRPVASDFE
QTVHSIPLTINKEIALVRTVANDFE

SEQ ID NO: 46585 - protein, 25 aa, synthetic construct
  source 1..25: note = Seed: QTVHSIPLTINKEEALQRPVASDFE
QTVHSIPLTINKEIALVRTVASDFE

SEQ ID NO: 46586 - protein, 25 aa, synthetic construct
  source 1..25: note = Seed: QTVHSIPLTINKEEALQRPVASDFE
QTVHSIPLTINKEIALVRVVANDFE

SEQ ID NO: 46587 - protein, 25 aa, synthetic construct
  source 1..25: note = Seed: QTVHSIPLTINKEEALQRPVASDFE
QTVHSIPLTINKELALARAVAADFE

SEQ ID NO: 46588 - protein, 25 aa, synthetic construct
  source 1..25: note = Seed: QTVHSIPLTINKEEALQRPVASDFE
QTVHSIPLTINKELALARAVAGDFE

SEQ ID NO: 46589 - protein, 25 aa, synthetic construct
  source 1..25: note = Seed: QTVHSIPLTINKEEALQRPVASDFE
QTVHSIPLTINKELALARAVAHDFE

SEQ ID NO: 46590 - protein, 25 aa, synthetic construct
  source 1..25: note = Seed: QTVHSIPLTINKEEALQRPVASDFE
QTVHSIPLTINKELALARAVAIDFE

SEQ ID NO: 46591 - protein, 25 aa, synthetic construct
  source 1..25: note = Seed: QTVHSIPLTINKEEALQRPVASDFE
QTVHSIPLTINKELALARAVALDFE

SEQ ID NO: 46592 - protein, 25 aa, synthetic construct
  source 1..25: note = Seed: QTVHSIPLTINKEEALQRPVASDFE
QTVHSIPLTINKELALARAVAMDFE

SEQ ID NO: 46593 - protein, 25 aa, synthetic construct
  source 1..25: note = Seed: QTVHSIPLTINKEEALQRPVASDFE
QTVHSIPLTINKELALARAVANDFE

SEQ ID NO: 46594 - protein, 25 aa, synthetic construct
  source 1..25: note = Seed: QTVHSIPLTINKEEALQRPVASDFE
QTVHSIPLTINKELALARAVAQDFE

SEQ ID NO: 46595 - protein, 25 aa, synthetic construct
  source 1..25: note = Seed: QTVHSIPLTINKEEALQRPVASDFE
QTVHSIPLTINKELALARAVASDFE

SEQ ID NO: 46596 - protein, 25 aa, synthetic construct
  source 1..25: note = Seed: QTVHSIPLTINKEEALQRPVASDFE
QTVHSIPLTINKELALARAVATDFE

SEQ ID NO: 46597 - protein, 25 aa, synthetic construct
  source 1..25: note = Seed: QTVHSIPLTINKEEALQRPVASDFE
QTVHSIPLTINKELALARAVAVDFE

SEQ ID NO: 46598 - protein, 25 aa, synthetic construct
  source 1..25: note = Seed: QTVHSIPLTINKEEALQRPVASDFE
QTVHSIPLTINKELALARGVAADFE

SEQ ID NO: 46599 - protein, 25 aa, synthetic construct
  source 1..25: note = Seed: QTVHSIPLTINKEEALQRPVASDFE
QTVHSIPLTINKELALARGVANDFE

SEQ ID NO: 46600 - protein, 25 aa, synthetic construct
  source 1..25: note = Seed: QTVHSIPLTINKEEALQRPVASDFE
QTVHSIPLTINKELALARGVASDFE

SEQ ID NO: 46601 - protein, 25 aa, synthetic construct
  source 1..25: note = Seed: QTVHSIPLTINKEEALQRPVASDFE
QTVHSIPLTINKELALARGVAVDFE

SEQ ID NO: 46602 - protein, 25 aa, synthetic construct
  source 1..25: note = Seed: QTVHSIPLTINKEEALQRPVASDFE
QTVHSIPLTINKELALARIVAADFE

SEQ ID NO: 46603 - protein, 25 aa, synthetic construct
  source 1..25: note = Seed: QTVHSIPLTINKEEALQRPVASDFE
QTVHSIPLTINKELALARIVANDFE

SEQ ID NO: 46604 - protein, 25 aa, synthetic construct
  source 1..25: note = Seed: QTVHSIPLTINKEEALQRPVASDFE
QTVHSIPLTINKELALARIVASDFE

SEQ ID NO: 46605 - protein, 25 aa, synthetic construct
  source 1..25: note = Seed: QTVHSIPLTINKEEALQRPVASDFE
QTVHSIPLTINKELALARNVAADFE

SEQ ID NO: 46606 - protein, 25 aa, synthetic construct
  source 1..25: note = Seed: QTVHSIPLTINKEEALQRPVASDFE
QTVHSIPLTINKELALARNVANDFE

SEQ ID NO: 46607 - protein, 25 aa, synthetic construct
  source 1..25: note = Seed: QTVHSIPLTINKEEALQRPVASDFE
QTVHSIPLTINKELALARNVASDFE

SEQ ID NO: 46608 - protein, 25 aa, synthetic construct
  source 1..25: note = Seed: QTVHSIPLTINKEEALQRPVASDFE
QTVHSIPLTINKELALARPVAADFE

SEQ ID NO: 46609 - protein, 25 aa, synthetic construct
  source 1..25: note = Seed: QTVHSIPLTINKEEALQRPVASDFE
QTVHSIPLTINKELALARPVAGDFE

SEQ ID NO: 46610 - protein, 25 aa, synthetic construct
  source 1..25: note = Seed: QTVHSIPLTINKEEALQRPVASDFE
QTVHSIPLTINKELALARPVAHDFE

SEQ ID NO: 46611 - protein, 25 aa, synthetic construct
  source 1..25: note = Seed: QTVHSIPLTINKEEALQRPVASDFE
QTVHSIPLTINKELALARPVAIDFE

SEQ ID NO: 46612 - protein, 25 aa, synthetic construct
  source 1..25: note = Seed: QTVHSIPLTINKEEALQRPVASDFE
QTVHSIPLTINKELALARPVALDFE

SEQ ID NO: 46613 - protein, 25 aa, synthetic construct
  source 1..25: note = Seed: QTVHSIPLTINKEEALQRPVASDFE
QTVHSIPLTINKELALARPVAMDFE

SEQ ID NO: 46614 - protein, 25 aa, synthetic construct
  source 1..25: note = Seed: QTVHSIPLTINKEEALQRPVASDFE
QTVHSIPLTINKELALARPVANDFE

SEQ ID NO: 46615 - protein, 25 aa, synthetic construct
  source 1..25: note = Seed: QTVHSIPLTINKEEALQRPVASDFE
QTVHSIPLTINKELALARPVAQDFE

SEQ ID NO: 46616 - protein, 25 aa, synthetic construct
  source 1..25: note = Seed: QTVHSIPLTINKEEALQRPVASDFE
QTVHSIPLTINKELALARPVASDFE

SEQ ID NO: 46617 - protein, 25 aa, synthetic construct
  source 1..25: note = Seed: QTVHSIPLTINKEEALQRPVASDFE
QTVHSIPLTINKELALARPVATDFE

SEQ ID NO: 46618 - protein, 25 aa, synthetic construct
  source 1..25: note = Seed: QTVHSIPLTINKEEALQRPVASDFE
QTVHSIPLTINKELALARPVAVDFE

SEQ ID NO: 46619 - protein, 25 aa, synthetic construct
  source 1..25: note = Seed: QTVHSIPLTINKEEALQRPVASDFE
QTVHSIPLTINKELALARSVAADFE

SEQ ID NO: 46620 - protein, 25 aa, synthetic construct
  source 1..25: note = Seed: QTVHSIPLTINKEEALQRPVASDFE
QTVHSIPLTINKELALARSVAGDFE

SEQ ID NO: 46621 - protein, 25 aa, synthetic construct
  source 1..25: note = Seed: QTVHSIPLTINKEEALQRPVASDFE
QTVHSIPLTINKELALARSVAHDFE

SEQ ID NO: 46622 - protein, 25 aa, synthetic construct
  source 1..25: note = Seed: QTVHSIPLTINKEEALQRPVASDFE
QTVHSIPLTINKELALARSVAIDFE

SEQ ID NO: 46623 - protein, 25 aa, synthetic construct
  source 1..25: note = Seed: QTVHSIPLTINKEEALQRPVASDFE
QTVHSIPLTINKELALARSVALDFE

SEQ ID NO: 46624 - protein, 25 aa, synthetic construct
  source 1..25: note = Seed: QTVHSIPLTINKEEALQRPVASDFE
QTVHSIPLTINKELALARSVAMDFE

SEQ ID NO: 46625 - protein, 25 aa, synthetic construct
  source 1..25: note = Seed: QTVHSIPLTINKEEALQRPVASDFE
QTVHSIPLTINKELALARSVANDFE

SEQ ID NO: 46626 - protein, 25 aa, synthetic construct
  source 1..25: note = Seed: QTVHSIPLTINKEEALQRPVASDFE
QTVHSIPLTINKELALARSVASDFE

SEQ ID NO: 46627 - protein, 25 aa, synthetic construct
  source 1..25: note = Seed: QTVHSIPLTINKEEALQRPVASDFE
QTVHSIPLTINKELALARSVATDFE

SEQ ID NO: 46628 - protein, 25 aa, synthetic construct
  source 1..25: note = Seed: QTVHSIPLTINKEEALQRPVASDFE
QTVHSIPLTINKELALARSVAVDFE

SEQ ID NO: 46629 - protein, 25 aa, synthetic construct
  source 1..25: note = Seed: QTVHSIPLTINKEEALQRPVASDFE
QTVHSIPLTINKELALARTVAADFE

SEQ ID NO: 46630 - protein, 25 aa, synthetic construct
  source 1..25: note = Seed: QTVHSIPLTINKEEALQRPVASDFE
QTVHSIPLTINKELALARTVAGDFE

SEQ ID NO: 46631 - protein, 25 aa, synthetic construct
  source 1..25: note = Seed: QTVHSIPLTINKEEALQRPVASDFE
QTVHSIPLTINKELALARTVAIDFE

SEQ ID NO: 46632 - protein, 25 aa, synthetic construct
  source 1..25: note = Seed: QTVHSIPLTINKEEALQRPVASDFE
QTVHSIPLTINKELALARTVALDFE

SEQ ID NO: 46633 - protein, 25 aa, synthetic construct
  source 1..25: note = Seed: QTVHSIPLTINKEEALQRPVASDFE
QTVHSIPLTINKELALARTVAMDFE

SEQ ID NO: 46634 - protein, 25 aa, synthetic construct
  source 1..25: note = Seed: QTVHSIPLTINKEEALQRPVASDFE
QTVHSIPLTINKELALARTVANDFE

SEQ ID NO: 46635 - protein, 25 aa, synthetic construct
  source 1..25: note = Seed: QTVHSIPLTINKEEALQRPVASDFE
QTVHSIPLTINKELALARTVASDFE

SEQ ID NO: 46636 - protein, 25 aa, synthetic construct
  source 1..25: note = Seed: QTVHSIPLTINKEEALQRPVASDFE
QTVHSIPLTINKELALARTVATDFE

SEQ ID NO: 46637 - protein, 25 aa, synthetic construct
  source 1..25: note = Seed: QTVHSIPLTINKEEALQRPVASDFE
QTVHSIPLTINKELALARTVAVDFE

SEQ ID NO: 46638 - protein, 25 aa, synthetic construct
  source 1..25: note = Seed: QTVHSIPLTINKEEALQRPVASDFE
QTVHSIPLTINKELALARVVAADFE

SEQ ID NO: 46639 - protein, 25 aa, synthetic construct
  source 1..25: note = Seed: QTVHSIPLTINKEEALQRPVASDFE
QTVHSIPLTINKELALARVVAHDFE

SEQ ID NO: 46640 - protein, 25 aa, synthetic construct
  source 1..25: note = Seed: QTVHSIPLTINKEEALQRPVASDFE
QTVHSIPLTINKELALARVVANDFE

SEQ ID NO: 46641 - protein, 25 aa, synthetic construct
  source 1..25: note = Seed: QTVHSIPLTINKEEALQRPVASDFE
QTVHSIPLTINKELALARVVASDFE

SEQ ID NO: 46642 - protein, 25 aa, synthetic construct
  source 1..25: note = Seed: QTVHSIPLTINKEEALQRPVASDFE
QTVHSIPLTINKELALARVVATDFE

SEQ ID NO: 46643 - protein, 25 aa, synthetic construct
  source 1..25: note = Seed: QTVHSIPLTINKEEALQRPVASDFE
QTVHSIPLTINKELALERAVAADFE

SEQ ID NO: 46644 - protein, 25 aa, synthetic construct
  source 1..25: note = Seed: QTVHSIPLTINKEEALQRPVASDFE
QTVHSIPLTINKELALERAVANDFE

SEQ ID NO: 46645 - protein, 25 aa, synthetic construct
  source 1..25: note = Seed: QTVHSIPLTINKEEALQRPVASDFE
QTVHSIPLTINKELALERAVASDFE

SEQ ID NO: 46646 - protein, 25 aa, synthetic construct
  source 1..25: note = Seed: QTVHSIPLTINKEEALQRPVASDFE
QTVHSIPLTINKELALFRAVAADFE

SEQ ID NO: 46647 - protein, 25 aa, synthetic construct
  source 1..25: note = Seed: QTVHSIPLTINKEEALQRPVASDFE
QTVHSIPLTINKELALFRAVASDFE

SEQ ID NO: 46648 - protein, 25 aa, synthetic construct
  source 1..25: note = Seed: QTVHSIPLTINKEEALQRPVASDFE
QTVHSIPLTINKELALFRPVAADFE

SEQ ID NO: 46649 - protein, 25 aa, synthetic construct
  source 1..25: note = Seed: QTVHSIPLTINKEEALQRPVASDFE
QTVHSIPLTINKELALFRPVASDFE

SEQ ID NO: 46650 - protein, 25 aa, synthetic construct
  source 1..25: note = Seed: QTVHSIPLTINKEEALQRPVASDFE
QTVHSIPLTINKELALIRAVAADFE

SEQ ID NO: 46651 - protein, 25 aa, synthetic construct
  source 1..25: note = Seed: QTVHSIPLTINKEEALQRPVASDFE
QTVHSIPLTINKELALIRAVAGDFE

SEQ ID NO: 46652 - protein, 25 aa, synthetic construct
  source 1..25: note = Seed: QTVHSIPLTINKEEALQRPVASDFE
QTVHSIPLTINKELALIRAVAHDFE

SEQ ID NO: 46653 - protein, 25 aa, synthetic construct
  source 1..25: note = Seed: QTVHSIPLTINKEEALQRPVASDFE
QTVHSIPLTINKELALIRAVAMDFE

SEQ ID NO: 46654 - protein, 25 aa, synthetic construct
  source 1..25: note = Seed: QTVHSIPLTINKEEALQRPVASDFE
QTVHSIPLTINKELALIRAVANDFE

SEQ ID NO: 46655 - protein, 25 aa, synthetic construct
  source 1..25: note = Seed: QTVHSIPLTINKEEALQRPVASDFE
QTVHSIPLTINKELALIRAVASDFE

SEQ ID NO: 46656 - protein, 25 aa, synthetic construct
  source 1..25: note = Seed: QTVHSIPLTINKEEALQRPVASDFE
QTVHSIPLTINKELALIRAVATDFE

SEQ ID NO: 46657 - protein, 25 aa, synthetic construct
  source 1..25: note = Seed: QTVHSIPLTINKEEALQRPVASDFE
QTVHSIPLTINKELALIRAVAVDFE

SEQ ID NO: 46658 - protein, 25 aa, synthetic construct
  source 1..25: note = Seed: QTVHSIPLTINKEEALQRPVASDFE
QTVHSIPLTINKELALIRGVAADFE

SEQ ID NO: 46659 - protein, 25 aa, synthetic construct
  source 1..25: note = Seed: QTVHSIPLTINKEEALQRPVASDFE
QTVHSIPLTINKELALIRGVANDFE

SEQ ID NO: 46660 - protein, 25 aa, synthetic construct
  source 1..25: note = Seed: QTVHSIPLTINKEEALQRPVASDFE
QTVHSIPLTINKELALIRGVASDFE

SEQ ID NO: 46661 - protein, 25 aa, synthetic construct
  source 1..25: note = Seed: QTVHSIPLTINKEEALQRPVASDFE
QTVHSIPLTINKELALIRGVATDFE

SEQ ID NO: 46662 - protein, 25 aa, synthetic construct
  source 1..25: note = Seed: QTVHSIPLTINKEEALQRPVASDFE
QTVHSIPLTINKELALIRIVANDFE

SEQ ID NO: 46663 - protein, 25 aa, synthetic construct
  source 1..25: note = Seed: QTVHSIPLTINKEEALQRPVASDFE
QTVHSIPLTINKELALIRNVAADFE

SEQ ID NO: 46664 - protein, 25 aa, synthetic construct
  source 1..25: note = Seed: QTVHSIPLTINKEEALQRPVASDFE
QTVHSIPLTINKELALIRNVANDFE

SEQ ID NO: 46665 - protein, 25 aa, synthetic construct
  source 1..25: note = Seed: QTVHSIPLTINKEEALQRPVASDFE
QTVHSIPLTINKELALIRNVASDFE

SEQ ID NO: 46666 - protein, 25 aa, synthetic construct
  source 1..25: note = Seed: QTVHSIPLTINKEEALQRPVASDFE
QTVHSIPLTINKELALIRPVAADFE

SEQ ID NO: 46667 - protein, 25 aa, synthetic construct
  source 1..25: note = Seed: QTVHSIPLTINKEEALQRPVASDFE
QTVHSIPLTINKELALIRPVAGDFE

SEQ ID NO: 46668 - protein, 25 aa, synthetic construct
  source 1..25: note = Seed: QTVHSIPLTINKEEALQRPVASDFE
QTVHSIPLTINKELALIRPVAHDFE

SEQ ID NO: 46669 - protein, 25 aa, synthetic construct
  source 1..25: note = Seed: QTVHSIPLTINKEEALQRPVASDFE
QTVHSIPLTINKELALIRPVAIDFE

SEQ ID NO: 46670 - protein, 25 aa, synthetic construct
  source 1..25: note = Seed: QTVHSIPLTINKEEALQRPVASDFE
QTVHSIPLTINKELALIRPVALDFE

SEQ ID NO: 46671 - protein, 25 aa, synthetic construct
  source 1..25: note = Seed: QTVHSIPLTINKEEALQRPVASDFE
QTVHSIPLTINKELALIRPVAMDFE

SEQ ID NO: 46672 - protein, 25 aa, synthetic construct
  source 1..25: note = Seed: QTVHSIPLTINKEEALQRPVASDFE
QTVHSIPLTINKELALIRPVANDFE

SEQ ID NO: 46673 - protein, 25 aa, synthetic construct
  source 1..25: note = Seed: QTVHSIPLTINKEEALQRPVASDFE
QTVHSIPLTINKELALIRPVAQDFE

SEQ ID NO: 46674 - protein, 25 aa, synthetic construct
  source 1..25: note = Seed: QTVHSIPLTINKEEALQRPVASDFE
QTVHSIPLTINKELALIRPVASDFE

SEQ ID NO: 46675 - protein, 25 aa, synthetic construct
  source 1..25: note = Seed: QTVHSIPLTINKEEALQRPVASDFE
QTVHSIPLTINKELALIRPVATDFE

SEQ ID NO: 46676 - protein, 25 aa, synthetic construct
  source 1..25: note = Seed: QTVHSIPLTINKEEALQRPVASDFE
QTVHSIPLTINKELALIRPVAVDFE

SEQ ID NO: 46677 - protein, 25 aa, synthetic construct
  source 1..25: note = Seed: QTVHSIPLTINKEEALQRPVASDFE
QTVHSIPLTINKELALIRSVAADFE

SEQ ID NO: 46678 - protein, 25 aa, synthetic construct
  source 1..25: note = Seed: QTVHSIPLTINKEEALQRPVASDFE
QTVHSIPLTINKELALIRSVAGDFE

SEQ ID NO: 46679 - protein, 25 aa, synthetic construct
  source 1..25: note = Seed: QTVHSIPLTINKEEALQRPVASDFE
QTVHSIPLTINKELALIRSVAHDFE

SEQ ID NO: 46680 - protein, 25 aa, synthetic construct
  source 1..25: note = Seed: QTVHSIPLTINKEEALQRPVASDFE
QTVHSIPLTINKELALIRSVANDFE

SEQ ID NO: 46681 - protein, 25 aa, synthetic construct
  source 1..25: note = Seed: QTVHSIPLTINKEEALQRPVASDFE
QTVHSIPLTINKELALIRSVASDFE

SEQ ID NO: 46682 - protein, 25 aa, synthetic construct
  source 1..25: note = Seed: QTVHSIPLTINKEEALQRPVASDFE
QTVHSIPLTINKELALIRSVATDFE

SEQ ID NO: 46683 - protein, 25 aa, synthetic construct
  source 1..25: note = Seed: QTVHSIPLTINKEEALQRPVASDFE
QTVHSIPLTINKELALIRTVAADFE

SEQ ID NO: 46684 - protein, 25 aa, synthetic construct
  source 1..25: note = Seed: QTVHSIPLTINKEEALQRPVASDFE
QTVHSIPLTINKELALIRTVAGDFE

SEQ ID NO: 46685 - protein, 25 aa, synthetic construct
  source 1..25: note = Seed: QTVHSIPLTINKEEALQRPVASDFE
QTVHSIPLTINKELALIRTVAHDFE

SEQ ID NO: 46686 - protein, 25 aa, synthetic construct
  source 1..25: note = Seed: QTVHSIPLTINKEEALQRPVASDFE
QTVHSIPLTINKELALIRTVANDFE

SEQ ID NO: 46687 - protein, 25 aa, synthetic construct
  source 1..25: note = Seed: QTVHSIPLTINKEEALQRPVASDFE
QTVHSIPLTINKELALIRTVASDFE

SEQ ID NO: 46688 - protein, 25 aa, synthetic construct
  source 1..25: note = Seed: QTVHSIPLTINKEEALQRPVASDFE
QTVHSIPLTINKELALIRTVATDFE

SEQ ID NO: 46689 - protein, 25 aa, synthetic construct
  source 1..25: note = Seed: QTVHSIPLTINKEEALQRPVASDFE
QTVHSIPLTINKELALIRTVAVDFE

SEQ ID NO: 46690 - protein, 25 aa, synthetic construct
  source 1..25: note = Seed: QTVHSIPLTINKEEALQRPVASDFE
QTVHSIPLTINKELALIRVVANDFE

SEQ ID NO: 46691 - protein, 25 aa, synthetic construct
  source 1..25: note = Seed: QTVHSIPLTINKEEALQRPVASDFE
QTVHSIPLTINKELALIRVVASDFE

SEQ ID NO: 46692 - protein, 25 aa, synthetic construct
  source 1..25: note = Seed: QTVHSIPLTINKEEALQRPVASDFE
QTVHSIPLTINKELALLRAVAADFE

SEQ ID NO: 46693 - protein, 25 aa, synthetic construct
  source 1..25: note = Seed: QTVHSIPLTINKEEALQRPVASDFE
QTVHSIPLTINKELALLRAVADDFE

SEQ ID NO: 46694 - protein, 25 aa, synthetic construct
  source 1..25: note = Seed: QTVHSIPLTINKEEALQRPVASDFE
QTVHSIPLTINKELALLRAVAGDFE

SEQ ID NO: 46695 - protein, 25 aa, synthetic construct
  source 1..25: note = Seed: QTVHSIPLTINKEEALQRPVASDFE
QTVHSIPLTINKELALLRAVAHDFE

SEQ ID NO: 46696 - protein, 25 aa, synthetic construct
  source 1..25: note = Seed: QTVHSIPLTINKEEALQRPVASDFE
QTVHSIPLTINKELALLRAVAIDFE

SEQ ID NO: 46697 - protein, 25 aa, synthetic construct
  source 1..25: note = Seed: QTVHSIPLTINKEEALQRPVASDFE
QTVHSIPLTINKELALLRAVALDFE

SEQ ID NO: 46698 - protein, 25 aa, synthetic construct
  source 1..25: note = Seed: QTVHSIPLTINKEEALQRPVASDFE
QTVHSIPLTINKELALLRAVAMDFE

SEQ ID NO: 46699 - protein, 25 aa, synthetic construct
  source 1..25: note = Seed: QTVHSIPLTINKEEALQRPVASDFE
QTVHSIPLTINKELALLRAVANDFE

SEQ ID NO: 46700 - protein, 25 aa, synthetic construct
  source 1..25: note = Seed: QTVHSIPLTINKEEALQRPVASDFE
QTVHSIPLTINKELALLRAVAQDFE

SEQ ID NO: 46701 - protein, 25 aa, synthetic construct
  source 1..25: note = Seed: QTVHSIPLTINKEEALQRPVASDFE
QTVHSIPLTINKELALLRAVASDFE

SEQ ID NO: 46702 - protein, 25 aa, synthetic construct
  source 1..25: note = Seed: QTVHSIPLTINKEEALQRPVASDFE
QTVHSIPLTINKELALLRAVATDFE

SEQ ID NO: 46703 - protein, 25 aa, synthetic construct
  source 1..25: note = Seed: QTVHSIPLTINKEEALQRPVASDFE
QTVHSIPLTINKELALLRAVAVDFE

SEQ ID NO: 46704 - protein, 25 aa, synthetic construct
  source 1..25: note = Seed: QTVHSIPLTINKEEALQRPVASDFE
QTVHSIPLTINKELALLRGVAADFE

SEQ ID NO: 46705 - protein, 25 aa, synthetic construct
  source 1..25: note = Seed: QTVHSIPLTINKEEALQRPVASDFE
QTVHSIPLTINKELALLRGVAGDFE

SEQ ID NO: 46706 - protein, 25 aa, synthetic construct
  source 1..25: note = Seed: QTVHSIPLTINKEEALQRPVASDFE
QTVHSIPLTINKELALLRGVAHDFE

SEQ ID NO: 46707 - protein, 25 aa, synthetic construct
  source 1..25: note = Seed: QTVHSIPLTINKEEALQRPVASDFE
QTVHSIPLTINKELALLRGVANDFE

SEQ ID NO: 46708 - protein, 25 aa, synthetic construct
  source 1..25: note = Seed: QTVHSIPLTINKEEALQRPVASDFE
QTVHSIPLTINKELALLRGVASDFE

SEQ ID NO: 46709 - protein, 25 aa, synthetic construct
  source 1..25: note = Seed: QTVHSIPLTINKEEALQRPVASDFE
QTVHSIPLTINKELALLRGVATDFE

SEQ ID NO: 46710 - protein, 25 aa, synthetic construct
  source 1..25: note = Seed: QTVHSIPLTINKEEALQRPVASDFE
QTVHSIPLTINKELALLRGVAVDFE

SEQ ID NO: 46711 - protein, 25 aa, synthetic construct
  source 1..25: note = Seed: QTVHSIPLTINKEEALQRPVASDFE
QTVHSIPLTINKELALLRIVANDFE

SEQ ID NO: 46712 - protein, 25 aa, synthetic construct
  source 1..25: note = Seed: QTVHSIPLTINKEEALQRPVASDFE
QTVHSIPLTINKELALLRNVAADFE

SEQ ID NO: 46713 - protein, 25 aa, synthetic construct
  source 1..25: note = Seed: QTVHSIPLTINKEEALQRPVASDFE
QTVHSIPLTINKELALLRNVANDFE

SEQ ID NO: 46714 - protein, 25 aa, synthetic construct
  source 1..25: note = Seed: QTVHSIPLTINKEEALQRPVASDFE
QTVHSIPLTINKELALLRNVASDFE

SEQ ID NO: 46715 - protein, 25 aa, synthetic construct
  source 1..25: note = Seed: QTVHSIPLTINKEEALQRPVASDFE
QTVHSIPLTINKELALLRNVATDFE

SEQ ID NO: 46716 - protein, 25 aa, synthetic construct
  source 1..25: note = Seed: QTVHSIPLTINKEEALQRPVASDFE
QTVHSIPLTINKELALLRNVAVDFE

SEQ ID NO: 46717 - protein, 25 aa, synthetic construct
  source 1..25: note = Seed: QTVHSIPLTINKEEALQRPVASDFE
QTVHSIPLTINKELALLRPVAADFE

SEQ ID NO: 46718 - protein, 25 aa, synthetic construct
  source 1..25: note = Seed: QTVHSIPLTINKEEALQRPVASDFE
QTVHSIPLTINKELALLRPVAGDFE

SEQ ID NO: 46719 - protein, 25 aa, synthetic construct
  source 1..25: note = Seed: QTVHSIPLTINKEEALQRPVASDFE
QTVHSIPLTINKELALLRPVAHDFE

SEQ ID NO: 46720 - protein, 25 aa, synthetic construct
  source 1..25: note = Seed: QTVHSIPLTINKEEALQRPVASDFE
QTVHSIPLTINKELALLRPVAIDFE

SEQ ID NO: 46721 - protein, 25 aa, synthetic construct
  source 1..25: note = Seed: QTVHSIPLTINKEEALQRPVASDFE
QTVHSIPLTINKELALLRPVALDFE

SEQ ID NO: 46722 - protein, 25 aa, synthetic construct
  source 1..25: note = Seed: QTVHSIPLTINKEEALQRPVASDFE
QTVHSIPLTINKELALLRPVAMDFE

SEQ ID NO: 46723 - protein, 25 aa, synthetic construct
  source 1..25: note = Seed: QTVHSIPLTINKEEALQRPVASDFE
QTVHSIPLTINKELALLRPVANDFE

SEQ ID NO: 46724 - protein, 25 aa, synthetic construct
  source 1..25: note = Seed: QTVHSIPLTINKEEALQRPVASDFE
QTVHSIPLTINKELALLRPVAQDFE

SEQ ID NO: 46725 - protein, 25 aa, synthetic construct
  source 1..25: note = Seed: QTVHSIPLTINKEEALQRPVASDFE
QTVHSIPLTINKELALLRPVASDFE

SEQ ID NO: 46726 - protein, 25 aa, synthetic construct
  source 1..25: note = Seed: QTVHSIPLTINKEEALQRPVASDFE
QTVHSIPLTINKELALLRPVATDFE

SEQ ID NO: 46727 - protein, 25 aa, synthetic construct
  source 1..25: note = Seed: QTVHSIPLTINKEEALQRPVASDFE
QTVHSIPLTINKELALLRPVAVDFE

SEQ ID NO: 46728 - protein, 25 aa, synthetic construct
  source 1..25: note = Seed: QTVHSIPLTINKEEALQRPVASDFE
QTVHSIPLTINKELALLRSVAADFE

SEQ ID NO: 46729 - protein, 25 aa, synthetic construct
  source 1..25: note = Seed: QTVHSIPLTINKEEALQRPVASDFE
QTVHSIPLTINKELALLRSVAGDFE

SEQ ID NO: 46730 - protein, 25 aa, synthetic construct
  source 1..25: note = Seed: QTVHSIPLTINKEEALQRPVASDFE
QTVHSIPLTINKELALLRSVAHDFE

SEQ ID NO: 46731 - protein, 25 aa, synthetic construct
  source 1..25: note = Seed: QTVHSIPLTINKEEALQRPVASDFE
QTVHSIPLTINKELALLRSVAIDFE

SEQ ID NO: 46732 - protein, 25 aa, synthetic construct
  source 1..25: note = Seed: QTVHSIPLTINKEEALQRPVASDFE
QTVHSIPLTINKELALLRSVAMDFE

SEQ ID NO: 46733 - protein, 25 aa, synthetic construct
  source 1..25: note = Seed: QTVHSIPLTINKEEALQRPVASDFE
QTVHSIPLTINKELALLRSVANDFE

SEQ ID NO: 46734 - protein, 25 aa, synthetic construct
  source 1..25: note = Seed: QTVHSIPLTINKEEALQRPVASDFE
QTVHSIPLTINKELALLRSVAQDFE

SEQ ID NO: 46735 - protein, 25 aa, synthetic construct
  source 1..25: note = Seed: QTVHSIPLTINKEEALQRPVASDFE
QTVHSIPLTINKELALLRSVASDFE

SEQ ID NO: 46736 - protein, 25 aa, synthetic construct
  source 1..25: note = Seed: QTVHSIPLTINKEEALQRPVASDFE
QTVHSIPLTINKELALLRSVATDFE

SEQ ID NO: 46737 - protein, 25 aa, synthetic construct
  source 1..25: note = Seed: QTVHSIPLTINKEEALQRPVASDFE
QTVHSIPLTINKELALLRSVAVDFE

SEQ ID NO: 46738 - protein, 25 aa, synthetic construct
  source 1..25: note = Seed: QTVHSIPLTINKEEALQRPVASDFE
QTVHSIPLTINKELALLRTVAADFE

SEQ ID NO: 46739 - protein, 25 aa, synthetic construct
  source 1..25: note = Seed: QTVHSIPLTINKEEALQRPVASDFE
QTVHSIPLTINKELALLRTVAGDFE

SEQ ID NO: 46740 - protein, 25 aa, synthetic construct
  source 1..25: note = Seed: QTVHSIPLTINKEEALQRPVASDFE
QTVHSIPLTINKELALLRTVAHDFE

SEQ ID NO: 46741 - protein, 25 aa, synthetic construct
  source 1..25: note = Seed: QTVHSIPLTINKEEALQRPVASDFE
QTVHSIPLTINKELALLRTVAIDFE

SEQ ID NO: 46742 - protein, 25 aa, synthetic construct
  source 1..25: note = Seed: QTVHSIPLTINKEEALQRPVASDFE
QTVHSIPLTINKELALLRTVALDFE

SEQ ID NO: 46743 - protein, 25 aa, synthetic construct
  source 1..25: note = Seed: QTVHSIPLTINKEEALQRPVASDFE
QTVHSIPLTINKELALLRTVAMDFE

SEQ ID NO: 46744 - protein, 25 aa, synthetic construct
  source 1..25: note = Seed: QTVHSIPLTINKEEALQRPVASDFE
QTVHSIPLTINKELALLRTVANDFE

SEQ ID NO: 46745 - protein, 25 aa, synthetic construct
  source 1..25: note = Seed: QTVHSIPLTINKEEALQRPVASDFE
QTVHSIPLTINKELALLRTVAQDFE

SEQ ID NO: 46746 - protein, 25 aa, synthetic construct
  source 1..25: note = Seed: QTVHSIPLTINKEEALQRPVASDFE
QTVHSIPLTINKELALLRTVASDFE

SEQ ID NO: 46747 - protein, 25 aa, synthetic construct
  source 1..25: note = Seed: QTVHSIPLTINKEEALQRPVASDFE
QTVHSIPLTINKELALLRTVATDFE

SEQ ID NO: 46748 - protein, 25 aa, synthetic construct
  source 1..25: note = Seed: QTVHSIPLTINKEEALQRPVASDFE
QTVHSIPLTINKELALLRTVAVDFE

SEQ ID NO: 46749 - protein, 25 aa, synthetic construct
  source 1..25: note = Seed: QTVHSIPLTINKEEALQRPVASDFE
QTVHSIPLTINKELALLRVVAADFE

SEQ ID NO: 46750 - protein, 25 aa, synthetic construct
  source 1..25: note = Seed: QTVHSIPLTINKEEALQRPVASDFE
QTVHSIPLTINKELALLRVVAHDFE

SEQ ID NO: 46751 - protein, 25 aa, synthetic construct
  source 1..25: note = Seed: QTVHSIPLTINKEEALQRPVASDFE
QTVHSIPLTINKELALLRVVANDFE

SEQ ID NO: 46752 - protein, 25 aa, synthetic construct
  source 1..25: note = Seed: QTVHSIPLTINKEEALQRPVASDFE
QTVHSIPLTINKELALLRVVASDFE

SEQ ID NO: 46753 - protein, 25 aa, synthetic construct
  source 1..25: note = Seed: QTVHSIPLTINKEEALQRPVASDFE
QTVHSIPLTINKELALMRAVAADFE

SEQ ID NO: 46754 - protein, 25 aa, synthetic construct
  source 1..25: note = Seed: QTVHSIPLTINKEEALQRPVASDFE
QTVHSIPLTINKELALMRAVADDFE

SEQ ID NO: 46755 - protein, 25 aa, synthetic construct
  source 1..25: note = Seed: QTVHSIPLTINKEEALQRPVASDFE
QTVHSIPLTINKELALMRAVAEDFE

SEQ ID NO: 46756 - protein, 25 aa, synthetic construct
  source 1..25: note = Seed: QTVHSIPLTINKEEALQRPVASDFE
QTVHSIPLTINKELALMRAVAGDFE

SEQ ID NO: 46757 - protein, 25 aa, synthetic construct
  source 1..25: note = Seed: QTVHSIPLTINKEEALQRPVASDFE
QTVHSIPLTINKELALMRAVAHDFE

SEQ ID NO: 46758 - protein, 25 aa, synthetic construct
  source 1..25: note = Seed: QTVHSIPLTINKEEALQRPVASDFE
QTVHSIPLTINKELALMRAVAIDFE

SEQ ID NO: 46759 - protein, 25 aa, synthetic construct
  source 1..25: note = Seed: QTVHSIPLTINKEEALQRPVASDFE
QTVHSIPLTINKELALMRAVALDFE

SEQ ID NO: 46760 - protein, 25 aa, synthetic construct
  source 1..25: note = Seed: QTVHSIPLTINKEEALQRPVASDFE
QTVHSIPLTINKELALMRAVAMDFE

SEQ ID NO: 46761 - protein, 25 aa, synthetic construct
  source 1..25: note = Seed: QTVHSIPLTINKEEALQRPVASDFE
QTVHSIPLTINKELALMRAVANDFE

SEQ ID NO: 46762 - protein, 25 aa, synthetic construct
  source 1..25: note = Seed: QTVHSIPLTINKEEALQRPVASDFE
QTVHSIPLTINKELALMRAVAPDFE

SEQ ID NO: 46763 - protein, 25 aa, synthetic construct
  source 1..25: note = Seed: QTVHSIPLTINKEEALQRPVASDFE
QTVHSIPLTINKELALMRAVAQDFE

SEQ ID NO: 46764 - protein, 25 aa, synthetic construct
  source 1..25: note = Seed: QTVHSIPLTINKEEALQRPVASDFE
QTVHSIPLTINKELALMRAVASDFE

SEQ ID NO: 46765 - protein, 25 aa, synthetic construct
  source 1..25: note = Seed: QTVHSIPLTINKEEALQRPVASDFE
QTVHSIPLTINKELALMRAVATDFE

SEQ ID NO: 46766 - protein, 25 aa, synthetic construct
  source 1..25: note = Seed: QTVHSIPLTINKEEALQRPVASDFE
QTVHSIPLTINKELALMRAVAVDFE

SEQ ID NO: 46767 - protein, 25 aa, synthetic construct
  source 1..25: note = Seed: QTVHSIPLTINKEEALQRPVASDFE
QTVHSIPLTINKELALMRGVAADFE

SEQ ID NO: 46768 - protein, 25 aa, synthetic construct
  source 1..25: note = Seed: QTVHSIPLTINKEEALQRPVASDFE
QTVHSIPLTINKELALMRGVAGDFE

SEQ ID NO: 46769 - protein, 25 aa, synthetic construct
  source 1..25: note = Seed: QTVHSIPLTINKEEALQRPVASDFE
QTVHSIPLTINKELALMRGVAHDFE

SEQ ID NO: 46770 - protein, 25 aa, synthetic construct
  source 1..25: note = Seed: QTVHSIPLTINKEEALQRPVASDFE
QTVHSIPLTINKELALMRGVAIDFE

SEQ ID NO: 46771 - protein, 25 aa, synthetic construct
  source 1..25: note = Seed: QTVHSIPLTINKEEALQRPVASDFE
QTVHSIPLTINKELALMRGVALDFE

SEQ ID NO: 46772 - protein, 25 aa, synthetic construct
  source 1..25: note = Seed: QTVHSIPLTINKEEALQRPVASDFE
QTVHSIPLTINKELALMRGVAMDFE

SEQ ID NO: 46773 - protein, 25 aa, synthetic construct
  source 1..25: note = Seed: QTVHSIPLTINKEEALQRPVASDFE
QTVHSIPLTINKELALMRGVANDFE

SEQ ID NO: 46774 - protein, 25 aa, synthetic construct
  source 1..25: note = Seed: QTVHSIPLTINKEEALQRPVASDFE
QTVHSIPLTINKELALMRGVAQDFE

SEQ ID NO: 46775 - protein, 25 aa, synthetic construct
  source 1..25: note = Seed: QTVHSIPLTINKEEALQRPVASDFE
QTVHSIPLTINKELALMRGVASDFE

SEQ ID NO: 46776 - protein, 25 aa, synthetic construct
  source 1..25: note = Seed: QTVHSIPLTINKEEALQRPVASDFE
QTVHSIPLTINKELALMRGVATDFE

SEQ ID NO: 46777 - protein, 25 aa, synthetic construct
  source 1..25: note = Seed: QTVHSIPLTINKEEALQRPVASDFE
QTVHSIPLTINKELALMRGVAVDFE

SEQ ID NO: 46778 - protein, 25 aa, synthetic construct
  source 1..25: note = Seed: QTVHSIPLTINKEEALQRPVASDFE
QTVHSIPLTINKELALMRIVAADFE

SEQ ID NO: 46779 - protein, 25 aa, synthetic construct
  source 1..25: note = Seed: QTVHSIPLTINKEEALQRPVASDFE
QTVHSIPLTINKELALMRIVAHDFE

SEQ ID NO: 46780 - protein, 25 aa, synthetic construct
  source 1..25: note = Seed: QTVHSIPLTINKEEALQRPVASDFE
QTVHSIPLTINKELALMRIVANDFE

SEQ ID NO: 46781 - protein, 25 aa, synthetic construct
  source 1..25: note = Seed: QTVHSIPLTINKEEALQRPVASDFE
QTVHSIPLTINKELALMRIVASDFE

SEQ ID NO: 46782 - protein, 25 aa, synthetic construct
  source 1..25: note = Seed: QTVHSIPLTINKEEALQRPVASDFE
QTVHSIPLTINKELALMRNVAADFE

SEQ ID NO: 46783 - protein, 25 aa, synthetic construct
  source 1..25: note = Seed: QTVHSIPLTINKEEALQRPVASDFE
QTVHSIPLTINKELALMRNVAGDFE

SEQ ID NO: 46784 - protein, 25 aa, synthetic construct
  source 1..25: note = Seed: QTVHSIPLTINKEEALQRPVASDFE
QTVHSIPLTINKELALMRNVAHDFE

SEQ ID NO: 46785 - protein, 25 aa, synthetic construct
  source 1..25: note = Seed: QTVHSIPLTINKEEALQRPVASDFE
QTVHSIPLTINKELALMRNVAIDFE

SEQ ID NO: 46786 - protein, 25 aa, synthetic construct
  source 1..25: note = Seed: QTVHSIPLTINKEEALQRPVASDFE
QTVHSIPLTINKELALMRNVALDFE

SEQ ID NO: 46787 - protein, 25 aa, synthetic construct
  source 1..25: note = Seed: QTVHSIPLTINKEEALQRPVASDFE
QTVHSIPLTINKELALMRNVAMDFE

SEQ ID NO: 46788 - protein, 25 aa, synthetic construct
  source 1..25: note = Seed: QTVHSIPLTINKEEALQRPVASDFE
QTVHSIPLTINKELALMRNVANDFE

SEQ ID NO: 46789 - protein, 25 aa, synthetic construct
  source 1..25: note = Seed: QTVHSIPLTINKEEALQRPVASDFE
QTVHSIPLTINKELALMRNVASDFE

SEQ ID NO: 46790 - protein, 25 aa, synthetic construct
  source 1..25: note = Seed: QTVHSIPLTINKEEALQRPVASDFE
QTVHSIPLTINKELALMRNVATDFE

SEQ ID NO: 46791 - protein, 25 aa, synthetic construct
  source 1..25: note = Seed: QTVHSIPLTINKEEALQRPVASDFE
QTVHSIPLTINKELALMRNVAVDFE

SEQ ID NO: 46792 - protein, 25 aa, synthetic construct
  source 1..25: note = Seed: QTVHSIPLTINKEEALQRPVASDFE
QTVHSIPLTINKELALMRPVAADFE

SEQ ID NO: 46793 - protein, 25 aa, synthetic construct
  source 1..25: note = Seed: QTVHSIPLTINKEEALQRPVASDFE
QTVHSIPLTINKELALMRPVACDFE

SEQ ID NO: 46794 - protein, 25 aa, synthetic construct
  source 1..25: note = Seed: QTVHSIPLTINKEEALQRPVASDFE
QTVHSIPLTINKELALMRPVADDFE

SEQ ID NO: 46795 - protein, 25 aa, synthetic construct
  source 1..25: note = Seed: QTVHSIPLTINKEEALQRPVASDFE
QTVHSIPLTINKELALMRPVAEDFE

SEQ ID NO: 46796 - protein, 25 aa, synthetic construct
  source 1..25: note = Seed: QTVHSIPLTINKEEALQRPVASDFE
QTVHSIPLTINKELALMRPVAGDFE

SEQ ID NO: 46797 - protein, 25 aa, synthetic construct
  source 1..25: note = Seed: QTVHSIPLTINKEEALQRPVASDFE
QTVHSIPLTINKELALMRPVAHDFE

SEQ ID NO: 46798 - protein, 25 aa, synthetic construct
  source 1..25: note = Seed: QTVHSIPLTINKEEALQRPVASDFE
QTVHSIPLTINKELALMRPVAIDFE

SEQ ID NO: 46799 - protein, 25 aa, synthetic construct
  source 1..25: note = Seed: QTVHSIPLTINKEEALQRPVASDFE
QTVHSIPLTINKELALMRPVALDFE

SEQ ID NO: 46800 - protein, 25 aa, synthetic construct
  source 1..25: note = Seed: QTVHSIPLTINKEEALQRPVASDFE
QTVHSIPLTINKELALMRPVAMDFE

SEQ ID NO: 46801 - protein, 25 aa, synthetic construct
  source 1..25: note = Seed: QTVHSIPLTINKEEALQRPVASDFE
QTVHSIPLTINKELALMRPVANDFE

SEQ ID NO: 46802 - protein, 25 aa, synthetic construct
  source 1..25: note = Seed: QTVHSIPLTINKEEALQRPVASDFE
QTVHSIPLTINKELALMRPVAPDFE

SEQ ID NO: 46803 - protein, 25 aa, synthetic construct
  source 1..25: note = Seed: QTVHSIPLTINKEEALQRPVASDFE
QTVHSIPLTINKELALMRPVAQDFE

SEQ ID NO: 46804 - protein, 25 aa, synthetic construct
  source 1..25: note = Seed: QTVHSIPLTINKEEALQRPVASDFE
QTVHSIPLTINKELALMRPVASDFE

SEQ ID NO: 46805 - protein, 25 aa, synthetic construct
  source 1..25: note = Seed: QTVHSIPLTINKEEALQRPVASDFE
QTVHSIPLTINKELALMRPVATDFE

SEQ ID NO: 46806 - protein, 25 aa, synthetic construct
  source 1..25: note = Seed: QTVHSIPLTINKEEALQRPVASDFE
QTVHSIPLTINKELALMRPVAVDFE

SEQ ID NO: 46807 - protein, 25 aa, synthetic construct
  source 1..25: note = Seed: QTVHSIPLTINKEEALQRPVASDFE
QTVHSIPLTINKELALMRSVAADFE

SEQ ID NO: 46808 - protein, 25 aa, synthetic construct
  source 1..25: note = Seed: QTVHSIPLTINKEEALQRPVASDFE
QTVHSIPLTINKELALMRSVADDFE

SEQ ID NO: 46809 - protein, 25 aa, synthetic construct
  source 1..25: note = Seed: QTVHSIPLTINKEEALQRPVASDFE
QTVHSIPLTINKELALMRSVAGDFE

SEQ ID NO: 46810 - protein, 25 aa, synthetic construct
  source 1..25: note = Seed: QTVHSIPLTINKEEALQRPVASDFE
QTVHSIPLTINKELALMRSVAHDFE

SEQ ID NO: 46811 - protein, 25 aa, synthetic construct
  source 1..25: note = Seed: QTVHSIPLTINKEEALQRPVASDFE
QTVHSIPLTINKELALMRSVAIDFE

SEQ ID NO: 46812 - protein, 25 aa, synthetic construct
  source 1..25: note = Seed: QTVHSIPLTINKEEALQRPVASDFE
QTVHSIPLTINKELALMRSVALDFE

SEQ ID NO: 46813 - protein, 25 aa, synthetic construct
  source 1..25: note = Seed: QTVHSIPLTINKEEALQRPVASDFE
QTVHSIPLTINKELALMRSVAMDFE

SEQ ID NO: 46814 - protein, 25 aa, synthetic construct
  source 1..25: note = Seed: QTVHSIPLTINKEEALQRPVASDFE
QTVHSIPLTINKELALMRSVANDFE

SEQ ID NO: 46815 - protein, 25 aa, synthetic construct
  source 1..25: note = Seed: QTVHSIPLTINKEEALQRPVASDFE
QTVHSIPLTINKELALMRSVAQDFE

SEQ ID NO: 46816 - protein, 25 aa, synthetic construct
  source 1..25: note = Seed: QTVHSIPLTINKEEALQRPVASDFE
QTVHSIPLTINKELALMRSVASDFE

SEQ ID NO: 46817 - protein, 25 aa, synthetic construct
  source 1..25: note = Seed: QTVHSIPLTINKEEALQRPVASDFE
QTVHSIPLTINKELALMRSVATDFE

SEQ ID NO: 46818 - protein, 25 aa, synthetic construct
  source 1..25: note = Seed: QTVHSIPLTINKEEALQRPVASDFE
QTVHSIPLTINKELALMRSVAVDFE

SEQ ID NO: 46819 - protein, 25 aa, synthetic construct
  source 1..25: note = Seed: QTVHSIPLTINKEEALQRPVASDFE
QTVHSIPLTINKELALMRTVAADFE

SEQ ID NO: 46820 - protein, 25 aa, synthetic construct
  source 1..25: note = Seed: QTVHSIPLTINKEEALQRPVASDFE
QTVHSIPLTINKELALMRTVAGDFE

SEQ ID NO: 46821 - protein, 25 aa, synthetic construct
  source 1..25: note = Seed: QTVHSIPLTINKEEALQRPVASDFE
QTVHSIPLTINKELALMRTVAHDFE

SEQ ID NO: 46822 - protein, 25 aa, synthetic construct
  source 1..25: note = Seed: QTVHSIPLTINKEEALQRPVASDFE
QTVHSIPLTINKELALMRTVAIDFE

SEQ ID NO: 46823 - protein, 25 aa, synthetic construct
  source 1..25: note = Seed: QTVHSIPLTINKEEALQRPVASDFE
QTVHSIPLTINKELALMRTVALDFE

SEQ ID NO: 46824 - protein, 25 aa, synthetic construct
  source 1..25: note = Seed: QTVHSIPLTINKEEALQRPVASDFE
QTVHSIPLTINKELALMRTVAMDFE

SEQ ID NO: 46825 - protein, 25 aa, synthetic construct
  source 1..25: note = Seed: QTVHSIPLTINKEEALQRPVASDFE
QTVHSIPLTINKELALMRTVANDFE

SEQ ID NO: 46826 - protein, 25 aa, synthetic construct
  source 1..25: note = Seed: QTVHSIPLTINKEEALQRPVASDFE
QTVHSIPLTINKELALMRTVAQDFE

SEQ ID NO: 46827 - protein, 25 aa, synthetic construct
  source 1..25: note = Seed: QTVHSIPLTINKEEALQRPVASDFE
QTVHSIPLTINKELALMRTVASDFE

SEQ ID NO: 46828 - protein, 25 aa, synthetic construct
  source 1..25: note = Seed: QTVHSIPLTINKEEALQRPVASDFE
QTVHSIPLTINKELALMRTVATDFE

SEQ ID NO: 46829 - protein, 25 aa, synthetic construct
  source 1..25: note = Seed: QTVHSIPLTINKEEALQRPVASDFE
QTVHSIPLTINKELALMRTVAVDFE

SEQ ID NO: 46830 - protein, 25 aa, synthetic construct
  source 1..25: note = Seed: QTVHSIPLTINKEEALQRPVASDFE
QTVHSIPLTINKELALMRVVAADFE

SEQ ID NO: 46831 - protein, 25 aa, synthetic construct
  source 1..25: note = Seed: QTVHSIPLTINKEEALQRPVASDFE
QTVHSIPLTINKELALMRVVAGDFE

SEQ ID NO: 46832 - protein, 25 aa, synthetic construct
  source 1..25: note = Seed: QTVHSIPLTINKEEALQRPVASDFE
QTVHSIPLTINKELALMRVVAHDFE

SEQ ID NO: 46833 - protein, 25 aa, synthetic construct
  source 1..25: note = Seed: QTVHSIPLTINKEEALQRPVASDFE
QTVHSIPLTINKELALMRVVANDFE

SEQ ID NO: 46834 - protein, 25 aa, synthetic construct
  source 1..25: note = Seed: QTVHSIPLTINKEEALQRPVASDFE
QTVHSIPLTINKELALMRVVAQDFE

SEQ ID NO: 46835 - protein, 25 aa, synthetic construct
  source 1..25: note = Seed: QTVHSIPLTINKEEALQRPVASDFE
QTVHSIPLTINKELALMRVVASDFE

SEQ ID NO: 46836 - protein, 25 aa, synthetic construct
  source 1..25: note = Seed: QTVHSIPLTINKEEALQRPVASDFE
QTVHSIPLTINKELALMRVVATDFE

SEQ ID NO: 46837 - protein, 25 aa, synthetic construct
  source 1..25: note = Seed: QTVHSIPLTINKEEALQRPVASDFE
QTVHSIPLTINKELALQRAVAADFE

SEQ ID NO: 46838 - protein, 25 aa, synthetic construct
  source 1..25: note = Seed: QTVHSIPLTINKEEALQRPVASDFE
QTVHSIPLTINKELALQRAVAHDFE

SEQ ID NO: 46839 - protein, 25 aa, synthetic construct
  source 1..25: note = Seed: QTVHSIPLTINKEEALQRPVASDFE
QTVHSIPLTINKELALQRAVAIDFE

SEQ ID NO: 46840 - protein, 25 aa, synthetic construct
  source 1..25: note = Seed: QTVHSIPLTINKEEALQRPVASDFE
QTVHSIPLTINKELALQRAVALDFE

SEQ ID NO: 46841 - protein, 25 aa, synthetic construct
  source 1..25: note = Seed: QTVHSIPLTINKEEALQRPVASDFE
QTVHSIPLTINKELALQRAVAMDFE

SEQ ID NO: 46842 - protein, 25 aa, synthetic construct
  source 1..25: note = Seed: QTVHSIPLTINKEEALQRPVASDFE
QTVHSIPLTINKELALQRAVANDFE

SEQ ID NO: 46843 - protein, 25 aa, synthetic construct
  source 1..25: note = Seed: QTVHSIPLTINKEEALQRPVASDFE
QTVHSIPLTINKELALQRAVASDFE

SEQ ID NO: 46844 - protein, 25 aa, synthetic construct
  source 1..25: note = Seed: QTVHSIPLTINKEEALQRPVASDFE
QTVHSIPLTINKELALQRAVATDFE

SEQ ID NO: 46845 - protein, 25 aa, synthetic construct
  source 1..25: note = Seed: QTVHSIPLTINKEEALQRPVASDFE
QTVHSIPLTINKELALQRAVAVDFE

SEQ ID NO: 46846 - protein, 25 aa, synthetic construct
  source 1..25: note = Seed: QTVHSIPLTINKEEALQRPVASDFE
QTVHSIPLTINKELALQRGVAADFE

SEQ ID NO: 46847 - protein, 25 aa, synthetic construct
  source 1..25: note = Seed: QTVHSIPLTINKEEALQRPVASDFE
QTVHSIPLTINKELALQRGVANDFE

SEQ ID NO: 46848 - protein, 25 aa, synthetic construct
  source 1..25: note = Seed: QTVHSIPLTINKEEALQRPVASDFE
QTVHSIPLTINKELALQRGVASDFE

SEQ ID NO: 46849 - protein, 25 aa, synthetic construct
  source 1..25: note = Seed: QTVHSIPLTINKEEALQRPVASDFE
QTVHSIPLTINKELALQRIVAADFE

SEQ ID NO: 46850 - protein, 25 aa, synthetic construct
  source 1..25: note = Seed: QTVHSIPLTINKEEALQRPVASDFE
QTVHSIPLTINKELALQRIVANDFE

SEQ ID NO: 46851 - protein, 25 aa, synthetic construct
  source 1..25: note = Seed: QTVHSIPLTINKEEALQRPVASDFE
QTVHSIPLTINKELALQRIVASDFE

SEQ ID NO: 46852 - protein, 25 aa, synthetic construct
  source 1..25: note = Seed: QTVHSIPLTINKEEALQRPVASDFE
QTVHSIPLTINKELALQRPVAADFE

SEQ ID NO: 46853 - protein, 25 aa, synthetic construct
  source 1..25: note = Seed: QTVHSIPLTINKEEALQRPVASDFE
QTVHSIPLTINKELALQRPVANDFE

SEQ ID NO: 46854 - protein, 25 aa, synthetic construct
  source 1..25: note = Seed: QTVHSIPLTINKEEALQRPVASDFE
QTVHSIPLTINKELALQRPVASDFE

SEQ ID NO: 46855 - protein, 25 aa, synthetic construct
  source 1..25: note = Seed: QTVHSIPLTINKEEALQRPVASDFE
QTVHSIPLTINKELALQRSVAADFE

SEQ ID NO: 46856 - protein, 25 aa, synthetic construct
  source 1..25: note = Seed: QTVHSIPLTINKEEALQRPVASDFE
QTVHSIPLTINKELALQRSVANDFE

SEQ ID NO: 46857 - protein, 25 aa, synthetic construct
  source 1..25: note = Seed: QTVHSIPLTINKEEALQRPVASDFE
QTVHSIPLTINKELALQRSVASDFE

SEQ ID NO: 46858 - protein, 25 aa, synthetic construct
  source 1..25: note = Seed: QTVHSIPLTINKEEALQRPVASDFE
QTVHSIPLTINKELALQRTVAADFE

SEQ ID NO: 46859 - protein, 25 aa, synthetic construct
  source 1..25: note = Seed: QTVHSIPLTINKEEALQRPVASDFE
QTVHSIPLTINKELALQRTVANDFE

SEQ ID NO: 46860 - protein, 25 aa, synthetic construct
  source 1..25: note = Seed: QTVHSIPLTINKEEALQRPVASDFE
QTVHSIPLTINKELALQRTVASDFE

SEQ ID NO: 46861 - protein, 25 aa, synthetic construct
  source 1..25: note = Seed: QTVHSIPLTINKEEALQRPVASDFE
QTVHSIPLTINKELALQRVVAADFE

SEQ ID NO: 46862 - protein, 25 aa, synthetic construct
  source 1..25: note = Seed: QTVHSIPLTINKEEALQRPVASDFE
QTVHSIPLTINKELALQRVVANDFE

SEQ ID NO: 46863 - protein, 25 aa, synthetic construct
  source 1..25: note = Seed: QTVHSIPLTINKEEALQRPVASDFE
QTVHSIPLTINKELALQRVVASDFE

SEQ ID NO: 46864 - protein, 25 aa, synthetic construct
  source 1..25: note = Seed: QTVHSIPLTINKEEALQRPVASDFE
QTVHSIPLTINKELALSRAVAADFE

SEQ ID NO: 46865 - protein, 25 aa, synthetic construct
  source 1..25: note = Seed: QTVHSIPLTINKEEALQRPVASDFE
QTVHSIPLTINKELALSRAVANDFE

SEQ ID NO: 46866 - protein, 25 aa, synthetic construct
  source 1..25: note = Seed: QTVHSIPLTINKEEALQRPVASDFE
QTVHSIPLTINKELALSRAVASDFE

SEQ ID NO: 46867 - protein, 25 aa, synthetic construct
  source 1..25: note = Seed: QTVHSIPLTINKEEALQRPVASDFE
QTVHSIPLTINKELALSRPVAADFE

SEQ ID NO: 46868 - protein, 25 aa, synthetic construct
  source 1..25: note = Seed: QTVHSIPLTINKEEALQRPVASDFE
QTVHSIPLTINKELALSRPVANDFE

SEQ ID NO: 46869 - protein, 25 aa, synthetic construct
  source 1..25: note = Seed: QTVHSIPLTINKEEALQRPVASDFE
QTVHSIPLTINKELALSRSVAADFE

SEQ ID NO: 46870 - protein, 25 aa, synthetic construct
  source 1..25: note = Seed: QTVHSIPLTINKEEALQRPVASDFE
QTVHSIPLTINKELALTRAVAADFE

SEQ ID NO: 46871 - protein, 25 aa, synthetic construct
  source 1..25: note = Seed: QTVHSIPLTINKEEALQRPVASDFE
QTVHSIPLTINKELALTRAVANDFE

SEQ ID NO: 46872 - protein, 25 aa, synthetic construct
  source 1..25: note = Seed: QTVHSIPLTINKEEALQRPVASDFE
QTVHSIPLTINKELALTRAVASDFE

SEQ ID NO: 46873 - protein, 25 aa, synthetic construct
  source 1..25: note = Seed: QTVHSIPLTINKEEALQRPVASDFE
QTVHSIPLTINKELALTRPVAADFE

SEQ ID NO: 46874 - protein, 25 aa, synthetic construct
  source 1..25: note = Seed: QTVHSIPLTINKEEALQRPVASDFE
QTVHSIPLTINKELALVRAVAADFE

SEQ ID NO: 46875 - protein, 25 aa, synthetic construct
  source 1..25: note = Seed: QTVHSIPLTINKEEALQRPVASDFE
QTVHSIPLTINKELALVRAVAHDFE

SEQ ID NO: 46876 - protein, 25 aa, synthetic construct
  source 1..25: note = Seed: QTVHSIPLTINKEEALQRPVASDFE
QTVHSIPLTINKELALVRAVANDFE

SEQ ID NO: 46877 - protein, 25 aa, synthetic construct
  source 1..25: note = Seed: QTVHSIPLTINKEEALQRPVASDFE
QTVHSIPLTINKELALVRAVASDFE

SEQ ID NO: 46878 - protein, 25 aa, synthetic construct
  source 1..25: note = Seed: QTVHSIPLTINKEEALQRPVASDFE
QTVHSIPLTINKELALVRAVATDFE

SEQ ID NO: 46879 - protein, 25 aa, synthetic construct
  source 1..25: note = Seed: QTVHSIPLTINKEEALQRPVASDFE
QTVHSIPLTINKELALVRGVAADFE

SEQ ID NO: 46880 - protein, 25 aa, synthetic construct
  source 1..25: note = Seed: QTVHSIPLTINKEEALQRPVASDFE
QTVHSIPLTINKELALVRGVANDFE

SEQ ID NO: 46881 - protein, 25 aa, synthetic construct
  source 1..25: note = Seed: QTVHSIPLTINKEEALQRPVASDFE
QTVHSIPLTINKELALVRGVASDFE

SEQ ID NO: 46882 - protein, 25 aa, synthetic construct
  source 1..25: note = Seed: QTVHSIPLTINKEEALQRPVASDFE
QTVHSIPLTINKELALVRNVAADFE

SEQ ID NO: 46883 - protein, 25 aa, synthetic construct
  source 1..25: note = Seed: QTVHSIPLTINKEEALQRPVASDFE
QTVHSIPLTINKELALVRPVAADFE

SEQ ID NO: 46884 - protein, 25 aa, synthetic construct
  source 1..25: note = Seed: QTVHSIPLTINKEEALQRPVASDFE
QTVHSIPLTINKELALVRPVANDFE

SEQ ID NO: 46885 - protein, 25 aa, synthetic construct
  source 1..25: note = Seed: QTVHSIPLTINKEEALQRPVASDFE
QTVHSIPLTINKELALVRPVASDFE

SEQ ID NO: 46886 - protein, 25 aa, synthetic construct
  source 1..25: note = Seed: QTVHSIPLTINKEEALQRPVASDFE
QTVHSIPLTINKELALVRPVATDFE

SEQ ID NO: 46887 - protein, 25 aa, synthetic construct
  source 1..25: note = Seed: QTVHSIPLTINKEEALQRPVASDFE
QTVHSIPLTINKELALVRSVAADFE

SEQ ID NO: 46888 - protein, 25 aa, synthetic construct
  source 1..25: note = Seed: QTVHSIPLTINKEEALQRPVASDFE
QTVHSIPLTINKELALVRSVANDFE

SEQ ID NO: 46889 - protein, 25 aa, synthetic construct
  source 1..25: note = Seed: QTVHSIPLTINKEEALQRPVASDFE
QTVHSIPLTINKELALVRSVASDFE

SEQ ID NO: 46890 - protein, 25 aa, synthetic construct
  source 1..25: note = Seed: QTVHSIPLTINKEEALQRPVASDFE
QTVHSIPLTINKELALVRTVAADFE

SEQ ID NO: 46891 - protein, 25 aa, synthetic construct
  source 1..25: note = Seed: QTVHSIPLTINKEEALQRPVASDFE
QTVHSIPLTINKELALVRTVANDFE

SEQ ID NO: 46892 - protein, 25 aa, synthetic construct
  source 1..25: note = Seed: QTVHSIPLTINKEEALQRPVASDFE
QTVHSIPLTINKELALVRTVASDFE

SEQ ID NO: 46893 - protein, 25 aa, synthetic construct
  source 1..25: note = Seed: QTVHSIPLTINKEEALQRPVASDFE
QTVHSIPLTINKELALVRVVANDFE

SEQ ID NO: 46894 - protein, 25 aa, synthetic construct
  source 1..25: note = Seed: QTVHSIPLTINKEEALQRPVASDFE
QTVHSIPLTINKEMALARAVAADFE

SEQ ID NO: 46895 - protein, 25 aa, synthetic construct
  source 1..25: note = Seed: QTVHSIPLTINKEEALQRPVASDFE
QTVHSIPLTINKEMALARAVAGDFE

SEQ ID NO: 46896 - protein, 25 aa, synthetic construct
  source 1..25: note = Seed: QTVHSIPLTINKEEALQRPVASDFE
QTVHSIPLTINKEMALARAVAHDFE

SEQ ID NO: 46897 - protein, 25 aa, synthetic construct
  source 1..25: note = Seed: QTVHSIPLTINKEEALQRPVASDFE
QTVHSIPLTINKEMALARAVAIDFE

SEQ ID NO: 46898 - protein, 25 aa, synthetic construct
  source 1..25: note = Seed: QTVHSIPLTINKEEALQRPVASDFE
QTVHSIPLTINKEMALARAVALDFE

SEQ ID NO: 46899 - protein, 25 aa, synthetic construct
  source 1..25: note = Seed: QTVHSIPLTINKEEALQRPVASDFE
QTVHSIPLTINKEMALARAVAMDFE

SEQ ID NO: 46900 - protein, 25 aa, synthetic construct
  source 1..25: note = Seed: QTVHSIPLTINKEEALQRPVASDFE
QTVHSIPLTINKEMALARAVANDFE

SEQ ID NO: 46901 - protein, 25 aa, synthetic construct
  source 1..25: note = Seed: QTVHSIPLTINKEEALQRPVASDFE
QTVHSIPLTINKEMALARAVAQDFE

SEQ ID NO: 46902 - protein, 25 aa, synthetic construct
  source 1..25: note = Seed: QTVHSIPLTINKEEALQRPVASDFE
QTVHSIPLTINKEMALARAVASDFE

SEQ ID NO: 46903 - protein, 25 aa, synthetic construct
  source 1..25: note = Seed: QTVHSIPLTINKEEALQRPVASDFE
QTVHSIPLTINKEMALARAVATDFE

SEQ ID NO: 46904 - protein, 25 aa, synthetic construct
  source 1..25: note = Seed: QTVHSIPLTINKEEALQRPVASDFE
QTVHSIPLTINKEMALARAVAVDFE

SEQ ID NO: 46905 - protein, 25 aa, synthetic construct
  source 1..25: note = Seed: QTVHSIPLTINKEEALQRPVASDFE
QTVHSIPLTINKEMALARGVAADFE

SEQ ID NO: 46906 - protein, 25 aa, synthetic construct
  source 1..25: note = Seed: QTVHSIPLTINKEEALQRPVASDFE
QTVHSIPLTINKEMALARGVANDFE

SEQ ID NO: 46907 - protein, 25 aa, synthetic construct
  source 1..25: note = Seed: QTVHSIPLTINKEEALQRPVASDFE
QTVHSIPLTINKEMALARGVASDFE

SEQ ID NO: 46908 - protein, 25 aa, synthetic construct
  source 1..25: note = Seed: QTVHSIPLTINKEEALQRPVASDFE
QTVHSIPLTINKEMALARIVAADFE

SEQ ID NO: 46909 - protein, 25 aa, synthetic construct
  source 1..25: note = Seed: QTVHSIPLTINKEEALQRPVASDFE
QTVHSIPLTINKEMALARIVANDFE

SEQ ID NO: 46910 - protein, 25 aa, synthetic construct
  source 1..25: note = Seed: QTVHSIPLTINKEEALQRPVASDFE
QTVHSIPLTINKEMALARIVASDFE

SEQ ID NO: 46911 - protein, 25 aa, synthetic construct
  source 1..25: note = Seed: QTVHSIPLTINKEEALQRPVASDFE
QTVHSIPLTINKEMALARNVAADFE

SEQ ID NO: 46912 - protein, 25 aa, synthetic construct
  source 1..25: note = Seed: QTVHSIPLTINKEEALQRPVASDFE
QTVHSIPLTINKEMALARPVAADFE

SEQ ID NO: 46913 - protein, 25 aa, synthetic construct
  source 1..25: note = Seed: QTVHSIPLTINKEEALQRPVASDFE
QTVHSIPLTINKEMALARPVAIDFE

SEQ ID NO: 46914 - protein, 25 aa, synthetic construct
  source 1..25: note = Seed: QTVHSIPLTINKEEALQRPVASDFE
QTVHSIPLTINKEMALARPVAMDFE

SEQ ID NO: 46915 - protein, 25 aa, synthetic construct
  source 1..25: note = Seed: QTVHSIPLTINKEEALQRPVASDFE
QTVHSIPLTINKEMALARPVANDFE

SEQ ID NO: 46916 - protein, 25 aa, synthetic construct
  source 1..25: note = Seed: QTVHSIPLTINKEEALQRPVASDFE
QTVHSIPLTINKEMALARPVASDFE

SEQ ID NO: 46917 - protein, 25 aa, synthetic construct
  source 1..25: note = Seed: QTVHSIPLTINKEEALQRPVASDFE
QTVHSIPLTINKEMALARPVATDFE

SEQ ID NO: 46918 - protein, 25 aa, synthetic construct
  source 1..25: note = Seed: QTVHSIPLTINKEEALQRPVASDFE
QTVHSIPLTINKEMALARPVAVDFE

SEQ ID NO: 46919 - protein, 25 aa, synthetic construct
  source 1..25: note = Seed: QTVHSIPLTINKEEALQRPVASDFE
QTVHSIPLTINKEMALARSVAADFE

SEQ ID NO: 46920 - protein, 25 aa, synthetic construct
  source 1..25: note = Seed: QTVHSIPLTINKEEALQRPVASDFE
QTVHSIPLTINKEMALARSVAIDFE

SEQ ID NO: 46921 - protein, 25 aa, synthetic construct
  source 1..25: note = Seed: QTVHSIPLTINKEEALQRPVASDFE
QTVHSIPLTINKEMALARSVANDFE

SEQ ID NO: 46922 - protein, 25 aa, synthetic construct
  source 1..25: note = Seed: QTVHSIPLTINKEEALQRPVASDFE
QTVHSIPLTINKEMALARSVASDFE

SEQ ID NO: 46923 - protein, 25 aa, synthetic construct
  source 1..25: note = Seed: QTVHSIPLTINKEEALQRPVASDFE
QTVHSIPLTINKEMALARSVATDFE

SEQ ID NO: 46924 - protein, 25 aa, synthetic construct
  source 1..25: note = Seed: QTVHSIPLTINKEEALQRPVASDFE
QTVHSIPLTINKEMALARSVAVDFE

SEQ ID NO: 46925 - protein, 25 aa, synthetic construct
  source 1..25: note = Seed: QTVHSIPLTINKEEALQRPVASDFE
QTVHSIPLTINKEMALARTVAADFE

SEQ ID NO: 46926 - protein, 25 aa, synthetic construct
  source 1..25: note = Seed: QTVHSIPLTINKEEALQRPVASDFE
QTVHSIPLTINKEMALARTVAIDFE

SEQ ID NO: 46927 - protein, 25 aa, synthetic construct
  source 1..25: note = Seed: QTVHSIPLTINKEEALQRPVASDFE
QTVHSIPLTINKEMALARTVAMDFE

SEQ ID NO: 46928 - protein, 25 aa, synthetic construct
  source 1..25: note = Seed: QTVHSIPLTINKEEALQRPVASDFE
QTVHSIPLTINKEMALARTVANDFE

SEQ ID NO: 46929 - protein, 25 aa, synthetic construct
  source 1..25: note = Seed: QTVHSIPLTINKEEALQRPVASDFE
QTVHSIPLTINKEMALARTVASDFE

SEQ ID NO: 46930 - protein, 25 aa, synthetic construct
  source 1..25: note = Seed: QTVHSIPLTINKEEALQRPVASDFE
QTVHSIPLTINKEMALARTVATDFE

SEQ ID NO: 46931 - protein, 25 aa, synthetic construct
  source 1..25: note = Seed: QTVHSIPLTINKEEALQRPVASDFE
QTVHSIPLTINKEMALARTVAVDFE

SEQ ID NO: 46932 - protein, 25 aa, synthetic construct
  source 1..25: note = Seed: QTVHSIPLTINKEEALQRPVASDFE
QTVHSIPLTINKEMALARVVAADFE

SEQ ID NO: 46933 - protein, 25 aa, synthetic construct
  source 1..25: note = Seed: QTVHSIPLTINKEEALQRPVASDFE
QTVHSIPLTINKEMALARVVANDFE

SEQ ID NO: 46934 - protein, 25 aa, synthetic construct
  source 1..25: note = Seed: QTVHSIPLTINKEEALQRPVASDFE
QTVHSIPLTINKEMALARVVASDFE

SEQ ID NO: 46935 - protein, 25 aa, synthetic construct
  source 1..25: note = Seed: QTVHSIPLTINKEEALQRPVASDFE
QTVHSIPLTINKEMALFRAVAADFE

SEQ ID NO: 46936 - protein, 25 aa, synthetic construct
  source 1..25: note = Seed: QTVHSIPLTINKEEALQRPVASDFE
QTVHSIPLTINKEMALFRAVASDFE

SEQ ID NO: 46937 - protein, 25 aa, synthetic construct
  source 1..25: note = Seed: QTVHSIPLTINKEEALQRPVASDFE
QTVHSIPLTINKEMALFRPVAADFE

SEQ ID NO: 46938 - protein, 25 aa, synthetic construct
  source 1..25: note = Seed: QTVHSIPLTINKEEALQRPVASDFE
QTVHSIPLTINKEMALIRAVAADFE

SEQ ID NO: 46939 - protein, 25 aa, synthetic construct
  source 1..25: note = Seed: QTVHSIPLTINKEEALQRPVASDFE
QTVHSIPLTINKEMALIRAVAGDFE

SEQ ID NO: 46940 - protein, 25 aa, synthetic construct
  source 1..25: note = Seed: QTVHSIPLTINKEEALQRPVASDFE
QTVHSIPLTINKEMALIRAVAHDFE

SEQ ID NO: 46941 - protein, 25 aa, synthetic construct
  source 1..25: note = Seed: QTVHSIPLTINKEEALQRPVASDFE
QTVHSIPLTINKEMALIRAVAMDFE

SEQ ID NO: 46942 - protein, 25 aa, synthetic construct
  source 1..25: note = Seed: QTVHSIPLTINKEEALQRPVASDFE
QTVHSIPLTINKEMALIRAVANDFE

SEQ ID NO: 46943 - protein, 25 aa, synthetic construct
  source 1..25: note = Seed: QTVHSIPLTINKEEALQRPVASDFE
QTVHSIPLTINKEMALIRAVASDFE

SEQ ID NO: 46944 - protein, 25 aa, synthetic construct
  source 1..25: note = Seed: QTVHSIPLTINKEEALQRPVASDFE
QTVHSIPLTINKEMALIRAVATDFE

SEQ ID NO: 46945 - protein, 25 aa, synthetic construct
  source 1..25: note = Seed: QTVHSIPLTINKEEALQRPVASDFE
QTVHSIPLTINKEMALIRAVAVDFE

SEQ ID NO: 46946 - protein, 25 aa, synthetic construct
  source 1..25: note = Seed: QTVHSIPLTINKEEALQRPVASDFE
QTVHSIPLTINKEMALIRGVAADFE

SEQ ID NO: 46947 - protein, 25 aa, synthetic construct
  source 1..25: note = Seed: QTVHSIPLTINKEEALQRPVASDFE
QTVHSIPLTINKEMALIRGVANDFE

SEQ ID NO: 46948 - protein, 25 aa, synthetic construct
  source 1..25: note = Seed: QTVHSIPLTINKEEALQRPVASDFE
QTVHSIPLTINKEMALIRGVASDFE

SEQ ID NO: 46949 - protein, 25 aa, synthetic construct
  source 1..25: note = Seed: QTVHSIPLTINKEEALQRPVASDFE
QTVHSIPLTINKEMALIRIVANDFE

SEQ ID NO: 46950 - protein, 25 aa, synthetic construct
  source 1..25: note = Seed: QTVHSIPLTINKEEALQRPVASDFE
QTVHSIPLTINKEMALIRNVAADFE

SEQ ID NO: 46951 - protein, 25 aa, synthetic construct
  source 1..25: note = Seed: QTVHSIPLTINKEEALQRPVASDFE
QTVHSIPLTINKEMALIRNVANDFE

SEQ ID NO: 46952 - protein, 25 aa, synthetic construct
  source 1..25: note = Seed: QTVHSIPLTINKEEALQRPVASDFE
QTVHSIPLTINKEMALIRNVASDFE

SEQ ID NO: 46953 - protein, 25 aa, synthetic construct
  source 1..25: note = Seed: QTVHSIPLTINKEEALQRPVASDFE
QTVHSIPLTINKEMALIRPVAADFE

SEQ ID NO: 46954 - protein, 25 aa, synthetic construct
  source 1..25: note = Seed: QTVHSIPLTINKEEALQRPVASDFE
QTVHSIPLTINKEMALIRPVAIDFE

SEQ ID NO: 46955 - protein, 25 aa, synthetic construct
  source 1..25: note = Seed: QTVHSIPLTINKEEALQRPVASDFE
QTVHSIPLTINKEMALIRPVAMDFE

SEQ ID NO: 46956 - protein, 25 aa, synthetic construct
  source 1..25: note = Seed: QTVHSIPLTINKEEALQRPVASDFE
QTVHSIPLTINKEMALIRPVANDFE

SEQ ID NO: 46957 - protein, 25 aa, synthetic construct
  source 1..25: note = Seed: QTVHSIPLTINKEEALQRPVASDFE
QTVHSIPLTINKEMALIRPVASDFE

SEQ ID NO: 46958 - protein, 25 aa, synthetic construct
  source 1..25: note = Seed: QTVHSIPLTINKEEALQRPVASDFE
QTVHSIPLTINKEMALIRPVATDFE

SEQ ID NO: 46959 - protein, 25 aa, synthetic construct
  source 1..25: note = Seed: QTVHSIPLTINKEEALQRPVASDFE
QTVHSIPLTINKEMALIRPVAVDFE

SEQ ID NO: 46960 - protein, 25 aa, synthetic construct
  source 1..25: note = Seed: QTVHSIPLTINKEEALQRPVASDFE
QTVHSIPLTINKEMALIRSVAADFE

SEQ ID NO: 46961 - protein, 25 aa, synthetic construct
  source 1..25: note = Seed: QTVHSIPLTINKEEALQRPVASDFE
QTVHSIPLTINKEMALIRSVANDFE

SEQ ID NO: 46962 - protein, 25 aa, synthetic construct
  source 1..25: note = Seed: QTVHSIPLTINKEEALQRPVASDFE
QTVHSIPLTINKEMALIRSVASDFE

SEQ ID NO: 46963 - protein, 25 aa, synthetic construct
  source 1..25: note = Seed: QTVHSIPLTINKEEALQRPVASDFE
QTVHSIPLTINKEMALIRSVATDFE

SEQ ID NO: 46964 - protein, 25 aa, synthetic construct
  source 1..25: note = Seed: QTVHSIPLTINKEEALQRPVASDFE
QTVHSIPLTINKEMALIRTVAADFE

SEQ ID NO: 46965 - protein, 25 aa, synthetic construct
  source 1..25: note = Seed: QTVHSIPLTINKEEALQRPVASDFE
QTVHSIPLTINKEMALIRTVANDFE

SEQ ID NO: 46966 - protein, 25 aa, synthetic construct
  source 1..25: note = Seed: QTVHSIPLTINKEEALQRPVASDFE
QTVHSIPLTINKEMALIRTVASDFE

SEQ ID NO: 46967 - protein, 25 aa, synthetic construct
  source 1..25: note = Seed: QTVHSIPLTINKEEALQRPVASDFE
QTVHSIPLTINKEMALIRTVATDFE

SEQ ID NO: 46968 - protein, 25 aa, synthetic construct
  source 1..25: note = Seed: QTVHSIPLTINKEEALQRPVASDFE
QTVHSIPLTINKEMALIRVVAADFE

SEQ ID NO: 46969 - protein, 25 aa, synthetic construct
  source 1..25: note = Seed: QTVHSIPLTINKEEALQRPVASDFE
QTVHSIPLTINKEMALIRVVANDFE

SEQ ID NO: 46970 - protein, 25 aa, synthetic construct
  source 1..25: note = Seed: QTVHSIPLTINKEEALQRPVASDFE
QTVHSIPLTINKEMALIRVVASDFE

SEQ ID NO: 46971 - protein, 25 aa, synthetic construct
  source 1..25: note = Seed: QTVHSIPLTINKEEALQRPVASDFE
QTVHSIPLTINKEMALLRAVAADFE

SEQ ID NO: 46972 - protein, 25 aa, synthetic construct
  source 1..25: note = Seed: QTVHSIPLTINKEEALQRPVASDFE
QTVHSIPLTINKEMALLRAVAGDFE

SEQ ID NO: 46973 - protein, 25 aa, synthetic construct
  source 1..25: note = Seed: QTVHSIPLTINKEEALQRPVASDFE
QTVHSIPLTINKEMALLRAVAHDFE

SEQ ID NO: 46974 - protein, 25 aa, synthetic construct
  source 1..25: note = Seed: QTVHSIPLTINKEEALQRPVASDFE
QTVHSIPLTINKEMALLRAVAIDFE

SEQ ID NO: 46975 - protein, 25 aa, synthetic construct
  source 1..25: note = Seed: QTVHSIPLTINKEEALQRPVASDFE
QTVHSIPLTINKEMALLRAVALDFE

SEQ ID NO: 46976 - protein, 25 aa, synthetic construct
  source 1..25: note = Seed: QTVHSIPLTINKEEALQRPVASDFE
QTVHSIPLTINKEMALLRAVAMDFE

SEQ ID NO: 46977 - protein, 25 aa, synthetic construct
  source 1..25: note = Seed: QTVHSIPLTINKEEALQRPVASDFE
QTVHSIPLTINKEMALLRAVANDFE

SEQ ID NO: 46978 - protein, 25 aa, synthetic construct
  source 1..25: note = Seed: QTVHSIPLTINKEEALQRPVASDFE
QTVHSIPLTINKEMALLRAVAQDFE

SEQ ID NO: 46979 - protein, 25 aa, synthetic construct
  source 1..25: note = Seed: QTVHSIPLTINKEEALQRPVASDFE
QTVHSIPLTINKEMALLRAVASDFE

SEQ ID NO: 46980 - protein, 25 aa, synthetic construct
  source 1..25: note = Seed: QTVHSIPLTINKEEALQRPVASDFE
QTVHSIPLTINKEMALLRAVATDFE

SEQ ID NO: 46981 - protein, 25 aa, synthetic construct
  source 1..25: note = Seed: QTVHSIPLTINKEEALQRPVASDFE
QTVHSIPLTINKEMALLRAVAVDFE

SEQ ID NO: 46982 - protein, 25 aa, synthetic construct
  source 1..25: note = Seed: QTVHSIPLTINKEEALQRPVASDFE
QTVHSIPLTINKEMALLRGVAADFE

SEQ ID NO: 46983 - protein, 25 aa, synthetic construct
  source 1..25: note = Seed: QTVHSIPLTINKEEALQRPVASDFE
QTVHSIPLTINKEMALLRGVANDFE

SEQ ID NO: 46984 - protein, 25 aa, synthetic construct
  source 1..25: note = Seed: QTVHSIPLTINKEEALQRPVASDFE
QTVHSIPLTINKEMALLRGVASDFE

SEQ ID NO: 46985 - protein, 25 aa, synthetic construct
  source 1..25: note = Seed: QTVHSIPLTINKEEALQRPVASDFE
QTVHSIPLTINKEMALLRGVATDFE

SEQ ID NO: 46986 - protein, 25 aa, synthetic construct
  source 1..25: note = Seed: QTVHSIPLTINKEEALQRPVASDFE
QTVHSIPLTINKEMALLRGVAVDFE

SEQ ID NO: 46987 - protein, 25 aa, synthetic construct
  source 1..25: note = Seed: QTVHSIPLTINKEEALQRPVASDFE
QTVHSIPLTINKEMALLRIVAADFE

SEQ ID NO: 46988 - protein, 25 aa, synthetic construct
  source 1..25: note = Seed: QTVHSIPLTINKEEALQRPVASDFE
QTVHSIPLTINKEMALLRIVANDFE

SEQ ID NO: 46989 - protein, 25 aa, synthetic construct
  source 1..25: note = Seed: QTVHSIPLTINKEEALQRPVASDFE
QTVHSIPLTINKEMALLRIVASDFE

SEQ ID NO: 46990 - protein, 25 aa, synthetic construct
  source 1..25: note = Seed: QTVHSIPLTINKEEALQRPVASDFE
QTVHSIPLTINKEMALLRNVAADFE

SEQ ID NO: 46991 - protein, 25 aa, synthetic construct
  source 1..25: note = Seed: QTVHSIPLTINKEEALQRPVASDFE
QTVHSIPLTINKEMALLRNVANDFE

SEQ ID NO: 46992 - protein, 25 aa, synthetic construct
  source 1..25: note = Seed: QTVHSIPLTINKEEALQRPVASDFE
QTVHSIPLTINKEMALLRNVASDFE

SEQ ID NO: 46993 - protein, 25 aa, synthetic construct
  source 1..25: note = Seed: QTVHSIPLTINKEEALQRPVASDFE
QTVHSIPLTINKEMALLRNVATDFE

SEQ ID NO: 46994 - protein, 25 aa, synthetic construct
  source 1..25: note = Seed: QTVHSIPLTINKEEALQRPVASDFE
QTVHSIPLTINKEMALLRNVAVDFE

SEQ ID NO: 46995 - protein, 25 aa, synthetic construct
  source 1..25: note = Seed: QTVHSIPLTINKEEALQRPVASDFE
QTVHSIPLTINKEMALLRPVAADFE

SEQ ID NO: 46996 - protein, 25 aa, synthetic construct
  source 1..25: note = Seed: QTVHSIPLTINKEEALQRPVASDFE
QTVHSIPLTINKEMALLRPVAGDFE

SEQ ID NO: 46997 - protein, 25 aa, synthetic construct
  source 1..25: note = Seed: QTVHSIPLTINKEEALQRPVASDFE
QTVHSIPLTINKEMALLRPVAHDFE

SEQ ID NO: 46998 - protein, 25 aa, synthetic construct
  source 1..25: note = Seed: QTVHSIPLTINKEEALQRPVASDFE
QTVHSIPLTINKEMALLRPVAIDFE

SEQ ID NO: 46999 - protein, 25 aa, synthetic construct
  source 1..25: note = Seed: QTVHSIPLTINKEEALQRPVASDFE
QTVHSIPLTINKEMALLRPVALDFE

SEQ ID NO: 47000 - protein, 25 aa, synthetic construct
  source 1..25: note = Seed: QTVHSIPLTINKEEALQRPVASDFE
QTVHSIPLTINKEMALLRPVAMDFE

SEQ ID NO: 47001 - protein, 25 aa, synthetic construct
  source 1..25: note = Seed: QTVHSIPLTINKEEALQRPVASDFE
QTVHSIPLTINKEMALLRPVANDFE

SEQ ID NO: 47002 - protein, 25 aa, synthetic construct
  source 1..25: note = Seed: QTVHSIPLTINKEEALQRPVASDFE
QTVHSIPLTINKEMALLRPVAQDFE

SEQ ID NO: 47003 - protein, 25 aa, synthetic construct
  source 1..25: note = Seed: QTVHSIPLTINKEEALQRPVASDFE
QTVHSIPLTINKEMALLRPVASDFE

SEQ ID NO: 47004 - protein, 25 aa, synthetic construct
  source 1..25: note = Seed: QTVHSIPLTINKEEALQRPVASDFE
QTVHSIPLTINKEMALLRPVATDFE

SEQ ID NO: 47005 - protein, 25 aa, synthetic construct
  source 1..25: note = Seed: QTVHSIPLTINKEEALQRPVASDFE
QTVHSIPLTINKEMALLRPVAVDFE

SEQ ID NO: 47006 - protein, 25 aa, synthetic construct
  source 1..25: note = Seed: QTVHSIPLTINKEEALQRPVASDFE
QTVHSIPLTINKEMALLRSVAADFE

SEQ ID NO: 47007 - protein, 25 aa, synthetic construct
  source 1..25: note = Seed: QTVHSIPLTINKEEALQRPVASDFE
QTVHSIPLTINKEMALLRSVAGDFE

SEQ ID NO: 47008 - protein, 25 aa, synthetic construct
  source 1..25: note = Seed: QTVHSIPLTINKEEALQRPVASDFE
QTVHSIPLTINKEMALLRSVAHDFE

SEQ ID NO: 47009 - protein, 25 aa, synthetic construct
  source 1..25: note = Seed: QTVHSIPLTINKEEALQRPVASDFE
QTVHSIPLTINKEMALLRSVAIDFE

SEQ ID NO: 47010 - protein, 25 aa, synthetic construct
  source 1..25: note = Seed: QTVHSIPLTINKEEALQRPVASDFE
QTVHSIPLTINKEMALLRSVALDFE

SEQ ID NO: 47011 - protein, 25 aa, synthetic construct
  source 1..25: note = Seed: QTVHSIPLTINKEEALQRPVASDFE
QTVHSIPLTINKEMALLRSVAMDFE

SEQ ID NO: 47012 - protein, 25 aa, synthetic construct
  source 1..25: note = Seed: QTVHSIPLTINKEEALQRPVASDFE
QTVHSIPLTINKEMALLRSVANDFE

SEQ ID NO: 47013 - protein, 25 aa, synthetic construct
  source 1..25: note = Seed: QTVHSIPLTINKEEALQRPVASDFE
QTVHSIPLTINKEMALLRSVASDFE

SEQ ID NO: 47014 - protein, 25 aa, synthetic construct
  source 1..25: note = Seed: QTVHSIPLTINKEEALQRPVASDFE
QTVHSIPLTINKEMALLRSVATDFE

SEQ ID NO: 47015 - protein, 25 aa, synthetic construct
  source 1..25: note = Seed: QTVHSIPLTINKEEALQRPVASDFE
QTVHSIPLTINKEMALLRSVAVDFE

SEQ ID NO: 47016 - protein, 25 aa, synthetic construct
  source 1..25: note = Seed: QTVHSIPLTINKEEALQRPVASDFE
QTVHSIPLTINKEMALLRTVAADFE

SEQ ID NO: 47017 - protein, 25 aa, synthetic construct
  source 1..25: note = Seed: QTVHSIPLTINKEEALQRPVASDFE
QTVHSIPLTINKEMALLRTVAGDFE

SEQ ID NO: 47018 - protein, 25 aa, synthetic construct
  source 1..25: note = Seed: QTVHSIPLTINKEEALQRPVASDFE
QTVHSIPLTINKEMALLRTVAHDFE

SEQ ID NO: 47019 - protein, 25 aa, synthetic construct
  source 1..25: note = Seed: QTVHSIPLTINKEEALQRPVASDFE
QTVHSIPLTINKEMALLRTVAIDFE

SEQ ID NO: 47020 - protein, 25 aa, synthetic construct
  source 1..25: note = Seed: QTVHSIPLTINKEEALQRPVASDFE
QTVHSIPLTINKEMALLRTVALDFE

SEQ ID NO: 47021 - protein, 25 aa, synthetic construct
  source 1..25: note = Seed: QTVHSIPLTINKEEALQRPVASDFE
QTVHSIPLTINKEMALLRTVAMDFE

SEQ ID NO: 47022 - protein, 25 aa, synthetic construct
  source 1..25: note = Seed: QTVHSIPLTINKEEALQRPVASDFE
QTVHSIPLTINKEMALLRTVANDFE

SEQ ID NO: 47023 - protein, 25 aa, synthetic construct
  source 1..25: note = Seed: QTVHSIPLTINKEEALQRPVASDFE
QTVHSIPLTINKEMALLRTVASDFE

SEQ ID NO: 47024 - protein, 25 aa, synthetic construct
  source 1..25: note = Seed: QTVHSIPLTINKEEALQRPVASDFE
QTVHSIPLTINKEMALLRTVATDFE

SEQ ID NO: 47025 - protein, 25 aa, synthetic construct
  source 1..25: note = Seed: QTVHSIPLTINKEEALQRPVASDFE
QTVHSIPLTINKEMALLRTVAVDFE

SEQ ID NO: 47026 - protein, 25 aa, synthetic construct
  source 1..25: note = Seed: QTVHSIPLTINKEEALQRPVASDFE
QTVHSIPLTINKEMALLRVVAADFE

SEQ ID NO: 47027 - protein, 25 aa, synthetic construct
  source 1..25: note = Seed: QTVHSIPLTINKEEALQRPVASDFE
QTVHSIPLTINKEMALLRVVAHDFE

SEQ ID NO: 47028 - protein, 25 aa, synthetic construct
  source 1..25: note = Seed: QTVHSIPLTINKEEALQRPVASDFE
QTVHSIPLTINKEMALLRVVANDFE

SEQ ID NO: 47029 - protein, 25 aa, synthetic construct
  source 1..25: note = Seed: QTVHSIPLTINKEEALQRPVASDFE
QTVHSIPLTINKEMALLRVVASDFE

SEQ ID NO: 47030 - protein, 25 aa, synthetic construct
  source 1..25: note = Seed: QTVHSIPLTINKEEALQRPVASDFE
QTVHSIPLTINKEMALLRVVATDFE

SEQ ID NO: 47031 - protein, 25 aa, synthetic construct
  source 1..25: note = Seed: QTVHSIPLTINKEEALQRPVASDFE
QTVHSIPLTINKEMALMRAVAADFE

SEQ ID NO: 47032 - protein, 25 aa, synthetic construct
  source 1..25: note = Seed: QTVHSIPLTINKEEALQRPVASDFE
QTVHSIPLTINKEMALMRAVADDFE

SEQ ID NO: 47033 - protein, 25 aa, synthetic construct
  source 1..25: note = Seed: QTVHSIPLTINKEEALQRPVASDFE
QTVHSIPLTINKEMALMRAVAEDFE

SEQ ID NO: 47034 - protein, 25 aa, synthetic construct
  source 1..25: note = Seed: QTVHSIPLTINKEEALQRPVASDFE
QTVHSIPLTINKEMALMRAVAGDFE

SEQ ID NO: 47035 - protein, 25 aa, synthetic construct
  source 1..25: note = Seed: QTVHSIPLTINKEEALQRPVASDFE
QTVHSIPLTINKEMALMRAVAHDFE

SEQ ID NO: 47036 - protein, 25 aa, synthetic construct
  source 1..25: note = Seed: QTVHSIPLTINKEEALQRPVASDFE
QTVHSIPLTINKEMALMRAVAIDFE

SEQ ID NO: 47037 - protein, 25 aa, synthetic construct
  source 1..25: note = Seed: QTVHSIPLTINKEEALQRPVASDFE
QTVHSIPLTINKEMALMRAVALDFE

SEQ ID NO: 47038 - protein, 25 aa, synthetic construct
  source 1..25: note = Seed: QTVHSIPLTINKEEALQRPVASDFE
QTVHSIPLTINKEMALMRAVAMDFE

SEQ ID NO: 47039 - protein, 25 aa, synthetic construct
  source 1..25: note = Seed: QTVHSIPLTINKEEALQRPVASDFE
QTVHSIPLTINKEMALMRAVANDFE

SEQ ID NO: 47040 - protein, 25 aa, synthetic construct
  source 1..25: note = Seed: QTVHSIPLTINKEEALQRPVASDFE
QTVHSIPLTINKEMALMRAVAPDFE

SEQ ID NO: 47041 - protein, 25 aa, synthetic construct
  source 1..25: note = Seed: QTVHSIPLTINKEEALQRPVASDFE
QTVHSIPLTINKEMALMRAVAQDFE

SEQ ID NO: 47042 - protein, 25 aa, synthetic construct
  source 1..25: note = Seed: QTVHSIPLTINKEEALQRPVASDFE
QTVHSIPLTINKEMALMRAVASDFE

SEQ ID NO: 47043 - protein, 25 aa, synthetic construct
  source 1..25: note = Seed: QTVHSIPLTINKEEALQRPVASDFE
QTVHSIPLTINKEMALMRAVATDFE

SEQ ID NO: 47044 - protein, 25 aa, synthetic construct
  source 1..25: note = Seed: QTVHSIPLTINKEEALQRPVASDFE
QTVHSIPLTINKEMALMRAVAVDFE

SEQ ID NO: 47045 - protein, 25 aa, synthetic construct
  source 1..25: note = Seed: QTVHSIPLTINKEEALQRPVASDFE
QTVHSIPLTINKEMALMRGVAADFE

SEQ ID NO: 47046 - protein, 25 aa, synthetic construct
  source 1..25: note = Seed: QTVHSIPLTINKEEALQRPVASDFE
QTVHSIPLTINKEMALMRGVAGDFE

SEQ ID NO: 47047 - protein, 25 aa, synthetic construct
  source 1..25: note = Seed: QTVHSIPLTINKEEALQRPVASDFE
QTVHSIPLTINKEMALMRGVAHDFE

SEQ ID NO: 47048 - protein, 25 aa, synthetic construct
  source 1..25: note = Seed: QTVHSIPLTINKEEALQRPVASDFE
QTVHSIPLTINKEMALMRGVAIDFE

SEQ ID NO: 47049 - protein, 25 aa, synthetic construct
  source 1..25: note = Seed: QTVHSIPLTINKEEALQRPVASDFE
QTVHSIPLTINKEMALMRGVALDFE

SEQ ID NO: 47050 - protein, 25 aa, synthetic construct
  source 1..25: note = Seed: QTVHSIPLTINKEEALQRPVASDFE
QTVHSIPLTINKEMALMRGVAMDFE

SEQ ID NO: 47051 - protein, 25 aa, synthetic construct
  source 1..25: note = Seed: QTVHSIPLTINKEEALQRPVASDFE
QTVHSIPLTINKEMALMRGVANDFE

SEQ ID NO: 47052 - protein, 25 aa, synthetic construct
  source 1..25: note = Seed: QTVHSIPLTINKEEALQRPVASDFE
QTVHSIPLTINKEMALMRGVAQDFE

SEQ ID NO: 47053 - protein, 25 aa, synthetic construct
  source 1..25: note = Seed: QTVHSIPLTINKEEALQRPVASDFE
QTVHSIPLTINKEMALMRGVASDFE

SEQ ID NO: 47054 - protein, 25 aa, synthetic construct
  source 1..25: note = Seed: QTVHSIPLTINKEEALQRPVASDFE
QTVHSIPLTINKEMALMRGVATDFE

SEQ ID NO: 47055 - protein, 25 aa, synthetic construct
  source 1..25: note = Seed: QTVHSIPLTINKEEALQRPVASDFE
QTVHSIPLTINKEMALMRGVAVDFE

SEQ ID NO: 47056 - protein, 25 aa, synthetic construct
  source 1..25: note = Seed: QTVHSIPLTINKEEALQRPVASDFE
QTVHSIPLTINKEMALMRIVAADFE

SEQ ID NO: 47057 - protein, 25 aa, synthetic construct
  source 1..25: note = Seed: QTVHSIPLTINKEEALQRPVASDFE
QTVHSIPLTINKEMALMRIVAHDFE

SEQ ID NO: 47058 - protein, 25 aa, synthetic construct
  source 1..25: note = Seed: QTVHSIPLTINKEEALQRPVASDFE
QTVHSIPLTINKEMALMRIVANDFE

SEQ ID NO: 47059 - protein, 25 aa, synthetic construct
  source 1..25: note = Seed: QTVHSIPLTINKEEALQRPVASDFE
QTVHSIPLTINKEMALMRIVASDFE

SEQ ID NO: 47060 - protein, 25 aa, synthetic construct
  source 1..25: note = Seed: QTVHSIPLTINKEEALQRPVASDFE
QTVHSIPLTINKEMALMRIVATDFE

SEQ ID NO: 47061 - protein, 25 aa, synthetic construct
  source 1..25: note = Seed: QTVHSIPLTINKEEALQRPVASDFE
QTVHSIPLTINKEMALMRLVANDFE

SEQ ID NO: 47062 - protein, 25 aa, synthetic construct
  source 1..25: note = Seed: QTVHSIPLTINKEEALQRPVASDFE
QTVHSIPLTINKEMALMRLVASDFE

SEQ ID NO: 47063 - protein, 25 aa, synthetic construct
  source 1..25: note = Seed: QTVHSIPLTINKEEALQRPVASDFE
QTVHSIPLTINKEMALMRMVANDFE

SEQ ID NO: 47064 - protein, 25 aa, synthetic construct
  source 1..25: note = Seed: QTVHSIPLTINKEEALQRPVASDFE
QTVHSIPLTINKEMALMRNVAADFE

SEQ ID NO: 47065 - protein, 25 aa, synthetic construct
  source 1..25: note = Seed: QTVHSIPLTINKEEALQRPVASDFE
QTVHSIPLTINKEMALMRNVAGDFE

SEQ ID NO: 47066 - protein, 25 aa, synthetic construct
  source 1..25: note = Seed: QTVHSIPLTINKEEALQRPVASDFE
QTVHSIPLTINKEMALMRNVAHDFE

SEQ ID NO: 47067 - protein, 25 aa, synthetic construct
  source 1..25: note = Seed: QTVHSIPLTINKEEALQRPVASDFE
QTVHSIPLTINKEMALMRNVAIDFE

SEQ ID NO: 47068 - protein, 25 aa, synthetic construct
  source 1..25: note = Seed: QTVHSIPLTINKEEALQRPVASDFE
QTVHSIPLTINKEMALMRNVALDFE

SEQ ID NO: 47069 - protein, 25 aa, synthetic construct
  source 1..25: note = Seed: QTVHSIPLTINKEEALQRPVASDFE
QTVHSIPLTINKEMALMRNVAMDFE

SEQ ID NO: 47070 - protein, 25 aa, synthetic construct
  source 1..25: note = Seed: QTVHSIPLTINKEEALQRPVASDFE
QTVHSIPLTINKEMALMRNVANDFE

SEQ ID NO: 47071 - protein, 25 aa, synthetic construct
  source 1..25: note = Seed: QTVHSIPLTINKEEALQRPVASDFE
QTVHSIPLTINKEMALMRNVASDFE

SEQ ID NO: 47072 - protein, 25 aa, synthetic construct
  source 1..25: note = Seed: QTVHSIPLTINKEEALQRPVASDFE
QTVHSIPLTINKEMALMRNVATDFE

SEQ ID NO: 47073 - protein, 25 aa, synthetic construct
  source 1..25: note = Seed: QTVHSIPLTINKEEALQRPVASDFE
QTVHSIPLTINKEMALMRNVAVDFE

SEQ ID NO: 47074 - protein, 25 aa, synthetic construct
  source 1..25: note = Seed: QTVHSIPLTINKEEALQRPVASDFE
QTVHSIPLTINKEMALMRPVAADFE

SEQ ID NO: 47075 - protein, 25 aa, synthetic construct
  source 1..25: note = Seed: QTVHSIPLTINKEEALQRPVASDFE
QTVHSIPLTINKEMALMRPVAGDFE

SEQ ID NO: 47076 - protein, 25 aa, synthetic construct
  source 1..25: note = Seed: QTVHSIPLTINKEEALQRPVASDFE
QTVHSIPLTINKEMALMRPVAHDFE

SEQ ID NO: 47077 - protein, 25 aa, synthetic construct
  source 1..25: note = Seed: QTVHSIPLTINKEEALQRPVASDFE
QTVHSIPLTINKEMALMRPVAIDFE

SEQ ID NO: 47078 - protein, 25 aa, synthetic construct
  source 1..25: note = Seed: QTVHSIPLTINKEEALQRPVASDFE
QTVHSIPLTINKEMALMRPVALDFE

SEQ ID NO: 47079 - protein, 25 aa, synthetic construct
  source 1..25: note = Seed: QTVHSIPLTINKEEALQRPVASDFE
QTVHSIPLTINKEMALMRPVAMDFE

SEQ ID NO: 47080 - protein, 25 aa, synthetic construct
  source 1..25: note = Seed: QTVHSIPLTINKEEALQRPVASDFE
QTVHSIPLTINKEMALMRPVANDFE

SEQ ID NO: 47081 - protein, 25 aa, synthetic construct
  source 1..25: note = Seed: QTVHSIPLTINKEEALQRPVASDFE
QTVHSIPLTINKEMALMRPVAQDFE

SEQ ID NO: 47082 - protein, 25 aa, synthetic construct
  source 1..25: note = Seed: QTVHSIPLTINKEEALQRPVASDFE
QTVHSIPLTINKEMALMRPVASDFE

SEQ ID NO: 47083 - protein, 25 aa, synthetic construct
  source 1..25: note = Seed: QTVHSIPLTINKEEALQRPVASDFE
QTVHSIPLTINKEMALMRPVATDFE

SEQ ID NO: 47084 - protein, 25 aa, synthetic construct
  source 1..25: note = Seed: QTVHSIPLTINKEEALQRPVASDFE
QTVHSIPLTINKEMALMRPVAVDFE

SEQ ID NO: 47085 - protein, 25 aa, synthetic construct
  source 1..25: note = Seed: QTVHSIPLTINKEEALQRPVASDFE
QTVHSIPLTINKEMALMRSVAADFE

SEQ ID NO: 47086 - protein, 25 aa, synthetic construct
  source 1..25: note = Seed: QTVHSIPLTINKEEALQRPVASDFE
QTVHSIPLTINKEMALMRSVAGDFE

SEQ ID NO: 47087 - protein, 25 aa, synthetic construct
  source 1..25: note = Seed: QTVHSIPLTINKEEALQRPVASDFE
QTVHSIPLTINKEMALMRSVAHDFE

SEQ ID NO: 47088 - protein, 25 aa, synthetic construct
  source 1..25: note = Seed: QTVHSIPLTINKEEALQRPVASDFE
QTVHSIPLTINKEMALMRSVAIDFE

SEQ ID NO: 47089 - protein, 25 aa, synthetic construct
  source 1..25: note = Seed: QTVHSIPLTINKEEALQRPVASDFE
QTVHSIPLTINKEMALMRSVALDFE

SEQ ID NO: 47090 - protein, 25 aa, synthetic construct
  source 1..25: note = Seed: QTVHSIPLTINKEEALQRPVASDFE
QTVHSIPLTINKEMALMRSVAMDFE

SEQ ID NO: 47091 - protein, 25 aa, synthetic construct
  source 1..25: note = Seed: QTVHSIPLTINKEEALQRPVASDFE
QTVHSIPLTINKEMALMRSVANDFE

SEQ ID NO: 47092 - protein, 25 aa, synthetic construct
  source 1..25: note = Seed: QTVHSIPLTINKEEALQRPVASDFE
QTVHSIPLTINKEMALMRSVAQDFE

SEQ ID NO: 47093 - protein, 25 aa, synthetic construct
  source 1..25: note = Seed: QTVHSIPLTINKEEALQRPVASDFE
QTVHSIPLTINKEMALMRSVASDFE

SEQ ID NO: 47094 - protein, 25 aa, synthetic construct
  source 1..25: note = Seed: QTVHSIPLTINKEEALQRPVASDFE
QTVHSIPLTINKEMALMRSVATDFE

SEQ ID NO: 47095 - protein, 25 aa, synthetic construct
  source 1..25: note = Seed: QTVHSIPLTINKEEALQRPVASDFE
QTVHSIPLTINKEMALMRSVAVDFE

SEQ ID NO: 47096 - protein, 25 aa, synthetic construct
  source 1..25: note = Seed: QTVHSIPLTINKEEALQRPVASDFE
QTVHSIPLTINKEMALMRTVAADFE

SEQ ID NO: 47097 - protein, 25 aa, synthetic construct
  source 1..25: note = Seed: QTVHSIPLTINKEEALQRPVASDFE
QTVHSIPLTINKEMALMRTVAGDFE

SEQ ID NO: 47098 - protein, 25 aa, synthetic construct
  source 1..25: note = Seed: QTVHSIPLTINKEEALQRPVASDFE
QTVHSIPLTINKEMALMRTVAHDFE

SEQ ID NO: 47099 - protein, 25 aa, synthetic construct
  source 1..25: note = Seed: QTVHSIPLTINKEEALQRPVASDFE
QTVHSIPLTINKEMALMRTVAIDFE

SEQ ID NO: 47100 - protein, 25 aa, synthetic construct
  source 1..25: note = Seed: QTVHSIPLTINKEEALQRPVASDFE
QTVHSIPLTINKEMALMRTVALDFE

SEQ ID NO: 47101 - protein, 25 aa, synthetic construct
  source 1..25: note = Seed: QTVHSIPLTINKEEALQRPVASDFE
QTVHSIPLTINKEMALMRTVAMDFE

SEQ ID NO: 47102 - protein, 25 aa, synthetic construct
  source 1..25: note = Seed: QTVHSIPLTINKEEALQRPVASDFE
QTVHSIPLTINKEMALMRTVANDFE

SEQ ID NO: 47103 - protein, 25 aa, synthetic construct
  source 1..25: note = Seed: QTVHSIPLTINKEEALQRPVASDFE
QTVHSIPLTINKEMALMRTVAQDFE

SEQ ID NO: 47104 - protein, 25 aa, synthetic construct
  source 1..25: note = Seed: QTVHSIPLTINKEEALQRPVASDFE
QTVHSIPLTINKEMALMRTVASDFE

SEQ ID NO: 47105 - protein, 25 aa, synthetic construct
  source 1..25: note = Seed: QTVHSIPLTINKEEALQRPVASDFE
QTVHSIPLTINKEMALMRTVATDFE

SEQ ID NO: 47106 - protein, 25 aa, synthetic construct
  source 1..25: note = Seed: QTVHSIPLTINKEEALQRPVASDFE
QTVHSIPLTINKEMALMRTVAVDFE

SEQ ID NO: 47107 - protein, 25 aa, synthetic construct
  source 1..25: note = Seed: QTVHSIPLTINKEEALQRPVASDFE
QTVHSIPLTINKEMALMRVVAADFE

SEQ ID NO: 47108 - protein, 25 aa, synthetic construct
  source 1..25: note = Seed: QTVHSIPLTINKEEALQRPVASDFE
QTVHSIPLTINKEMALMRVVAGDFE

SEQ ID NO: 47109 - protein, 25 aa, synthetic construct
  source 1..25: note = Seed: QTVHSIPLTINKEEALQRPVASDFE
QTVHSIPLTINKEMALMRVVAHDFE

SEQ ID NO: 47110 - protein, 25 aa, synthetic construct
  source 1..25: note = Seed: QTVHSIPLTINKEEALQRPVASDFE
QTVHSIPLTINKEMALMRVVAMDFE

SEQ ID NO: 47111 - protein, 25 aa, synthetic construct
  source 1..25: note = Seed: QTVHSIPLTINKEEALQRPVASDFE
QTVHSIPLTINKEMALMRVVANDFE

SEQ ID NO: 47112 - protein, 25 aa, synthetic construct
  source 1..25: note = Seed: QTVHSIPLTINKEEALQRPVASDFE
QTVHSIPLTINKEMALMRVVAQDFE

SEQ ID NO: 47113 - protein, 25 aa, synthetic construct
  source 1..25: note = Seed: QTVHSIPLTINKEEALQRPVASDFE
QTVHSIPLTINKEMALMRVVASDFE

SEQ ID NO: 47114 - protein, 25 aa, synthetic construct
  source 1..25: note = Seed: QTVHSIPLTINKEEALQRPVASDFE
QTVHSIPLTINKEMALMRVVATDFE

SEQ ID NO: 47115 - protein, 25 aa, synthetic construct
  source 1..25: note = Seed: QTVHSIPLTINKEEALQRPVASDFE
QTVHSIPLTINKEMALMRVVAVDFE

SEQ ID NO: 47116 - protein, 25 aa, synthetic construct
  source 1..25: note = Seed: QTVHSIPLTINKEEALQRPVASDFE
QTVHSIPLTINKEMALQRAVAADFE

SEQ ID NO: 47117 - protein, 25 aa, synthetic construct
  source 1..25: note = Seed: QTVHSIPLTINKEEALQRPVASDFE
QTVHSIPLTINKEMALQRAVANDFE

SEQ ID NO: 47118 - protein, 25 aa, synthetic construct
  source 1..25: note = Seed: QTVHSIPLTINKEEALQRPVASDFE
QTVHSIPLTINKEMALQRAVASDFE

SEQ ID NO: 47119 - protein, 25 aa, synthetic construct
  source 1..25: note = Seed: QTVHSIPLTINKEEALQRPVASDFE
QTVHSIPLTINKEMALQRAVATDFE

SEQ ID NO: 47120 - protein, 25 aa, synthetic construct
  source 1..25: note = Seed: QTVHSIPLTINKEEALQRPVASDFE
QTVHSIPLTINKEMALQRAVAVDFE

SEQ ID NO: 47121 - protein, 25 aa, synthetic construct
  source 1..25: note = Seed: QTVHSIPLTINKEEALQRPVASDFE
QTVHSIPLTINKEMALQRPVAADFE

SEQ ID NO: 47122 - protein, 25 aa, synthetic construct
  source 1..25: note = Seed: QTVHSIPLTINKEEALQRPVASDFE
QTVHSIPLTINKEMALQRSVAADFE

SEQ ID NO: 47123 - protein, 25 aa, synthetic construct
  source 1..25: note = Seed: QTVHSIPLTINKEEALQRPVASDFE
QTVHSIPLTINKEMALQRSVANDFE

SEQ ID NO: 47124 - protein, 25 aa, synthetic construct
  source 1..25: note = Seed: QTVHSIPLTINKEEALQRPVASDFE
QTVHSIPLTINKEMALQRTVAADFE

SEQ ID NO: 47125 - protein, 25 aa, synthetic construct
  source 1..25: note = Seed: QTVHSIPLTINKEEALQRPVASDFE
QTVHSIPLTINKEMALQRVVAADFE

SEQ ID NO: 47126 - protein, 25 aa, synthetic construct
  source 1..25: note = Seed: QTVHSIPLTINKEEALQRPVASDFE
QTVHSIPLTINKEMALQRVVANDFE

SEQ ID NO: 47127 - protein, 25 aa, synthetic construct
  source 1..25: note = Seed: QTVHSIPLTINKEEALQRPVASDFE
QTVHSIPLTINKEMALQRVVASDFE

SEQ ID NO: 47128 - protein, 25 aa, synthetic construct
  source 1..25: note = Seed: QTVHSIPLTINKEEALQRPVASDFE
QTVHSIPLTINKEMALSRAVAADFE

SEQ ID NO: 47129 - protein, 25 aa, synthetic construct
  source 1..25: note = Seed: QTVHSIPLTINKEEALQRPVASDFE
QTVHSIPLTINKEMALSRAVANDFE

SEQ ID NO: 47130 - protein, 25 aa, synthetic construct
  source 1..25: note = Seed: QTVHSIPLTINKEEALQRPVASDFE
QTVHSIPLTINKEMALSRAVASDFE

SEQ ID NO: 47131 - protein, 25 aa, synthetic construct
  source 1..25: note = Seed: QTVHSIPLTINKEEALQRPVASDFE
QTVHSIPLTINKEMALTRAVAADFE

SEQ ID NO: 47132 - protein, 25 aa, synthetic construct
  source 1..25: note = Seed: QTVHSIPLTINKEEALQRPVASDFE
QTVHSIPLTINKEMALVRAVAADFE

SEQ ID NO: 47133 - protein, 25 aa, synthetic construct
  source 1..25: note = Seed: QTVHSIPLTINKEEALQRPVASDFE
QTVHSIPLTINKEMALVRAVANDFE

SEQ ID NO: 47134 - protein, 25 aa, synthetic construct
  source 1..25: note = Seed: QTVHSIPLTINKEEALQRPVASDFE
QTVHSIPLTINKEMALVRAVASDFE

SEQ ID NO: 47135 - protein, 25 aa, synthetic construct
  source 1..25: note = Seed: QTVHSIPLTINKEEALQRPVASDFE
QTVHSIPLTINKEMALVRPVAADFE

SEQ ID NO: 47136 - protein, 25 aa, synthetic construct
  source 1..25: note = Seed: QTVHSIPLTINKEEALQRPVASDFE
QTVHSIPLTINKEMALVRPVANDFE

SEQ ID NO: 47137 - protein, 25 aa, synthetic construct
  source 1..25: note = Seed: QTVHSIPLTINKEEALQRPVASDFE
QTVHSIPLTINKEMALVRPVASDFE

SEQ ID NO: 47138 - protein, 25 aa, synthetic construct
  source 1..25: note = Seed: QTVHSIPLTINKEEALQRPVASDFE
QTVHSIPLTINKEMALVRSVAADFE

SEQ ID NO: 47139 - protein, 25 aa, synthetic construct
  source 1..25: note = Seed: QTVHSIPLTINKEEALQRPVASDFE
QTVHSIPLTINKEMALVRSVANDFE

SEQ ID NO: 47140 - protein, 25 aa, synthetic construct
  source 1..25: note = Seed: QTVHSIPLTINKEEALQRPVASDFE
QTVHSIPLTINKEMALVRSVASDFE

SEQ ID NO: 47141 - protein, 25 aa, synthetic construct
  source 1..25: note = Seed: QTVHSIPLTINKEEALQRPVASDFE
QTVHSIPLTINKEMALVRTVAADFE

SEQ ID NO: 47142 - protein, 25 aa, synthetic construct
  source 1..25: note = Seed: QTVHSIPLTINKEEALQRPVASDFE
QTVHSIPLTINKEMALVRTVANDFE

SEQ ID NO: 47143 - protein, 25 aa, synthetic construct
  source 1..25: note = Seed: QTVHSIPLTINKEEALQRPVASDFE
QTVHSIPLTINKEMALVRTVASDFE

SEQ ID NO: 47144 - protein, 25 aa, synthetic construct
  source 1..25: note = Seed: QTVHSIPLTINKEEALQRPVASDFE
QTVHSIPLTINKEMALVRVVANDFE

SEQ ID NO: 47145 - protein, 25 aa, synthetic construct
  source 1..25: note = Seed: QTVHSIPLTINKEEALQRPVASDFE
QTVHSIPLTINKEVALARAVAADFE

SEQ ID NO: 47146 - protein, 25 aa, synthetic construct
  source 1..25: note = Seed: QTVHSIPLTINKEEALQRPVASDFE
QTVHSIPLTINKEVALARAVANDFE

SEQ ID NO: 47147 - protein, 25 aa, synthetic construct
  source 1..25: note = Seed: QTVHSIPLTINKEEALQRPVASDFE
QTVHSIPLTINKEVALARAVASDFE

SEQ ID NO: 47148 - protein, 25 aa, synthetic construct
  source 1..25: note = Seed: QTVHSIPLTINKEEALQRPVASDFE
QTVHSIPLTINKEVALARPVAADFE

SEQ ID NO: 47149 - protein, 25 aa, synthetic construct
  source 1..25: note = Seed: QTVHSIPLTINKEEALQRPVASDFE
QTVHSIPLTINKEVALARPVANDFE

SEQ ID NO: 47150 - protein, 25 aa, synthetic construct
  source 1..25: note = Seed: QTVHSIPLTINKEEALQRPVASDFE
QTVHSIPLTINKEVALARPVASDFE

SEQ ID NO: 47151 - protein, 25 aa, synthetic construct
  source 1..25: note = Seed: QTVHSIPLTINKEEALQRPVASDFE
QTVHSIPLTINKEVALARSVAADFE

SEQ ID NO: 47152 - protein, 25 aa, synthetic construct
  source 1..25: note = Seed: QTVHSIPLTINKEEALQRPVASDFE
QTVHSIPLTINKEVALARSVANDFE

SEQ ID NO: 47153 - protein, 25 aa, synthetic construct
  source 1..25: note = Seed: QTVHSIPLTINKEEALQRPVASDFE
QTVHSIPLTINKEVALARSVASDFE

SEQ ID NO: 47154 - protein, 25 aa, synthetic construct
  source 1..25: note = Seed: QTVHSIPLTINKEEALQRPVASDFE
QTVHSIPLTINKEVALARTVAADFE

SEQ ID NO: 47155 - protein, 25 aa, synthetic construct
  source 1..25: note = Seed: QTVHSIPLTINKEEALQRPVASDFE
QTVHSIPLTINKEVALARTVANDFE

SEQ ID NO: 47156 - protein, 25 aa, synthetic construct
  source 1..25: note = Seed: QTVHSIPLTINKEEALQRPVASDFE
QTVHSIPLTINKEVALARTVASDFE

SEQ ID NO: 47157 - protein, 25 aa, synthetic construct
  source 1..25: note = Seed: QTVHSIPLTINKEEALQRPVASDFE
QTVHSIPLTINKEVALARVVANDFE

SEQ ID NO: 47158 - protein, 25 aa, synthetic construct
  source 1..25: note = Seed: QTVHSIPLTINKEEALQRPVASDFE
QTVHSIPLTINKEVALIRAVAADFE

SEQ ID NO: 47159 - protein, 25 aa, synthetic construct
  source 1..25: note = Seed: QTVHSIPLTINKEEALQRPVASDFE
QTVHSIPLTINKEVALIRAVANDFE

SEQ ID NO: 47160 - protein, 25 aa, synthetic construct
  source 1..25: note = Seed: QTVHSIPLTINKEEALQRPVASDFE
QTVHSIPLTINKEVALIRAVASDFE

SEQ ID NO: 47161 - protein, 25 aa, synthetic construct
  source 1..25: note = Seed: QTVHSIPLTINKEEALQRPVASDFE
QTVHSIPLTINKEVALIRPVAADFE

SEQ ID NO: 47162 - protein, 25 aa, synthetic construct
  source 1..25: note = Seed: QTVHSIPLTINKEEALQRPVASDFE
QTVHSIPLTINKEVALIRPVANDFE

SEQ ID NO: 47163 - protein, 25 aa, synthetic construct
  source 1..25: note = Seed: QTVHSIPLTINKEEALQRPVASDFE
QTVHSIPLTINKEVALIRPVASDFE

SEQ ID NO: 47164 - protein, 25 aa, synthetic construct
  source 1..25: note = Seed: QTVHSIPLTINKEEALQRPVASDFE
QTVHSIPLTINKEVALIRPVATDFE

SEQ ID NO: 47165 - protein, 25 aa, synthetic construct
  source 1..25: note = Seed: QTVHSIPLTINKEEALQRPVASDFE
QTVHSIPLTINKEVALIRSVAADFE

SEQ ID NO: 47166 - protein, 25 aa, synthetic construct
  source 1..25: note = Seed: QTVHSIPLTINKEEALQRPVASDFE
QTVHSIPLTINKEVALIRSVANDFE

SEQ ID NO: 47167 - protein, 25 aa, synthetic construct
  source 1..25: note = Seed: QTVHSIPLTINKEEALQRPVASDFE
QTVHSIPLTINKEVALIRSVASDFE

SEQ ID NO: 47168 - protein, 25 aa, synthetic construct
  source 1..25: note = Seed: QTVHSIPLTINKEEALQRPVASDFE
QTVHSIPLTINKEVALIRTVAADFE

SEQ ID NO: 47169 - protein, 25 aa, synthetic construct
  source 1..25: note = Seed: QTVHSIPLTINKEEALQRPVASDFE
QTVHSIPLTINKEVALIRTVANDFE

SEQ ID NO: 47170 - protein, 25 aa, synthetic construct
  source 1..25: note = Seed: QTVHSIPLTINKEEALQRPVASDFE
QTVHSIPLTINKEVALIRTVASDFE

SEQ ID NO: 47171 - protein, 25 aa, synthetic construct
  source 1..25: note = Seed: QTVHSIPLTINKEEALQRPVASDFE
QTVHSIPLTINKEVALLRAVAADFE

SEQ ID NO: 47172 - protein, 25 aa, synthetic construct
  source 1..25: note = Seed: QTVHSIPLTINKEEALQRPVASDFE
QTVHSIPLTINKEVALLRAVAHDFE

SEQ ID NO: 47173 - protein, 25 aa, synthetic construct
  source 1..25: note = Seed: QTVHSIPLTINKEEALQRPVASDFE
QTVHSIPLTINKEVALLRAVANDFE

SEQ ID NO: 47174 - protein, 25 aa, synthetic construct
  source 1..25: note = Seed: QTVHSIPLTINKEEALQRPVASDFE
QTVHSIPLTINKEVALLRAVASDFE

SEQ ID NO: 47175 - protein, 25 aa, synthetic construct
  source 1..25: note = Seed: QTVHSIPLTINKEEALQRPVASDFE
QTVHSIPLTINKEVALLRAVATDFE

SEQ ID NO: 47176 - protein, 25 aa, synthetic construct
  source 1..25: note = Seed: QTVHSIPLTINKEEALQRPVASDFE
QTVHSIPLTINKEVALLRGVAADFE

SEQ ID NO: 47177 - protein, 25 aa, synthetic construct
  source 1..25: note = Seed: QTVHSIPLTINKEEALQRPVASDFE
QTVHSIPLTINKEVALLRGVANDFE

SEQ ID NO: 47178 - protein, 25 aa, synthetic construct
  source 1..25: note = Seed: QTVHSIPLTINKEEALQRPVASDFE
QTVHSIPLTINKEVALLRGVASDFE

SEQ ID NO: 47179 - protein, 25 aa, synthetic construct
  source 1..25: note = Seed: QTVHSIPLTINKEEALQRPVASDFE
QTVHSIPLTINKEVALLRNVAADFE

SEQ ID NO: 47180 - protein, 25 aa, synthetic construct
  source 1..25: note = Seed: QTVHSIPLTINKEEALQRPVASDFE
QTVHSIPLTINKEVALLRNVANDFE

SEQ ID NO: 47181 - protein, 25 aa, synthetic construct
  source 1..25: note = Seed: QTVHSIPLTINKEEALQRPVASDFE
QTVHSIPLTINKEVALLRPVAADFE

SEQ ID NO: 47182 - protein, 25 aa, synthetic construct
  source 1..25: note = Seed: QTVHSIPLTINKEEALQRPVASDFE
QTVHSIPLTINKEVALLRPVAIDFE

SEQ ID NO: 47183 - protein, 25 aa, synthetic construct
  source 1..25: note = Seed: QTVHSIPLTINKEEALQRPVASDFE
QTVHSIPLTINKEVALLRPVAMDFE

SEQ ID NO: 47184 - protein, 25 aa, synthetic construct
  source 1..25: note = Seed: QTVHSIPLTINKEEALQRPVASDFE
QTVHSIPLTINKEVALLRPVANDFE

SEQ ID NO: 47185 - protein, 25 aa, synthetic construct
  source 1..25: note = Seed: QTVHSIPLTINKEEALQRPVASDFE
QTVHSIPLTINKEVALLRPVASDFE

SEQ ID NO: 47186 - protein, 25 aa, synthetic construct
  source 1..25: note = Seed: QTVHSIPLTINKEEALQRPVASDFE
QTVHSIPLTINKEVALLRPVATDFE

SEQ ID NO: 47187 - protein, 25 aa, synthetic construct
  source 1..25: note = Seed: QTVHSIPLTINKEEALQRPVASDFE
QTVHSIPLTINKEVALLRPVAVDFE

SEQ ID NO: 47188 - protein, 25 aa, synthetic construct
  source 1..25: note = Seed: QTVHSIPLTINKEEALQRPVASDFE
QTVHSIPLTINKEVALLRSVAADFE

SEQ ID NO: 47189 - protein, 25 aa, synthetic construct
  source 1..25: note = Seed: QTVHSIPLTINKEEALQRPVASDFE
QTVHSIPLTINKEVALLRSVANDFE

SEQ ID NO: 47190 - protein, 25 aa, synthetic construct
  source 1..25: note = Seed: QTVHSIPLTINKEEALQRPVASDFE
QTVHSIPLTINKEVALLRSVASDFE

SEQ ID NO: 47191 - protein, 25 aa, synthetic construct
  source 1..25: note = Seed: QTVHSIPLTINKEEALQRPVASDFE
QTVHSIPLTINKEVALLRSVATDFE

SEQ ID NO: 47192 - protein, 25 aa, synthetic construct
  source 1..25: note = Seed: QTVHSIPLTINKEEALQRPVASDFE
QTVHSIPLTINKEVALLRTVAADFE

SEQ ID NO: 47193 - protein, 25 aa, synthetic construct
  source 1..25: note = Seed: QTVHSIPLTINKEEALQRPVASDFE
QTVHSIPLTINKEVALLRTVANDFE

SEQ ID NO: 47194 - protein, 25 aa, synthetic construct
  source 1..25: note = Seed: QTVHSIPLTINKEEALQRPVASDFE
QTVHSIPLTINKEVALLRTVASDFE

SEQ ID NO: 47195 - protein, 25 aa, synthetic construct
  source 1..25: note = Seed: QTVHSIPLTINKEEALQRPVASDFE
QTVHSIPLTINKEVALLRTVATDFE

SEQ ID NO: 47196 - protein, 25 aa, synthetic construct
  source 1..25: note = Seed: QTVHSIPLTINKEEALQRPVASDFE
QTVHSIPLTINKEVALLRVVANDFE

SEQ ID NO: 47197 - protein, 25 aa, synthetic construct
  source 1..25: note = Seed: QTVHSIPLTINKEEALQRPVASDFE
QTVHSIPLTINKEVALMRAVAADFE

SEQ ID NO: 47198 - protein, 25 aa, synthetic construct
  source 1..25: note = Seed: QTVHSIPLTINKEEALQRPVASDFE
QTVHSIPLTINKEVALMRAVAGDFE

SEQ ID NO: 47199 - protein, 25 aa, synthetic construct
  source 1..25: note = Seed: QTVHSIPLTINKEEALQRPVASDFE
QTVHSIPLTINKEVALMRAVAHDFE

SEQ ID NO: 47200 - protein, 25 aa, synthetic construct
  source 1..25: note = Seed: QTVHSIPLTINKEEALQRPVASDFE
QTVHSIPLTINKEVALMRAVAMDFE

SEQ ID NO: 47201 - protein, 25 aa, synthetic construct
  source 1..25: note = Seed: QTVHSIPLTINKEEALQRPVASDFE
QTVHSIPLTINKEVALMRAVANDFE

SEQ ID NO: 47202 - protein, 25 aa, synthetic construct
  source 1..25: note = Seed: QTVHSIPLTINKEEALQRPVASDFE
QTVHSIPLTINKEVALMRAVASDFE

SEQ ID NO: 47203 - protein, 25 aa, synthetic construct
  source 1..25: note = Seed: QTVHSIPLTINKEEALQRPVASDFE
QTVHSIPLTINKEVALMRAVATDFE

SEQ ID NO: 47204 - protein, 25 aa, synthetic construct
  source 1..25: note = Seed: QTVHSIPLTINKEEALQRPVASDFE
QTVHSIPLTINKEVALMRAVAVDFE

SEQ ID NO: 47205 - protein, 25 aa, synthetic construct
  source 1..25: note = Seed: QTVHSIPLTINKEEALQRPVASDFE
QTVHSIPLTINKEVALMRGVAADFE

SEQ ID NO: 47206 - protein, 25 aa, synthetic construct
  source 1..25: note = Seed: QTVHSIPLTINKEEALQRPVASDFE
QTVHSIPLTINKEVALMRGVANDFE

SEQ ID NO: 47207 - protein, 25 aa, synthetic construct
  source 1..25: note = Seed: QTVHSIPLTINKEEALQRPVASDFE
QTVHSIPLTINKEVALMRGVASDFE

SEQ ID NO: 47208 - protein, 25 aa, synthetic construct
  source 1..25: note = Seed: QTVHSIPLTINKEEALQRPVASDFE
QTVHSIPLTINKEVALMRGVATDFE

SEQ ID NO: 47209 - protein, 25 aa, synthetic construct
  source 1..25: note = Seed: QTVHSIPLTINKEEALQRPVASDFE
QTVHSIPLTINKEVALMRIVANDFE

SEQ ID NO: 47210 - protein, 25 aa, synthetic construct
  source 1..25: note = Seed: QTVHSIPLTINKEEALQRPVASDFE
QTVHSIPLTINKEVALMRNVAADFE

SEQ ID NO: 47211 - protein, 25 aa, synthetic construct
  source 1..25: note = Seed: QTVHSIPLTINKEEALQRPVASDFE
QTVHSIPLTINKEVALMRNVANDFE

SEQ ID NO: 47212 - protein, 25 aa, synthetic construct
  source 1..25: note = Seed: QTVHSIPLTINKEEALQRPVASDFE
QTVHSIPLTINKEVALMRNVASDFE

SEQ ID NO: 47213 - protein, 25 aa, synthetic construct
  source 1..25: note = Seed: QTVHSIPLTINKEEALQRPVASDFE
QTVHSIPLTINKEVALMRNVATDFE

SEQ ID NO: 47214 - protein, 25 aa, synthetic construct
  source 1..25: note = Seed: QTVHSIPLTINKEEALQRPVASDFE
QTVHSIPLTINKEVALMRPVAADFE

SEQ ID NO: 47215 - protein, 25 aa, synthetic construct
  source 1..25: note = Seed: QTVHSIPLTINKEEALQRPVASDFE
QTVHSIPLTINKEVALMRPVAHDFE

SEQ ID NO: 47216 - protein, 25 aa, synthetic construct
  source 1..25: note = Seed: QTVHSIPLTINKEEALQRPVASDFE
QTVHSIPLTINKEVALMRPVAIDFE

SEQ ID NO: 47217 - protein, 25 aa, synthetic construct
  source 1..25: note = Seed: QTVHSIPLTINKEEALQRPVASDFE
QTVHSIPLTINKEVALMRPVALDFE

SEQ ID NO: 47218 - protein, 25 aa, synthetic construct
  source 1..25: note = Seed: QTVHSIPLTINKEEALQRPVASDFE
QTVHSIPLTINKEVALMRPVAMDFE

SEQ ID NO: 47219 - protein, 25 aa, synthetic construct
  source 1..25: note = Seed: QTVHSIPLTINKEEALQRPVASDFE
QTVHSIPLTINKEVALMRPVANDFE

SEQ ID NO: 47220 - protein, 25 aa, synthetic construct
  source 1..25: note = Seed: QTVHSIPLTINKEEALQRPVASDFE
QTVHSIPLTINKEVALMRPVASDFE

SEQ ID NO: 47221 - protein, 25 aa, synthetic construct
  source 1..25: note = Seed: QTVHSIPLTINKEEALQRPVASDFE
QTVHSIPLTINKEVALMRPVATDFE

SEQ ID NO: 47222 - protein, 25 aa, synthetic construct
  source 1..25: note = Seed: QTVHSIPLTINKEEALQRPVASDFE
QTVHSIPLTINKEVALMRPVAVDFE

SEQ ID NO: 47223 - protein, 25 aa, synthetic construct
  source 1..25: note = Seed: QTVHSIPLTINKEEALQRPVASDFE
QTVHSIPLTINKEVALMRSVAADFE

SEQ ID NO: 47224 - protein, 25 aa, synthetic construct
  source 1..25: note = Seed: QTVHSIPLTINKEEALQRPVASDFE
QTVHSIPLTINKEVALMRSVAHDFE

SEQ ID NO: 47225 - protein, 25 aa, synthetic construct
  source 1..25: note = Seed: QTVHSIPLTINKEEALQRPVASDFE
QTVHSIPLTINKEVALMRSVANDFE

SEQ ID NO: 47226 - protein, 25 aa, synthetic construct
  source 1..25: note = Seed: QTVHSIPLTINKEEALQRPVASDFE
QTVHSIPLTINKEVALMRSVASDFE

SEQ ID NO: 47227 - protein, 25 aa, synthetic construct
  source 1..25: note = Seed: QTVHSIPLTINKEEALQRPVASDFE
QTVHSIPLTINKEVALMRSVATDFE

SEQ ID NO: 47228 - protein, 25 aa, synthetic construct
  source 1..25: note = Seed: QTVHSIPLTINKEEALQRPVASDFE
QTVHSIPLTINKEVALMRSVAVDFE

SEQ ID NO: 47229 - protein, 25 aa, synthetic construct
  source 1..25: note = Seed: QTVHSIPLTINKEEALQRPVASDFE
QTVHSIPLTINKEVALMRTVAADFE

SEQ ID NO: 47230 - protein, 25 aa, synthetic construct
  source 1..25: note = Seed: QTVHSIPLTINKEEALQRPVASDFE
QTVHSIPLTINKEVALMRTVAHDFE

SEQ ID NO: 47231 - protein, 25 aa, synthetic construct
  source 1..25: note = Seed: QTVHSIPLTINKEEALQRPVASDFE
QTVHSIPLTINKEVALMRTVAMDFE

SEQ ID NO: 47232 - protein, 25 aa, synthetic construct
  source 1..25: note = Seed: QTVHSIPLTINKEEALQRPVASDFE
QTVHSIPLTINKEVALMRTVANDFE

SEQ ID NO: 47233 - protein, 25 aa, synthetic construct
  source 1..25: note = Seed: QTVHSIPLTINKEEALQRPVASDFE
QTVHSIPLTINKEVALMRTVASDFE

SEQ ID NO: 47234 - protein, 25 aa, synthetic construct
  source 1..25: note = Seed: QTVHSIPLTINKEEALQRPVASDFE
QTVHSIPLTINKEVALMRTVATDFE

SEQ ID NO: 47235 - protein, 25 aa, synthetic construct
  source 1..25: note = Seed: QTVHSIPLTINKEEALQRPVASDFE
QTVHSIPLTINKEVALMRTVAVDFE

SEQ ID NO: 47236 - protein, 25 aa, synthetic construct
  source 1..25: note = Seed: QTVHSIPLTINKEEALQRPVASDFE
QTVHSIPLTINKEVALMRVVAADFE

SEQ ID NO: 47237 - protein, 25 aa, synthetic construct
  source 1..25: note = Seed: QTVHSIPLTINKEEALQRPVASDFE
QTVHSIPLTINKEVALMRVVAHDFE

SEQ ID NO: 47238 - protein, 25 aa, synthetic construct
  source 1..25: note = Seed: QTVHSIPLTINKEEALQRPVASDFE
QTVHSIPLTINKEVALMRVVANDFE

SEQ ID NO: 47239 - protein, 25 aa, synthetic construct
  source 1..25: note = Seed: QTVHSIPLTINKEEALQRPVASDFE
QTVHSIPLTINKEVALMRVVASDFE

SEQ ID NO: 47240 - protein, 25 aa, synthetic construct
  source 1..25: note = Seed: QTVHSIPLTINKEEALQRPVASDFE
QTVHSIPLTINKEVALQRAVAADFE

SEQ ID NO: 47241 - protein, 25 aa, synthetic construct
  source 1..25: note = Seed: QTVHSIPLTINKEEALQRPVASDFE
QTVHSIPLTINKEVALQRAVANDFE

SEQ ID NO: 47242 - protein, 25 aa, synthetic construct
  source 1..25: note = Seed: QTVHSIPLTINKEEALQRPVASDFE
QTVHSIPLTINKEVALQRAVASDFE

SEQ ID NO: 47243 - protein, 25 aa, synthetic construct
  source 1..25: note = Seed: QTVHSIPLTINKEEALQRPVASDFE
QTVHSIPLTINKEVALVRPVANDFE

SEQ ID NO: 47244 - protein, 25 aa, synthetic construct
  source 1..25: note = Seed: QTVHSIPLTINKEEALQRPVASDFE
QTVHSIPLTINKEWALARAVAADFE

SEQ ID NO: 47245 - protein, 25 aa, synthetic construct
  source 1..25: note = Seed: QTVHSIPLTINKEEALQRPVASDFE
QTVHSIPLTINKEWALARAVADDFE

SEQ ID NO: 47246 - protein, 25 aa, synthetic construct
  source 1..25: note = Seed: QTVHSIPLTINKEEALQRPVASDFE
QTVHSIPLTINKEWALARAVAEDFE

SEQ ID NO: 47247 - protein, 25 aa, synthetic construct
  source 1..25: note = Seed: QTVHSIPLTINKEEALQRPVASDFE
QTVHSIPLTINKEWALARAVAGDFE

SEQ ID NO: 47248 - protein, 25 aa, synthetic construct
  source 1..25: note = Seed: QTVHSIPLTINKEEALQRPVASDFE
QTVHSIPLTINKEWALARAVAHDFE

SEQ ID NO: 47249 - protein, 25 aa, synthetic construct
  source 1..25: note = Seed: QTVHSIPLTINKEEALQRPVASDFE
QTVHSIPLTINKEWALARAVAIDFE

SEQ ID NO: 47250 - protein, 25 aa, synthetic construct
  source 1..25: note = Seed: QTVHSIPLTINKEEALQRPVASDFE
QTVHSIPLTINKEWALARAVAKDFE

SEQ ID NO: 47251 - protein, 25 aa, synthetic construct
  source 1..25: note = Seed: QTVHSIPLTINKEEALQRPVASDFE
QTVHSIPLTINKEWALARAVALDFE

SEQ ID NO: 47252 - protein, 25 aa, synthetic construct
  source 1..25: note = Seed: QTVHSIPLTINKEEALQRPVASDFE
QTVHSIPLTINKEWALARAVAMDFE

SEQ ID NO: 47253 - protein, 25 aa, synthetic construct
  source 1..25: note = Seed: QTVHSIPLTINKEEALQRPVASDFE
QTVHSIPLTINKEWALARAVANDFE

SEQ ID NO: 47254 - protein, 25 aa, synthetic construct
  source 1..25: note = Seed: QTVHSIPLTINKEEALQRPVASDFE
QTVHSIPLTINKEWALARAVAPDFE

SEQ ID NO: 47255 - protein, 25 aa, synthetic construct
  source 1..25: note = Seed: QTVHSIPLTINKEEALQRPVASDFE
QTVHSIPLTINKEWALARAVAQDFE

SEQ ID NO: 47256 - protein, 25 aa, synthetic construct
  source 1..25: note = Seed: QTVHSIPLTINKEEALQRPVASDFE
QTVHSIPLTINKEWALARAVASDFE

SEQ ID NO: 47257 - protein, 25 aa, synthetic construct
  source 1..25: note = Seed: QTVHSIPLTINKEEALQRPVASDFE
QTVHSIPLTINKEWALARAVATDFE

SEQ ID NO: 47258 - protein, 25 aa, synthetic construct
  source 1..25: note = Seed: QTVHSIPLTINKEEALQRPVASDFE
QTVHSIPLTINKEWALARAVAVDFE

SEQ ID NO: 47259 - protein, 25 aa, synthetic construct
  source 1..25: note = Seed: QTVHSIPLTINKEEALQRPVASDFE
QTVHSIPLTINKEWALARAVAYDFE

SEQ ID NO: 47260 - protein, 25 aa, synthetic construct
  source 1..25: note = Seed: QTVHSIPLTINKEEALQRPVASDFE
QTVHSIPLTINKEWALARGVAADFE

SEQ ID NO: 47261 - protein, 25 aa, synthetic construct
  source 1..25: note = Seed: QTVHSIPLTINKEEALQRPVASDFE
QTVHSIPLTINKEWALARGVAGDFE

SEQ ID NO: 47262 - protein, 25 aa, synthetic construct
  source 1..25: note = Seed: QTVHSIPLTINKEEALQRPVASDFE
QTVHSIPLTINKEWALARGVAIDFE

SEQ ID NO: 47263 - protein, 25 aa, synthetic construct
  source 1..25: note = Seed: QTVHSIPLTINKEEALQRPVASDFE
QTVHSIPLTINKEWALARGVALDFE

SEQ ID NO: 47264 - protein, 25 aa, synthetic construct
  source 1..25: note = Seed: QTVHSIPLTINKEEALQRPVASDFE
QTVHSIPLTINKEWALARGVAMDFE

SEQ ID NO: 47265 - protein, 25 aa, synthetic construct
  source 1..25: note = Seed: QTVHSIPLTINKEEALQRPVASDFE
QTVHSIPLTINKEWALARGVANDFE

SEQ ID NO: 47266 - protein, 25 aa, synthetic construct
  source 1..25: note = Seed: QTVHSIPLTINKEEALQRPVASDFE
QTVHSIPLTINKEWALARGVAQDFE

SEQ ID NO: 47267 - protein, 25 aa, synthetic construct
  source 1..25: note = Seed: QTVHSIPLTINKEEALQRPVASDFE
QTVHSIPLTINKEWALARGVASDFE

SEQ ID NO: 47268 - protein, 25 aa, synthetic construct
  source 1..25: note = Seed: QTVHSIPLTINKEEALQRPVASDFE
QTVHSIPLTINKEWALARGVATDFE

SEQ ID NO: 47269 - protein, 25 aa, synthetic construct
  source 1..25: note = Seed: QTVHSIPLTINKEEALQRPVASDFE
QTVHSIPLTINKEWALARGVAVDFE

SEQ ID NO: 47270 - protein, 25 aa, synthetic construct
  source 1..25: note = Seed: QTVHSIPLTINKEEALQRPVASDFE
QTVHSIPLTINKEWALARIVAADFE

SEQ ID NO: 47271 - protein, 25 aa, synthetic construct
  source 1..25: note = Seed: QTVHSIPLTINKEEALQRPVASDFE
QTVHSIPLTINKEWALARIVAGDFE

SEQ ID NO: 47272 - protein, 25 aa, synthetic construct
  source 1..25: note = Seed: QTVHSIPLTINKEEALQRPVASDFE
QTVHSIPLTINKEWALARIVAHDFE

SEQ ID NO: 47273 - protein, 25 aa, synthetic construct
  source 1..25: note = Seed: QTVHSIPLTINKEEALQRPVASDFE
QTVHSIPLTINKEWALARIVANDFE

SEQ ID NO: 47274 - protein, 25 aa, synthetic construct
  source 1..25: note = Seed: QTVHSIPLTINKEEALQRPVASDFE
QTVHSIPLTINKEWALARIVASDFE

SEQ ID NO: 47275 - protein, 25 aa, synthetic construct
  source 1..25: note = Seed: QTVHSIPLTINKEEALQRPVASDFE
QTVHSIPLTINKEWALARIVATDFE

SEQ ID NO: 47276 - protein, 25 aa, synthetic construct
  source 1..25: note = Seed: QTVHSIPLTINKEEALQRPVASDFE
QTVHSIPLTINKEWALARLVANDFE

SEQ ID NO: 47277 - protein, 25 aa, synthetic construct
  source 1..25: note = Seed: QTVHSIPLTINKEEALQRPVASDFE
QTVHSIPLTINKEWALARMVANDFE

SEQ ID NO: 47278 - protein, 25 aa, synthetic construct
  source 1..25: note = Seed: QTVHSIPLTINKEEALQRPVASDFE
QTVHSIPLTINKEWALARNVAADFE

SEQ ID NO: 47279 - protein, 25 aa, synthetic construct
  source 1..25: note = Seed: QTVHSIPLTINKEEALQRPVASDFE
QTVHSIPLTINKEWALARNVAGDFE

SEQ ID NO: 47280 - protein, 25 aa, synthetic construct
  source 1..25: note = Seed: QTVHSIPLTINKEEALQRPVASDFE
QTVHSIPLTINKEWALARNVAIDFE

SEQ ID NO: 47281 - protein, 25 aa, synthetic construct
  source 1..25: note = Seed: QTVHSIPLTINKEEALQRPVASDFE
QTVHSIPLTINKEWALARNVALDFE

SEQ ID NO: 47282 - protein, 25 aa, synthetic construct
  source 1..25: note = Seed: QTVHSIPLTINKEEALQRPVASDFE
QTVHSIPLTINKEWALARNVAMDFE

SEQ ID NO: 47283 - protein, 25 aa, synthetic construct
  source 1..25: note = Seed: QTVHSIPLTINKEEALQRPVASDFE
QTVHSIPLTINKEWALARNVANDFE

SEQ ID NO: 47284 - protein, 25 aa, synthetic construct
  source 1..25: note = Seed: QTVHSIPLTINKEEALQRPVASDFE
QTVHSIPLTINKEWALARNVAQDFE

SEQ ID NO: 47285 - protein, 25 aa, synthetic construct
  source 1..25: note = Seed: QTVHSIPLTINKEEALQRPVASDFE
QTVHSIPLTINKEWALARNVASDFE

SEQ ID NO: 47286 - protein, 25 aa, synthetic construct
  source 1..25: note = Seed: QTVHSIPLTINKEEALQRPVASDFE
QTVHSIPLTINKEWALARNVATDFE

SEQ ID NO: 47287 - protein, 25 aa, synthetic construct
  source 1..25: note = Seed: QTVHSIPLTINKEEALQRPVASDFE
QTVHSIPLTINKEWALARNVAVDFE

SEQ ID NO: 47288 - protein, 25 aa, synthetic construct
  source 1..25: note = Seed: QTVHSIPLTINKEEALQRPVASDFE
QTVHSIPLTINKEWALARPVAADFE

SEQ ID NO: 47289 - protein, 25 aa, synthetic construct
  source 1..25: note = Seed: QTVHSIPLTINKEEALQRPVASDFE
QTVHSIPLTINKEWALARPVAGDFE

SEQ ID NO: 47290 - protein, 25 aa, synthetic construct
  source 1..25: note = Seed: QTVHSIPLTINKEEALQRPVASDFE
QTVHSIPLTINKEWALARPVAHDFE

SEQ ID NO: 47291 - protein, 25 aa, synthetic construct
  source 1..25: note = Seed: QTVHSIPLTINKEEALQRPVASDFE
QTVHSIPLTINKEWALARPVAIDFE

SEQ ID NO: 47292 - protein, 25 aa, synthetic construct
  source 1..25: note = Seed: QTVHSIPLTINKEEALQRPVASDFE
QTVHSIPLTINKEWALARPVALDFE

SEQ ID NO: 47293 - protein, 25 aa, synthetic construct
  source 1..25: note = Seed: QTVHSIPLTINKEEALQRPVASDFE
QTVHSIPLTINKEWALARPVAMDFE

SEQ ID NO: 47294 - protein, 25 aa, synthetic construct
  source 1..25: note = Seed: QTVHSIPLTINKEEALQRPVASDFE
QTVHSIPLTINKEWALARPVANDFE

SEQ ID NO: 47295 - protein, 25 aa, synthetic construct
  source 1..25: note = Seed: QTVHSIPLTINKEEALQRPVASDFE
QTVHSIPLTINKEWALARPVAQDFE

SEQ ID NO: 47296 - protein, 25 aa, synthetic construct
  source 1..25: note = Seed: QTVHSIPLTINKEEALQRPVASDFE
QTVHSIPLTINKEWALARPVASDFE

SEQ ID NO: 47297 - protein, 25 aa, synthetic construct
  source 1..25: note = Seed: QTVHSIPLTINKEEALQRPVASDFE
QTVHSIPLTINKEWALARPVATDFE

SEQ ID NO: 47298 - protein, 25 aa, synthetic construct
  source 1..25: note = Seed: QTVHSIPLTINKEEALQRPVASDFE
QTVHSIPLTINKEWALARPVAVDFE

SEQ ID NO: 47299 - protein, 25 aa, synthetic construct
  source 1..25: note = Seed: QTVHSIPLTINKEEALQRPVASDFE
QTVHSIPLTINKEWALARSVAADFE

SEQ ID NO: 47300 - protein, 25 aa, synthetic construct
  source 1..25: note = Seed: QTVHSIPLTINKEEALQRPVASDFE
QTVHSIPLTINKEWALARSVAGDFE

SEQ ID NO: 47301 - protein, 25 aa, synthetic construct
  source 1..25: note = Seed: QTVHSIPLTINKEEALQRPVASDFE
QTVHSIPLTINKEWALARSVAHDFE

SEQ ID NO: 47302 - protein, 25 aa, synthetic construct
  source 1..25: note = Seed: QTVHSIPLTINKEEALQRPVASDFE
QTVHSIPLTINKEWALARSVAIDFE

SEQ ID NO: 47303 - protein, 25 aa, synthetic construct
  source 1..25: note = Seed: QTVHSIPLTINKEEALQRPVASDFE
QTVHSIPLTINKEWALARSVALDFE

SEQ ID NO: 47304 - protein, 25 aa, synthetic construct
  source 1..25: note = Seed: QTVHSIPLTINKEEALQRPVASDFE
QTVHSIPLTINKEWALARSVAMDFE

SEQ ID NO: 47305 - protein, 25 aa, synthetic construct
  source 1..25: note = Seed: QTVHSIPLTINKEEALQRPVASDFE
QTVHSIPLTINKEWALARSVANDFE

SEQ ID NO: 47306 - protein, 25 aa, synthetic construct
  source 1..25: note = Seed: QTVHSIPLTINKEEALQRPVASDFE
QTVHSIPLTINKEWALARSVAQDFE

SEQ ID NO: 47307 - protein, 25 aa, synthetic construct
  source 1..25: note = Seed: QTVHSIPLTINKEEALQRPVASDFE
QTVHSIPLTINKEWALARSVASDFE

SEQ ID NO: 47308 - protein, 25 aa, synthetic construct
  source 1..25: note = Seed: QTVHSIPLTINKEEALQRPVASDFE
QTVHSIPLTINKEWALARSVATDFE

SEQ ID NO: 47309 - protein, 25 aa, synthetic construct
  source 1..25: note = Seed: QTVHSIPLTINKEEALQRPVASDFE
QTVHSIPLTINKEWALARSVAVDFE

SEQ ID NO: 47310 - protein, 25 aa, synthetic construct
  source 1..25: note = Seed: QTVHSIPLTINKEEALQRPVASDFE
QTVHSIPLTINKEWALARTVAADFE

SEQ ID NO: 47311 - protein, 25 aa, synthetic construct
  source 1..25: note = Seed: QTVHSIPLTINKEEALQRPVASDFE
QTVHSIPLTINKEWALARTVAGDFE

SEQ ID NO: 47312 - protein, 25 aa, synthetic construct
  source 1..25: note = Seed: QTVHSIPLTINKEEALQRPVASDFE
QTVHSIPLTINKEWALARTVAHDFE

SEQ ID NO: 47313 - protein, 25 aa, synthetic construct
  source 1..25: note = Seed: QTVHSIPLTINKEEALQRPVASDFE
QTVHSIPLTINKEWALARTVAIDFE

SEQ ID NO: 47314 - protein, 25 aa, synthetic construct
  source 1..25: note = Seed: QTVHSIPLTINKEEALQRPVASDFE
QTVHSIPLTINKEWALARTVALDFE

SEQ ID NO: 47315 - protein, 25 aa, synthetic construct
  source 1..25: note = Seed: QTVHSIPLTINKEEALQRPVASDFE
QTVHSIPLTINKEWALARTVAMDFE

SEQ ID NO: 47316 - protein, 25 aa, synthetic construct
  source 1..25: note = Seed: QTVHSIPLTINKEEALQRPVASDFE
QTVHSIPLTINKEWALARTVANDFE

SEQ ID NO: 47317 - protein, 25 aa, synthetic construct
  source 1..25: note = Seed: QTVHSIPLTINKEEALQRPVASDFE
QTVHSIPLTINKEWALARTVAQDFE

SEQ ID NO: 47318 - protein, 25 aa, synthetic construct
  source 1..25: note = Seed: QTVHSIPLTINKEEALQRPVASDFE
QTVHSIPLTINKEWALARTVASDFE

SEQ ID NO: 47319 - protein, 25 aa, synthetic construct
  source 1..25: note = Seed: QTVHSIPLTINKEEALQRPVASDFE
QTVHSIPLTINKEWALARTVATDFE

SEQ ID NO: 47320 - protein, 25 aa, synthetic construct
  source 1..25: note = Seed: QTVHSIPLTINKEEALQRPVASDFE
QTVHSIPLTINKEWALARTVAVDFE

SEQ ID NO: 47321 - protein, 25 aa, synthetic construct
  source 1..25: note = Seed: QTVHSIPLTINKEEALQRPVASDFE
QTVHSIPLTINKEWALARVVAADFE

SEQ ID NO: 47322 - protein, 25 aa, synthetic construct
  source 1..25: note = Seed: QTVHSIPLTINKEEALQRPVASDFE
QTVHSIPLTINKEWALARVVAGDFE

SEQ ID NO: 47323 - protein, 25 aa, synthetic construct
  source 1..25: note = Seed: QTVHSIPLTINKEEALQRPVASDFE
QTVHSIPLTINKEWALARVVAHDFE

SEQ ID NO: 47324 - protein, 25 aa, synthetic construct
  source 1..25: note = Seed: QTVHSIPLTINKEEALQRPVASDFE
QTVHSIPLTINKEWALARVVAIDFE

SEQ ID NO: 47325 - protein, 25 aa, synthetic construct
  source 1..25: note = Seed: QTVHSIPLTINKEEALQRPVASDFE
QTVHSIPLTINKEWALARVVAMDFE

SEQ ID NO: 47326 - protein, 25 aa, synthetic construct
  source 1..25: note = Seed: QTVHSIPLTINKEEALQRPVASDFE
QTVHSIPLTINKEWALARVVANDFE

SEQ ID NO: 47327 - protein, 25 aa, synthetic construct
  source 1..25: note = Seed: QTVHSIPLTINKEEALQRPVASDFE
QTVHSIPLTINKEWALARVVAQDFE

SEQ ID NO: 47328 - protein, 25 aa, synthetic construct
  source 1..25: note = Seed: QTVHSIPLTINKEEALQRPVASDFE
QTVHSIPLTINKEWALARVVASDFE

SEQ ID NO: 47329 - protein, 25 aa, synthetic construct
  source 1..25: note = Seed: QTVHSIPLTINKEEALQRPVASDFE
QTVHSIPLTINKEWALARVVATDFE

SEQ ID NO: 47330 - protein, 25 aa, synthetic construct
  source 1..25: note = Seed: QTVHSIPLTINKEEALQRPVASDFE
QTVHSIPLTINKEWALARVVAVDFE

SEQ ID NO: 47331 - protein, 25 aa, synthetic construct
  source 1..25: note = Seed: QTVHSIPLTINKEEALQRPVASDFE
QTVHSIPLTINKEWALERAVAADFE

SEQ ID NO: 47332 - protein, 25 aa, synthetic construct
  source 1..25: note = Seed: QTVHSIPLTINKEEALQRPVASDFE
QTVHSIPLTINKEWALERAVANDFE

SEQ ID NO: 47333 - protein, 25 aa, synthetic construct
  source 1..25: note = Seed: QTVHSIPLTINKEEALQRPVASDFE
QTVHSIPLTINKEWALERAVASDFE

SEQ ID NO: 47334 - protein, 25 aa, synthetic construct
  source 1..25: note = Seed: QTVHSIPLTINKEEALQRPVASDFE
QTVHSIPLTINKEWALERAVATDFE

SEQ ID NO: 47335 - protein, 25 aa, synthetic construct
  source 1..25: note = Seed: QTVHSIPLTINKEEALQRPVASDFE
QTVHSIPLTINKEWALERPVAADFE

SEQ ID NO: 47336 - protein, 25 aa, synthetic construct
  source 1..25: note = Seed: QTVHSIPLTINKEEALQRPVASDFE
QTVHSIPLTINKEWALERPVASDFE

SEQ ID NO: 47337 - protein, 25 aa, synthetic construct
  source 1..25: note = Seed: QTVHSIPLTINKEEALQRPVASDFE
QTVHSIPLTINKEWALERSVAADFE

SEQ ID NO: 47338 - protein, 25 aa, synthetic construct
  source 1..25: note = Seed: QTVHSIPLTINKEEALQRPVASDFE
QTVHSIPLTINKEWALERSVANDFE

SEQ ID NO: 47339 - protein, 25 aa, synthetic construct
  source 1..25: note = Seed: QTVHSIPLTINKEEALQRPVASDFE
QTVHSIPLTINKEWALERSVASDFE

SEQ ID NO: 47340 - protein, 25 aa, synthetic construct
  source 1..25: note = Seed: QTVHSIPLTINKEEALQRPVASDFE
QTVHSIPLTINKEWALERTVAADFE

SEQ ID NO: 47341 - protein, 25 aa, synthetic construct
  source 1..25: note = Seed: QTVHSIPLTINKEEALQRPVASDFE
QTVHSIPLTINKEWALERTVANDFE

SEQ ID NO: 47342 - protein, 25 aa, synthetic construct
  source 1..25: note = Seed: QTVHSIPLTINKEEALQRPVASDFE
QTVHSIPLTINKEWALERTVASDFE

SEQ ID NO: 47343 - protein, 25 aa, synthetic construct
  source 1..25: note = Seed: QTVHSIPLTINKEEALQRPVASDFE
QTVHSIPLTINKEWALFRAVAADFE

SEQ ID NO: 47344 - protein, 25 aa, synthetic construct
  source 1..25: note = Seed: QTVHSIPLTINKEEALQRPVASDFE
QTVHSIPLTINKEWALFRAVANDFE

SEQ ID NO: 47345 - protein, 25 aa, synthetic construct
  source 1..25: note = Seed: QTVHSIPLTINKEEALQRPVASDFE
QTVHSIPLTINKEWALFRAVASDFE

SEQ ID NO: 47346 - protein, 25 aa, synthetic construct
  source 1..25: note = Seed: QTVHSIPLTINKEEALQRPVASDFE
QTVHSIPLTINKEWALFRPVAADFE

SEQ ID NO: 47347 - protein, 25 aa, synthetic construct
  source 1..25: note = Seed: QTVHSIPLTINKEEALQRPVASDFE
QTVHSIPLTINKEWALFRPVANDFE

SEQ ID NO: 47348 - protein, 25 aa, synthetic construct
  source 1..25: note = Seed: QTVHSIPLTINKEEALQRPVASDFE
QTVHSIPLTINKEWALFRPVASDFE

SEQ ID NO: 47349 - protein, 25 aa, synthetic construct
  source 1..25: note = Seed: QTVHSIPLTINKEEALQRPVASDFE
QTVHSIPLTINKEWALFRSVAADFE

SEQ ID NO: 47350 - protein, 25 aa, synthetic construct
  source 1..25: note = Seed: QTVHSIPLTINKEEALQRPVASDFE
QTVHSIPLTINKEWALFRSVANDFE

SEQ ID NO: 47351 - protein, 25 aa, synthetic construct
  source 1..25: note = Seed: QTVHSIPLTINKEEALQRPVASDFE
QTVHSIPLTINKEWALFRTVAADFE

SEQ ID NO: 47352 - protein, 25 aa, synthetic construct
  source 1..25: note = Seed: QTVHSIPLTINKEEALQRPVASDFE
QTVHSIPLTINKEWALFRTVANDFE

SEQ ID NO: 47353 - protein, 25 aa, synthetic construct
  source 1..25: note = Seed: QTVHSIPLTINKEEALQRPVASDFE
QTVHSIPLTINKEWALFRTVASDFE

SEQ ID NO: 47354 - protein, 25 aa, synthetic construct
  source 1..25: note = Seed: QTVHSIPLTINKEEALQRPVASDFE
QTVHSIPLTINKEWALGRAVAADFE

SEQ ID NO: 47355 - protein, 25 aa, synthetic construct
  source 1..25: note = Seed: QTVHSIPLTINKEEALQRPVASDFE
QTVHSIPLTINKEWALGRAVASDFE

SEQ ID NO: 47356 - protein, 25 aa, synthetic construct
  source 1..25: note = Seed: QTVHSIPLTINKEEALQRPVASDFE
QTVHSIPLTINKEWALIRAVAADFE

SEQ ID NO: 47357 - protein, 25 aa, synthetic construct
  source 1..25: note = Seed: QTVHSIPLTINKEEALQRPVASDFE
QTVHSIPLTINKEWALIRAVADDFE

SEQ ID NO: 47358 - protein, 25 aa, synthetic construct
  source 1..25: note = Seed: QTVHSIPLTINKEEALQRPVASDFE
QTVHSIPLTINKEWALIRAVAEDFE

SEQ ID NO: 47359 - protein, 25 aa, synthetic construct
  source 1..25: note = Seed: QTVHSIPLTINKEEALQRPVASDFE
QTVHSIPLTINKEWALIRAVAGDFE

SEQ ID NO: 47360 - protein, 25 aa, synthetic construct
  source 1..25: note = Seed: QTVHSIPLTINKEEALQRPVASDFE
QTVHSIPLTINKEWALIRAVAHDFE

SEQ ID NO: 47361 - protein, 25 aa, synthetic construct
  source 1..25: note = Seed: QTVHSIPLTINKEEALQRPVASDFE
QTVHSIPLTINKEWALIRAVAIDFE

SEQ ID NO: 47362 - protein, 25 aa, synthetic construct
  source 1..25: note = Seed: QTVHSIPLTINKEEALQRPVASDFE
QTVHSIPLTINKEWALIRAVALDFE

SEQ ID NO: 47363 - protein, 25 aa, synthetic construct
  source 1..25: note = Seed: QTVHSIPLTINKEEALQRPVASDFE
QTVHSIPLTINKEWALIRAVAMDFE

SEQ ID NO: 47364 - protein, 25 aa, synthetic construct
  source 1..25: note = Seed: QTVHSIPLTINKEEALQRPVASDFE
QTVHSIPLTINKEWALIRAVANDFE

SEQ ID NO: 47365 - protein, 25 aa, synthetic construct
  source 1..25: note = Seed: QTVHSIPLTINKEEALQRPVASDFE
QTVHSIPLTINKEWALIRAVAPDFE

SEQ ID NO: 47366 - protein, 25 aa, synthetic construct
  source 1..25: note = Seed: QTVHSIPLTINKEEALQRPVASDFE
QTVHSIPLTINKEWALIRAVAQDFE

SEQ ID NO: 47367 - protein, 25 aa, synthetic construct
  source 1..25: note = Seed: QTVHSIPLTINKEEALQRPVASDFE
QTVHSIPLTINKEWALIRAVASDFE

SEQ ID NO: 47368 - protein, 25 aa, synthetic construct
  source 1..25: note = Seed: QTVHSIPLTINKEEALQRPVASDFE
QTVHSIPLTINKEWALIRAVATDFE

SEQ ID NO: 47369 - protein, 25 aa, synthetic construct
  source 1..25: note = Seed: QTVHSIPLTINKEEALQRPVASDFE
QTVHSIPLTINKEWALIRAVAVDFE

SEQ ID NO: 47370 - protein, 25 aa, synthetic construct
  source 1..25: note = Seed: QTVHSIPLTINKEEALQRPVASDFE
QTVHSIPLTINKEWALIRGVAADFE

SEQ ID NO: 47371 - protein, 25 aa, synthetic construct
  source 1..25: note = Seed: QTVHSIPLTINKEEALQRPVASDFE
QTVHSIPLTINKEWALIRGVAGDFE

SEQ ID NO: 47372 - protein, 25 aa, synthetic construct
  source 1..25: note = Seed: QTVHSIPLTINKEEALQRPVASDFE
QTVHSIPLTINKEWALIRGVAHDFE

SEQ ID NO: 47373 - protein, 25 aa, synthetic construct
  source 1..25: note = Seed: QTVHSIPLTINKEEALQRPVASDFE
QTVHSIPLTINKEWALIRGVANDFE

SEQ ID NO: 47374 - protein, 25 aa, synthetic construct
  source 1..25: note = Seed: QTVHSIPLTINKEEALQRPVASDFE
QTVHSIPLTINKEWALIRGVASDFE

SEQ ID NO: 47375 - protein, 25 aa, synthetic construct
  source 1..25: note = Seed: QTVHSIPLTINKEEALQRPVASDFE
QTVHSIPLTINKEWALIRGVATDFE

SEQ ID NO: 47376 - protein, 25 aa, synthetic construct
  source 1..25: note = Seed: QTVHSIPLTINKEEALQRPVASDFE
QTVHSIPLTINKEWALIRGVAVDFE

SEQ ID NO: 47377 - protein, 25 aa, synthetic construct
  source 1..25: note = Seed: QTVHSIPLTINKEEALQRPVASDFE
QTVHSIPLTINKEWALIRIVAHDFE

SEQ ID NO: 47378 - protein, 25 aa, synthetic construct
  source 1..25: note = Seed: QTVHSIPLTINKEEALQRPVASDFE
QTVHSIPLTINKEWALIRIVANDFE

SEQ ID NO: 47379 - protein, 25 aa, synthetic construct
  source 1..25: note = Seed: QTVHSIPLTINKEEALQRPVASDFE
QTVHSIPLTINKEWALIRIVASDFE

SEQ ID NO: 47380 - protein, 25 aa, synthetic construct
  source 1..25: note = Seed: QTVHSIPLTINKEEALQRPVASDFE
QTVHSIPLTINKEWALIRNVAADFE

SEQ ID NO: 47381 - protein, 25 aa, synthetic construct
  source 1..25: note = Seed: QTVHSIPLTINKEEALQRPVASDFE
QTVHSIPLTINKEWALIRNVAGDFE

SEQ ID NO: 47382 - protein, 25 aa, synthetic construct
  source 1..25: note = Seed: QTVHSIPLTINKEEALQRPVASDFE
QTVHSIPLTINKEWALIRNVAHDFE

SEQ ID NO: 47383 - protein, 25 aa, synthetic construct
  source 1..25: note = Seed: QTVHSIPLTINKEEALQRPVASDFE
QTVHSIPLTINKEWALIRNVAIDFE

SEQ ID NO: 47384 - protein, 25 aa, synthetic construct
  source 1..25: note = Seed: QTVHSIPLTINKEEALQRPVASDFE
QTVHSIPLTINKEWALIRNVALDFE

SEQ ID NO: 47385 - protein, 25 aa, synthetic construct
  source 1..25: note = Seed: QTVHSIPLTINKEEALQRPVASDFE
QTVHSIPLTINKEWALIRNVAMDFE

SEQ ID NO: 47386 - protein, 25 aa, synthetic construct
  source 1..25: note = Seed: QTVHSIPLTINKEEALQRPVASDFE
QTVHSIPLTINKEWALIRNVANDFE

SEQ ID NO: 47387 - protein, 25 aa, synthetic construct
  source 1..25: note = Seed: QTVHSIPLTINKEEALQRPVASDFE
QTVHSIPLTINKEWALIRNVASDFE

SEQ ID NO: 47388 - protein, 25 aa, synthetic construct
  source 1..25: note = Seed: QTVHSIPLTINKEEALQRPVASDFE
QTVHSIPLTINKEWALIRNVATDFE

SEQ ID NO: 47389 - protein, 25 aa, synthetic construct
  source 1..25: note = Seed: QTVHSIPLTINKEEALQRPVASDFE
QTVHSIPLTINKEWALIRNVAVDFE

SEQ ID NO: 47390 - protein, 25 aa, synthetic construct
  source 1..25: note = Seed: QTVHSIPLTINKEEALQRPVASDFE
QTVHSIPLTINKEWALIRPVAADFE

SEQ ID NO: 47391 - protein, 25 aa, synthetic construct
  source 1..25: note = Seed: QTVHSIPLTINKEEALQRPVASDFE
QTVHSIPLTINKEWALIRPVADDFE

SEQ ID NO: 47392 - protein, 25 aa, synthetic construct
  source 1..25: note = Seed: QTVHSIPLTINKEEALQRPVASDFE
QTVHSIPLTINKEWALIRPVAGDFE

SEQ ID NO: 47393 - protein, 25 aa, synthetic construct
  source 1..25: note = Seed: QTVHSIPLTINKEEALQRPVASDFE
QTVHSIPLTINKEWALIRPVAHDFE

SEQ ID NO: 47394 - protein, 25 aa, synthetic construct
  source 1..25: note = Seed: QTVHSIPLTINKEEALQRPVASDFE
QTVHSIPLTINKEWALIRPVAIDFE

SEQ ID NO: 47395 - protein, 25 aa, synthetic construct
  source 1..25: note = Seed: QTVHSIPLTINKEEALQRPVASDFE
QTVHSIPLTINKEWALIRPVALDFE

SEQ ID NO: 47396 - protein, 25 aa, synthetic construct
  source 1..25: note = Seed: QTVHSIPLTINKEEALQRPVASDFE
QTVHSIPLTINKEWALIRPVAMDFE

SEQ ID NO: 47397 - protein, 25 aa, synthetic construct
  source 1..25: note = Seed: QTVHSIPLTINKEEALQRPVASDFE
QTVHSIPLTINKEWALIRPVANDFE

SEQ ID NO: 47398 - protein, 25 aa, synthetic construct
  source 1..25: note = Seed: QTVHSIPLTINKEEALQRPVASDFE
QTVHSIPLTINKEWALIRPVAPDFE

SEQ ID NO: 47399 - protein, 25 aa, synthetic construct
  source 1..25: note = Seed: QTVHSIPLTINKEEALQRPVASDFE
QTVHSIPLTINKEWALIRPVAQDFE

SEQ ID NO: 47400 - protein, 25 aa, synthetic construct
  source 1..25: note = Seed: QTVHSIPLTINKEEALQRPVASDFE
QTVHSIPLTINKEWALIRPVASDFE

SEQ ID NO: 47401 - protein, 25 aa, synthetic construct
  source 1..25: note = Seed: QTVHSIPLTINKEEALQRPVASDFE
QTVHSIPLTINKEWALIRPVATDFE

SEQ ID NO: 47402 - protein, 25 aa, synthetic construct
  source 1..25: note = Seed: QTVHSIPLTINKEEALQRPVASDFE
QTVHSIPLTINKEWALIRPVAVDFE

SEQ ID NO: 47403 - protein, 25 aa, synthetic construct
  source 1..25: note = Seed: QTVHSIPLTINKEEALQRPVASDFE
QTVHSIPLTINKEWALIRSVAADFE

SEQ ID NO: 47404 - protein, 25 aa, synthetic construct
  source 1..25: note = Seed: QTVHSIPLTINKEEALQRPVASDFE
QTVHSIPLTINKEWALIRSVAGDFE

SEQ ID NO: 47405 - protein, 25 aa, synthetic construct
  source 1..25: note = Seed: QTVHSIPLTINKEEALQRPVASDFE
QTVHSIPLTINKEWALIRSVAHDFE

SEQ ID NO: 47406 - protein, 25 aa, synthetic construct
  source 1..25: note = Seed: QTVHSIPLTINKEEALQRPVASDFE
QTVHSIPLTINKEWALIRSVAIDFE

SEQ ID NO: 47407 - protein, 25 aa, synthetic construct
  source 1..25: note = Seed: QTVHSIPLTINKEEALQRPVASDFE
QTVHSIPLTINKEWALIRSVALDFE

SEQ ID NO: 47408 - protein, 25 aa, synthetic construct
  source 1..25: note = Seed: QTVHSIPLTINKEEALQRPVASDFE
QTVHSIPLTINKEWALIRSVAMDFE

SEQ ID NO: 47409 - protein, 25 aa, synthetic construct
  source 1..25: note = Seed: QTVHSIPLTINKEEALQRPVASDFE
QTVHSIPLTINKEWALIRSVANDFE

SEQ ID NO: 47410 - protein, 25 aa, synthetic construct
  source 1..25: note = Seed: QTVHSIPLTINKEEALQRPVASDFE
QTVHSIPLTINKEWALIRSVAQDFE

SEQ ID NO: 47411 - protein, 25 aa, synthetic construct
  source 1..25: note = Seed: QTVHSIPLTINKEEALQRPVASDFE
QTVHSIPLTINKEWALIRSVASDFE

SEQ ID NO: 47412 - protein, 25 aa, synthetic construct
  source 1..25: note = Seed: QTVHSIPLTINKEEALQRPVASDFE
QTVHSIPLTINKEWALIRSVATDFE

SEQ ID NO: 47413 - protein, 25 aa, synthetic construct
  source 1..25: note = Seed: QTVHSIPLTINKEEALQRPVASDFE
QTVHSIPLTINKEWALIRSVAVDFE

SEQ ID NO: 47414 - protein, 25 aa, synthetic construct
  source 1..25: note = Seed: QTVHSIPLTINKEEALQRPVASDFE
QTVHSIPLTINKEWALIRTVAADFE

SEQ ID NO: 47415 - protein, 25 aa, synthetic construct
  source 1..25: note = Seed: QTVHSIPLTINKEEALQRPVASDFE
QTVHSIPLTINKEWALIRTVAGDFE

SEQ ID NO: 47416 - protein, 25 aa, synthetic construct
  source 1..25: note = Seed: QTVHSIPLTINKEEALQRPVASDFE
QTVHSIPLTINKEWALIRTVAHDFE

SEQ ID NO: 47417 - protein, 25 aa, synthetic construct
  source 1..25: note = Seed: QTVHSIPLTINKEEALQRPVASDFE
QTVHSIPLTINKEWALIRTVAIDFE

SEQ ID NO: 47418 - protein, 25 aa, synthetic construct
  source 1..25: note = Seed: QTVHSIPLTINKEEALQRPVASDFE
QTVHSIPLTINKEWALIRTVALDFE

SEQ ID NO: 47419 - protein, 25 aa, synthetic construct
  source 1..25: note = Seed: QTVHSIPLTINKEEALQRPVASDFE
QTVHSIPLTINKEWALIRTVAMDFE

SEQ ID NO: 47420 - protein, 25 aa, synthetic construct
  source 1..25: note = Seed: QTVHSIPLTINKEEALQRPVASDFE
QTVHSIPLTINKEWALIRTVANDFE

SEQ ID NO: 47421 - protein, 25 aa, synthetic construct
  source 1..25: note = Seed: QTVHSIPLTINKEEALQRPVASDFE
QTVHSIPLTINKEWALIRTVAQDFE

SEQ ID NO: 47422 - protein, 25 aa, synthetic construct
  source 1..25: note = Seed: QTVHSIPLTINKEEALQRPVASDFE
QTVHSIPLTINKEWALIRTVASDFE

SEQ ID NO: 47423 - protein, 25 aa, synthetic construct
  source 1..25: note = Seed: QTVHSIPLTINKEEALQRPVASDFE
QTVHSIPLTINKEWALIRTVATDFE

SEQ ID NO: 47424 - protein, 25 aa, synthetic construct
  source 1..25: note = Seed: QTVHSIPLTINKEEALQRPVASDFE
QTVHSIPLTINKEWALIRTVAVDFE

SEQ ID NO: 47425 - protein, 25 aa, synthetic construct
  source 1..25: note = Seed: QTVHSIPLTINKEEALQRPVASDFE
QTVHSIPLTINKEWALIRVVAADFE

SEQ ID NO: 47426 - protein, 25 aa, synthetic construct
  source 1..25: note = Seed: QTVHSIPLTINKEEALQRPVASDFE
QTVHSIPLTINKEWALIRVVAHDFE

SEQ ID NO: 47427 - protein, 25 aa, synthetic construct
  source 1..25: note = Seed: QTVHSIPLTINKEEALQRPVASDFE
QTVHSIPLTINKEWALIRVVANDFE

SEQ ID NO: 47428 - protein, 25 aa, synthetic construct
  source 1..25: note = Seed: QTVHSIPLTINKEEALQRPVASDFE
QTVHSIPLTINKEWALIRVVASDFE

SEQ ID NO: 47429 - protein, 25 aa, synthetic construct
  source 1..25: note = Seed: QTVHSIPLTINKEEALQRPVASDFE
QTVHSIPLTINKEWALIRVVATDFE

SEQ ID NO: 47430 - protein, 25 aa, synthetic construct
  source 1..25: note = Seed: QTVHSIPLTINKEEALQRPVASDFE
QTVHSIPLTINKEWALLRAVAADFE

SEQ ID NO: 47431 - protein, 25 aa, synthetic construct
  source 1..25: note = Seed: QTVHSIPLTINKEEALQRPVASDFE
QTVHSIPLTINKEWALLRAVADDFE

SEQ ID NO: 47432 - protein, 25 aa, synthetic construct
  source 1..25: note = Seed: QTVHSIPLTINKEEALQRPVASDFE
QTVHSIPLTINKEWALLRAVAEDFE

SEQ ID NO: 47433 - protein, 25 aa, synthetic construct
  source 1..25: note = Seed: QTVHSIPLTINKEEALQRPVASDFE
QTVHSIPLTINKEWALLRAVAGDFE

SEQ ID NO: 47434 - protein, 25 aa, synthetic construct
  source 1..25: note = Seed: QTVHSIPLTINKEEALQRPVASDFE
QTVHSIPLTINKEWALLRAVAHDFE

SEQ ID NO: 47435 - protein, 25 aa, synthetic construct
  source 1..25: note = Seed: QTVHSIPLTINKEEALQRPVASDFE
QTVHSIPLTINKEWALLRAVAIDFE

SEQ ID NO: 47436 - protein, 25 aa, synthetic construct
  source 1..25: note = Seed: QTVHSIPLTINKEEALQRPVASDFE
QTVHSIPLTINKEWALLRAVALDFE

SEQ ID NO: 47437 - protein, 25 aa, synthetic construct
  source 1..25: note = Seed: QTVHSIPLTINKEEALQRPVASDFE
QTVHSIPLTINKEWALLRAVAMDFE

SEQ ID NO: 47438 - protein, 25 aa, synthetic construct
  source 1..25: note = Seed: QTVHSIPLTINKEEALQRPVASDFE
QTVHSIPLTINKEWALLRAVANDFE

SEQ ID NO: 47439 - protein, 25 aa, synthetic construct
  source 1..25: note = Seed: QTVHSIPLTINKEEALQRPVASDFE
QTVHSIPLTINKEWALLRAVAPDFE

SEQ ID NO: 47440 - protein, 25 aa, synthetic construct
  source 1..25: note = Seed: QTVHSIPLTINKEEALQRPVASDFE
QTVHSIPLTINKEWALLRAVAQDFE

SEQ ID NO: 47441 - protein, 25 aa, synthetic construct
  source 1..25: note = Seed: QTVHSIPLTINKEEALQRPVASDFE
QTVHSIPLTINKEWALLRAVASDFE

SEQ ID NO: 47442 - protein, 25 aa, synthetic construct
  source 1..25: note = Seed: QTVHSIPLTINKEEALQRPVASDFE
QTVHSIPLTINKEWALLRAVATDFE

SEQ ID NO: 47443 - protein, 25 aa, synthetic construct
  source 1..25: note = Seed: QTVHSIPLTINKEEALQRPVASDFE
QTVHSIPLTINKEWALLRAVAVDFE

SEQ ID NO: 47444 - protein, 25 aa, synthetic construct
  source 1..25: note = Seed: QTVHSIPLTINKEEALQRPVASDFE
QTVHSIPLTINKEWALLRGVAADFE

SEQ ID NO: 47445 - protein, 25 aa, synthetic construct
  source 1..25: note = Seed: QTVHSIPLTINKEEALQRPVASDFE
QTVHSIPLTINKEWALLRGVAGDFE

SEQ ID NO: 47446 - protein, 25 aa, synthetic construct
  source 1..25: note = Seed: QTVHSIPLTINKEEALQRPVASDFE
QTVHSIPLTINKEWALLRGVAHDFE

SEQ ID NO: 47447 - protein, 25 aa, synthetic construct
  source 1..25: note = Seed: QTVHSIPLTINKEEALQRPVASDFE
QTVHSIPLTINKEWALLRGVAIDFE

SEQ ID NO: 47448 - protein, 25 aa, synthetic construct
  source 1..25: note = Seed: QTVHSIPLTINKEEALQRPVASDFE
QTVHSIPLTINKEWALLRGVAMDFE

SEQ ID NO: 47449 - protein, 25 aa, synthetic construct
  source 1..25: note = Seed: QTVHSIPLTINKEEALQRPVASDFE
QTVHSIPLTINKEWALLRGVANDFE

SEQ ID NO: 47450 - protein, 25 aa, synthetic construct
  source 1..25: note = Seed: QTVHSIPLTINKEEALQRPVASDFE
QTVHSIPLTINKEWALLRGVAQDFE

SEQ ID NO: 47451 - protein, 25 aa, synthetic construct
  source 1..25: note = Seed: QTVHSIPLTINKEEALQRPVASDFE
QTVHSIPLTINKEWALLRGVASDFE

SEQ ID NO: 47452 - protein, 25 aa, synthetic construct
  source 1..25: note = Seed: QTVHSIPLTINKEEALQRPVASDFE
QTVHSIPLTINKEWALLRGVATDFE

SEQ ID NO: 47453 - protein, 25 aa, synthetic construct
  source 1..25: note = Seed: QTVHSIPLTINKEEALQRPVASDFE
QTVHSIPLTINKEWALLRGVAVDFE

SEQ ID NO: 47454 - protein, 25 aa, synthetic construct
  source 1..25: note = Seed: QTVHSIPLTINKEEALQRPVASDFE
QTVHSIPLTINKEWALLRIVAHDFE

SEQ ID NO: 47455 - protein, 25 aa, synthetic construct
  source 1..25: note = Seed: QTVHSIPLTINKEEALQRPVASDFE
QTVHSIPLTINKEWALLRIVANDFE

SEQ ID NO: 47456 - protein, 25 aa, synthetic construct
  source 1..25: note = Seed: QTVHSIPLTINKEEALQRPVASDFE
QTVHSIPLTINKEWALLRIVASDFE

SEQ ID NO: 47457 - protein, 25 aa, synthetic construct
  source 1..25: note = Seed: QTVHSIPLTINKEEALQRPVASDFE
QTVHSIPLTINKEWALLRNVAADFE

SEQ ID NO: 47458 - protein, 25 aa, synthetic construct
  source 1..25: note = Seed: QTVHSIPLTINKEEALQRPVASDFE
QTVHSIPLTINKEWALLRNVAGDFE

SEQ ID NO: 47459 - protein, 25 aa, synthetic construct
  source 1..25: note = Seed: QTVHSIPLTINKEEALQRPVASDFE
QTVHSIPLTINKEWALLRNVAHDFE

SEQ ID NO: 47460 - protein, 25 aa, synthetic construct
  source 1..25: note = Seed: QTVHSIPLTINKEEALQRPVASDFE
QTVHSIPLTINKEWALLRNVAIDFE

SEQ ID NO: 47461 - protein, 25 aa, synthetic construct
  source 1..25: note = Seed: QTVHSIPLTINKEEALQRPVASDFE
QTVHSIPLTINKEWALLRNVALDFE

SEQ ID NO: 47462 - protein, 25 aa, synthetic construct
  source 1..25: note = Seed: QTVHSIPLTINKEEALQRPVASDFE
QTVHSIPLTINKEWALLRNVAMDFE

SEQ ID NO: 47463 - protein, 25 aa, synthetic construct
  source 1..25: note = Seed: QTVHSIPLTINKEEALQRPVASDFE
QTVHSIPLTINKEWALLRNVANDFE

SEQ ID NO: 47464 - protein, 25 aa, synthetic construct
  source 1..25: note = Seed: QTVHSIPLTINKEEALQRPVASDFE
QTVHSIPLTINKEWALLRNVAQDFE

SEQ ID NO: 47465 - protein, 25 aa, synthetic construct
  source 1..25: note = Seed: QTVHSIPLTINKEEALQRPVASDFE
QTVHSIPLTINKEWALLRNVASDFE

SEQ ID NO: 47466 - protein, 25 aa, synthetic construct
  source 1..25: note = Seed: QTVHSIPLTINKEEALQRPVASDFE
QTVHSIPLTINKEWALLRNVATDFE

SEQ ID NO: 47467 - protein, 25 aa, synthetic construct
  source 1..25: note = Seed: QTVHSIPLTINKEEALQRPVASDFE
QTVHSIPLTINKEWALLRNVAVDFE

SEQ ID NO: 47468 - protein, 25 aa, synthetic construct
  source 1..25: note = Seed: QTVHSIPLTINKEEALQRPVASDFE
QTVHSIPLTINKEWALLRPVAADFE

SEQ ID NO: 47469 - protein, 25 aa, synthetic construct
  source 1..25: note = Seed: QTVHSIPLTINKEEALQRPVASDFE
QTVHSIPLTINKEWALLRPVADDFE

SEQ ID NO: 47470 - protein, 25 aa, synthetic construct
  source 1..25: note = Seed: QTVHSIPLTINKEEALQRPVASDFE
QTVHSIPLTINKEWALLRPVAEDFE

SEQ ID NO: 47471 - protein, 25 aa, synthetic construct
  source 1..25: note = Seed: QTVHSIPLTINKEEALQRPVASDFE
QTVHSIPLTINKEWALLRPVAGDFE

SEQ ID NO: 47472 - protein, 25 aa, synthetic construct
  source 1..25: note = Seed: QTVHSIPLTINKEEALQRPVASDFE
QTVHSIPLTINKEWALLRPVAHDFE

SEQ ID NO: 47473 - protein, 25 aa, synthetic construct
  source 1..25: note = Seed: QTVHSIPLTINKEEALQRPVASDFE
QTVHSIPLTINKEWALLRPVAIDFE

SEQ ID NO: 47474 - protein, 25 aa, synthetic construct
  source 1..25: note = Seed: QTVHSIPLTINKEEALQRPVASDFE
QTVHSIPLTINKEWALLRPVALDFE

SEQ ID NO: 47475 - protein, 25 aa, synthetic construct
  source 1..25: note = Seed: QTVHSIPLTINKEEALQRPVASDFE
QTVHSIPLTINKEWALLRPVAMDFE

SEQ ID NO: 47476 - protein, 25 aa, synthetic construct
  source 1..25: note = Seed: QTVHSIPLTINKEEALQRPVASDFE
QTVHSIPLTINKEWALLRPVANDFE

SEQ ID NO: 47477 - protein, 25 aa, synthetic construct
  source 1..25: note = Seed: QTVHSIPLTINKEEALQRPVASDFE
QTVHSIPLTINKEWALLRPVAPDFE

SEQ ID NO: 47478 - protein, 25 aa, synthetic construct
  source 1..25: note = Seed: QTVHSIPLTINKEEALQRPVASDFE
QTVHSIPLTINKEWALLRPVAQDFE

SEQ ID NO: 47479 - protein, 25 aa, synthetic construct
  source 1..25: note = Seed: QTVHSIPLTINKEEALQRPVASDFE
QTVHSIPLTINKEWALLRPVASDFE

SEQ ID NO: 47480 - protein, 25 aa, synthetic construct
  source 1..25: note = Seed: QTVHSIPLTINKEEALQRPVASDFE
QTVHSIPLTINKEWALLRPVATDFE

SEQ ID NO: 47481 - protein, 25 aa, synthetic construct
  source 1..25: note = Seed: QTVHSIPLTINKEEALQRPVASDFE
QTVHSIPLTINKEWALLRPVAVDFE

SEQ ID NO: 47482 - protein, 25 aa, synthetic construct
  source 1..25: note = Seed: QTVHSIPLTINKEEALQRPVASDFE
QTVHSIPLTINKEWALLRSVAADFE

SEQ ID NO: 47483 - protein, 25 aa, synthetic construct
  source 1..25: note = Seed: QTVHSIPLTINKEEALQRPVASDFE
QTVHSIPLTINKEWALLRSVADDFE

SEQ ID NO: 47484 - protein, 25 aa, synthetic construct
  source 1..25: note = Seed: QTVHSIPLTINKEEALQRPVASDFE
QTVHSIPLTINKEWALLRSVAEDFE

SEQ ID NO: 47485 - protein, 25 aa, synthetic construct
  source 1..25: note = Seed: QTVHSIPLTINKEEALQRPVASDFE
QTVHSIPLTINKEWALLRSVAGDFE

SEQ ID NO: 47486 - protein, 25 aa, synthetic construct
  source 1..25: note = Seed: QTVHSIPLTINKEEALQRPVASDFE
QTVHSIPLTINKEWALLRSVAHDFE

SEQ ID NO: 47487 - protein, 25 aa, synthetic construct
  source 1..25: note = Seed: QTVHSIPLTINKEEALQRPVASDFE
QTVHSIPLTINKEWALLRSVAIDFE

SEQ ID NO: 47488 - protein, 25 aa, synthetic construct
  source 1..25: note = Seed: QTVHSIPLTINKEEALQRPVASDFE
QTVHSIPLTINKEWALLRSVALDFE

SEQ ID NO: 47489 - protein, 25 aa, synthetic construct
  source 1..25: note = Seed: QTVHSIPLTINKEEALQRPVASDFE
QTVHSIPLTINKEWALLRSVAMDFE

SEQ ID NO: 47490 - protein, 25 aa, synthetic construct
  source 1..25: note = Seed: QTVHSIPLTINKEEALQRPVASDFE
QTVHSIPLTINKEWALLRSVANDFE

SEQ ID NO: 47491 - protein, 25 aa, synthetic construct
  source 1..25: note = Seed: QTVHSIPLTINKEEALQRPVASDFE
QTVHSIPLTINKEWALLRSVAPDFE

SEQ ID NO: 47492 - protein, 25 aa, synthetic construct
  source 1..25: note = Seed: QTVHSIPLTINKEEALQRPVASDFE
QTVHSIPLTINKEWALLRSVAQDFE

SEQ ID NO: 47493 - protein, 25 aa, synthetic construct
  source 1..25: note = Seed: QTVHSIPLTINKEEALQRPVASDFE
QTVHSIPLTINKEWALLRSVASDFE

SEQ ID NO: 47494 - protein, 25 aa, synthetic construct
  source 1..25: note = Seed: QTVHSIPLTINKEEALQRPVASDFE
QTVHSIPLTINKEWALLRSVATDFE

SEQ ID NO: 47495 - protein, 25 aa, synthetic construct
  source 1..25: note = Seed: QTVHSIPLTINKEEALQRPVASDFE
QTVHSIPLTINKEWALLRSVAVDFE

SEQ ID NO: 47496 - protein, 25 aa, synthetic construct
  source 1..25: note = Seed: QTVHSIPLTINKEEALQRPVASDFE
QTVHSIPLTINKEWALLRTVAADFE

SEQ ID NO: 47497 - protein, 25 aa, synthetic construct
  source 1..25: note = Seed: QTVHSIPLTINKEEALQRPVASDFE
QTVHSIPLTINKEWALLRTVADDFE

SEQ ID NO: 47498 - protein, 25 aa, synthetic construct
  source 1..25: note = Seed: QTVHSIPLTINKEEALQRPVASDFE
QTVHSIPLTINKEWALLRTVAEDFE

SEQ ID NO: 47499 - protein, 25 aa, synthetic construct
  source 1..25: note = Seed: QTVHSIPLTINKEEALQRPVASDFE
QTVHSIPLTINKEWALLRTVAGDFE

SEQ ID NO: 47500 - protein, 25 aa, synthetic construct
  source 1..25: note = Seed: QTVHSIPLTINKEEALQRPVASDFE
QTVHSIPLTINKEWALLRTVAHDFE

SEQ ID NO: 47501 - protein, 25 aa, synthetic construct
  source 1..25: note = Seed: QTVHSIPLTINKEEALQRPVASDFE
QTVHSIPLTINKEWALLRTVAIDFE

SEQ ID NO: 47502 - protein, 25 aa, synthetic construct
  source 1..25: note = Seed: QTVHSIPLTINKEEALQRPVASDFE
QTVHSIPLTINKEWALLRTVALDFE

SEQ ID NO: 47503 - protein, 25 aa, synthetic construct
  source 1..25: note = Seed: QTVHSIPLTINKEEALQRPVASDFE
QTVHSIPLTINKEWALLRTVAMDFE

SEQ ID NO: 47504 - protein, 25 aa, synthetic construct
  source 1..25: note = Seed: QTVHSIPLTINKEEALQRPVASDFE
QTVHSIPLTINKEWALLRTVANDFE

SEQ ID NO: 47505 - protein, 25 aa, synthetic construct
  source 1..25: note = Seed: QTVHSIPLTINKEEALQRPVASDFE
QTVHSIPLTINKEWALLRTVAPDFE

SEQ ID NO: 47506 - protein, 25 aa, synthetic construct
  source 1..25: note = Seed: QTVHSIPLTINKEEALQRPVASDFE
QTVHSIPLTINKEWALLRTVAQDFE

SEQ ID NO: 47507 - protein, 25 aa, synthetic construct
  source 1..25: note = Seed: QTVHSIPLTINKEEALQRPVASDFE
QTVHSIPLTINKEWALLRTVASDFE

SEQ ID NO: 47508 - protein, 25 aa, synthetic construct
  source 1..25: note = Seed: QTVHSIPLTINKEEALQRPVASDFE
QTVHSIPLTINKEWALLRTVATDFE

SEQ ID NO: 47509 - protein, 25 aa, synthetic construct
  source 1..25: note = Seed: QTVHSIPLTINKEEALQRPVASDFE
QTVHSIPLTINKEWALLRTVAVDFE

SEQ ID NO: 47510 - protein, 25 aa, synthetic construct
  source 1..25: note = Seed: QTVHSIPLTINKEEALQRPVASDFE
QTVHSIPLTINKEWALLRVVAADFE

SEQ ID NO: 47511 - protein, 25 aa, synthetic construct
  source 1..25: note = Seed: QTVHSIPLTINKEEALQRPVASDFE
QTVHSIPLTINKEWALLRVVAGDFE

SEQ ID NO: 47512 - protein, 25 aa, synthetic construct
  source 1..25: note = Seed: QTVHSIPLTINKEEALQRPVASDFE
QTVHSIPLTINKEWALLRVVAHDFE

SEQ ID NO: 47513 - protein, 25 aa, synthetic construct
  source 1..25: note = Seed: QTVHSIPLTINKEEALQRPVASDFE
QTVHSIPLTINKEWALLRVVANDFE

SEQ ID NO: 47514 - protein, 25 aa, synthetic construct
  source 1..25: note = Seed: QTVHSIPLTINKEEALQRPVASDFE
QTVHSIPLTINKEWALLRVVASDFE

SEQ ID NO: 47515 - protein, 25 aa, synthetic construct
  source 1..25: note = Seed: QTVHSIPLTINKEEALQRPVASDFE
QTVHSIPLTINKEWALLRVVATDFE

SEQ ID NO: 47516 - protein, 25 aa, synthetic construct
  source 1..25: note = Seed: QTVHSIPLTINKEEALQRPVASDFE
QTVHSIPLTINKEWALMRAVAADFE

SEQ ID NO: 47517 - protein, 25 aa, synthetic construct
  source 1..25: note = Seed: QTVHSIPLTINKEEALQRPVASDFE
QTVHSIPLTINKEWALMRAVADDFE

SEQ ID NO: 47518 - protein, 25 aa, synthetic construct
  source 1..25: note = Seed: QTVHSIPLTINKEEALQRPVASDFE
QTVHSIPLTINKEWALMRAVAEDFE

SEQ ID NO: 47519 - protein, 25 aa, synthetic construct
  source 1..25: note = Seed: QTVHSIPLTINKEEALQRPVASDFE
QTVHSIPLTINKEWALMRAVAGDFE

SEQ ID NO: 47520 - protein, 25 aa, synthetic construct
  source 1..25: note = Seed: QTVHSIPLTINKEEALQRPVASDFE
QTVHSIPLTINKEWALMRAVAHDFE

SEQ ID NO: 47521 - protein, 25 aa, synthetic construct
  source 1..25: note = Seed: QTVHSIPLTINKEEALQRPVASDFE
QTVHSIPLTINKEWALMRAVAIDFE

SEQ ID NO: 47522 - protein, 25 aa, synthetic construct
  source 1..25: note = Seed: QTVHSIPLTINKEEALQRPVASDFE
QTVHSIPLTINKEWALMRAVAKDFE

SEQ ID NO: 47523 - protein, 25 aa, synthetic construct
  source 1..25: note = Seed: QTVHSIPLTINKEEALQRPVASDFE
QTVHSIPLTINKEWALMRAVALDFE

SEQ ID NO: 47524 - protein, 25 aa, synthetic construct
  source 1..25: note = Seed: QTVHSIPLTINKEEALQRPVASDFE
QTVHSIPLTINKEWALMRAVAMDFE

SEQ ID NO: 47525 - protein, 25 aa, synthetic construct
  source 1..25: note = Seed: QTVHSIPLTINKEEALQRPVASDFE
QTVHSIPLTINKEWALMRAVANDFE

SEQ ID NO: 47526 - protein, 25 aa, synthetic construct
  source 1..25: note = Seed: QTVHSIPLTINKEEALQRPVASDFE
QTVHSIPLTINKEWALMRAVAPDFE

SEQ ID NO: 47527 - protein, 25 aa, synthetic construct
  source 1..25: note = Seed: QTVHSIPLTINKEEALQRPVASDFE
QTVHSIPLTINKEWALMRAVAQDFE

SEQ ID NO: 47528 - protein, 25 aa, synthetic construct
  source 1..25: note = Seed: QTVHSIPLTINKEEALQRPVASDFE
QTVHSIPLTINKEWALMRAVARDFE

SEQ ID NO: 47529 - protein, 25 aa, synthetic construct
  source 1..25: note = Seed: QTVHSIPLTINKEEALQRPVASDFE
QTVHSIPLTINKEWALMRAVASDFE

SEQ ID NO: 47530 - protein, 25 aa, synthetic construct
  source 1..25: note = Seed: QTVHSIPLTINKEEALQRPVASDFE
QTVHSIPLTINKEWALMRAVATDFE

SEQ ID NO: 47531 - protein, 25 aa, synthetic construct
  source 1..25: note = Seed: QTVHSIPLTINKEEALQRPVASDFE
QTVHSIPLTINKEWALMRAVAVDFE

SEQ ID NO: 47532 - protein, 25 aa, synthetic construct
  source 1..25: note = Seed: QTVHSIPLTINKEEALQRPVASDFE
QTVHSIPLTINKEWALMRGVAADFE

SEQ ID NO: 47533 - protein, 25 aa, synthetic construct
  source 1..25: note = Seed: QTVHSIPLTINKEEALQRPVASDFE
QTVHSIPLTINKEWALMRGVADDFE

SEQ ID NO: 47534 - protein, 25 aa, synthetic construct
  source 1..25: note = Seed: QTVHSIPLTINKEEALQRPVASDFE
QTVHSIPLTINKEWALMRGVAGDFE

SEQ ID NO: 47535 - protein, 25 aa, synthetic construct
  source 1..25: note = Seed: QTVHSIPLTINKEEALQRPVASDFE
QTVHSIPLTINKEWALMRGVAHDFE

SEQ ID NO: 47536 - protein, 25 aa, synthetic construct
  source 1..25: note = Seed: QTVHSIPLTINKEEALQRPVASDFE
QTVHSIPLTINKEWALMRGVAIDFE

SEQ ID NO: 47537 - protein, 25 aa, synthetic construct
  source 1..25: note = Seed: QTVHSIPLTINKEEALQRPVASDFE
QTVHSIPLTINKEWALMRGVALDFE

SEQ ID NO: 47538 - protein, 25 aa, synthetic construct
  source 1..25: note = Seed: QTVHSIPLTINKEEALQRPVASDFE
QTVHSIPLTINKEWALMRGVAMDFE

SEQ ID NO: 47539 - protein, 25 aa, synthetic construct
  source 1..25: note = Seed: QTVHSIPLTINKEEALQRPVASDFE
QTVHSIPLTINKEWALMRGVANDFE

SEQ ID NO: 47540 - protein, 25 aa, synthetic construct
  source 1..25: note = Seed: QTVHSIPLTINKEEALQRPVASDFE
QTVHSIPLTINKEWALMRGVAQDFE

SEQ ID NO: 47541 - protein, 25 aa, synthetic construct
  source 1..25: note = Seed: QTVHSIPLTINKEEALQRPVASDFE
QTVHSIPLTINKEWALMRGVASDFE

SEQ ID NO: 47542 - protein, 25 aa, synthetic construct
  source 1..25: note = Seed: QTVHSIPLTINKEEALQRPVASDFE
QTVHSIPLTINKEWALMRGVATDFE

SEQ ID NO: 47543 - protein, 25 aa, synthetic construct
  source 1..25: note = Seed: QTVHSIPLTINKEEALQRPVASDFE
QTVHSIPLTINKEWALMRGVAVDFE

SEQ ID NO: 47544 - protein, 25 aa, synthetic construct
  source 1..25: note = Seed: QTVHSIPLTINKEEALQRPVASDFE
QTVHSIPLTINKEWALMRHVAADFE

SEQ ID NO: 47545 - protein, 25 aa, synthetic construct
  source 1..25: note = Seed: QTVHSIPLTINKEEALQRPVASDFE
QTVHSIPLTINKEWALMRHVANDFE

SEQ ID NO: 47546 - protein, 25 aa, synthetic construct
  source 1..25: note = Seed: QTVHSIPLTINKEEALQRPVASDFE
QTVHSIPLTINKEWALMRHVASDFE

SEQ ID NO: 47547 - protein, 25 aa, synthetic construct
  source 1..25: note = Seed: QTVHSIPLTINKEEALQRPVASDFE
QTVHSIPLTINKEWALMRIVAADFE

SEQ ID NO: 47548 - protein, 25 aa, synthetic construct
  source 1..25: note = Seed: QTVHSIPLTINKEEALQRPVASDFE
QTVHSIPLTINKEWALMRIVAHDFE

SEQ ID NO: 47549 - protein, 25 aa, synthetic construct
  source 1..25: note = Seed: QTVHSIPLTINKEEALQRPVASDFE
QTVHSIPLTINKEWALMRIVANDFE

SEQ ID NO: 47550 - protein, 25 aa, synthetic construct
  source 1..25: note = Seed: QTVHSIPLTINKEEALQRPVASDFE
QTVHSIPLTINKEWALMRIVASDFE

SEQ ID NO: 47551 - protein, 25 aa, synthetic construct
  source 1..25: note = Seed: QTVHSIPLTINKEEALQRPVASDFE
QTVHSIPLTINKEWALMRIVATDFE

SEQ ID NO: 47552 - protein, 25 aa, synthetic construct
  source 1..25: note = Seed: QTVHSIPLTINKEEALQRPVASDFE
QTVHSIPLTINKEWALMRLVANDFE

SEQ ID NO: 47553 - protein, 25 aa, synthetic construct
  source 1..25: note = Seed: QTVHSIPLTINKEEALQRPVASDFE
QTVHSIPLTINKEWALMRMVANDFE

SEQ ID NO: 47554 - protein, 25 aa, synthetic construct
  source 1..25: note = Seed: QTVHSIPLTINKEEALQRPVASDFE
QTVHSIPLTINKEWALMRNVAADFE

SEQ ID NO: 47555 - protein, 25 aa, synthetic construct
  source 1..25: note = Seed: QTVHSIPLTINKEEALQRPVASDFE
QTVHSIPLTINKEWALMRNVADDFE

SEQ ID NO: 47556 - protein, 25 aa, synthetic construct
  source 1..25: note = Seed: QTVHSIPLTINKEEALQRPVASDFE
QTVHSIPLTINKEWALMRNVAGDFE

SEQ ID NO: 47557 - protein, 25 aa, synthetic construct
  source 1..25: note = Seed: QTVHSIPLTINKEEALQRPVASDFE
QTVHSIPLTINKEWALMRNVAHDFE

SEQ ID NO: 47558 - protein, 25 aa, synthetic construct
  source 1..25: note = Seed: QTVHSIPLTINKEEALQRPVASDFE
QTVHSIPLTINKEWALMRNVAIDFE

SEQ ID NO: 47559 - protein, 25 aa, synthetic construct
  source 1..25: note = Seed: QTVHSIPLTINKEEALQRPVASDFE
QTVHSIPLTINKEWALMRNVALDFE

SEQ ID NO: 47560 - protein, 25 aa, synthetic construct
  source 1..25: note = Seed: QTVHSIPLTINKEEALQRPVASDFE
QTVHSIPLTINKEWALMRNVAMDFE

SEQ ID NO: 47561 - protein, 25 aa, synthetic construct
  source 1..25: note = Seed: QTVHSIPLTINKEEALQRPVASDFE
QTVHSIPLTINKEWALMRNVANDFE

SEQ ID NO: 47562 - protein, 25 aa, synthetic construct
  source 1..25: note = Seed: QTVHSIPLTINKEEALQRPVASDFE
QTVHSIPLTINKEWALMRNVAPDFE

SEQ ID NO: 47563 - protein, 25 aa, synthetic construct
  source 1..25: note = Seed: QTVHSIPLTINKEEALQRPVASDFE
QTVHSIPLTINKEWALMRNVAQDFE

SEQ ID NO: 47564 - protein, 25 aa, synthetic construct
  source 1..25: note = Seed: QTVHSIPLTINKEEALQRPVASDFE
QTVHSIPLTINKEWALMRNVASDFE

SEQ ID NO: 47565 - protein, 25 aa, synthetic construct
  source 1..25: note = Seed: QTVHSIPLTINKEEALQRPVASDFE
QTVHSIPLTINKEWALMRNVATDFE

SEQ ID NO: 47566 - protein, 25 aa, synthetic construct
  source 1..25: note = Seed: QTVHSIPLTINKEEALQRPVASDFE
QTVHSIPLTINKEWALMRNVAVDFE

SEQ ID NO: 47567 - protein, 25 aa, synthetic construct
  source 1..25: note = Seed: QTVHSIPLTINKEEALQRPVASDFE
QTVHSIPLTINKEWALMRPVAADFE

SEQ ID NO: 47568 - protein, 25 aa, synthetic construct
  source 1..25: note = Seed: QTVHSIPLTINKEEALQRPVASDFE
QTVHSIPLTINKEWALMRPVACDFE

SEQ ID NO: 47569 - protein, 25 aa, synthetic construct
  source 1..25: note = Seed: QTVHSIPLTINKEEALQRPVASDFE
QTVHSIPLTINKEWALMRPVADDFE

SEQ ID NO: 47570 - protein, 25 aa, synthetic construct
  source 1..25: note = Seed: QTVHSIPLTINKEEALQRPVASDFE
QTVHSIPLTINKEWALMRPVAEDFE

SEQ ID NO: 47571 - protein, 25 aa, synthetic construct
  source 1..25: note = Seed: QTVHSIPLTINKEEALQRPVASDFE
QTVHSIPLTINKEWALMRPVAGDFE

SEQ ID NO: 47572 - protein, 25 aa, synthetic construct
  source 1..25: note = Seed: QTVHSIPLTINKEEALQRPVASDFE
QTVHSIPLTINKEWALMRPVAHDFE

SEQ ID NO: 47573 - protein, 25 aa, synthetic construct
  source 1..25: note = Seed: QTVHSIPLTINKEEALQRPVASDFE
QTVHSIPLTINKEWALMRPVAIDFE

SEQ ID NO: 47574 - protein, 25 aa, synthetic construct
  source 1..25: note = Seed: QTVHSIPLTINKEEALQRPVASDFE
QTVHSIPLTINKEWALMRPVALDFE

SEQ ID NO: 47575 - protein, 25 aa, synthetic construct
  source 1..25: note = Seed: QTVHSIPLTINKEEALQRPVASDFE
QTVHSIPLTINKEWALMRPVAMDFE

SEQ ID NO: 47576 - protein, 25 aa, synthetic construct
  source 1..25: note = Seed: QTVHSIPLTINKEEALQRPVASDFE
QTVHSIPLTINKEWALMRPVANDFE

SEQ ID NO: 47577 - protein, 25 aa, synthetic construct
  source 1..25: note = Seed: QTVHSIPLTINKEEALQRPVASDFE
QTVHSIPLTINKEWALMRPVAPDFE

SEQ ID NO: 47578 - protein, 25 aa, synthetic construct
  source 1..25: note = Seed: QTVHSIPLTINKEEALQRPVASDFE
QTVHSIPLTINKEWALMRPVAQDFE

SEQ ID NO: 47579 - protein, 25 aa, synthetic construct
  source 1..25: note = Seed: QTVHSIPLTINKEEALQRPVASDFE
QTVHSIPLTINKEWALMRPVASDFE

SEQ ID NO: 47580 - protein, 25 aa, synthetic construct
  source 1..25: note = Seed: QTVHSIPLTINKEEALQRPVASDFE
QTVHSIPLTINKEWALMRPVATDFE

SEQ ID NO: 47581 - protein, 25 aa, synthetic construct
  source 1..25: note = Seed: QTVHSIPLTINKEEALQRPVASDFE
QTVHSIPLTINKEWALMRPVAVDFE

SEQ ID NO: 47582 - protein, 25 aa, synthetic construct
  source 1..25: note = Seed: QTVHSIPLTINKEEALQRPVASDFE
QTVHSIPLTINKEWALMRSVAADFE

SEQ ID NO: 47583 - protein, 25 aa, synthetic construct
  source 1..25: note = Seed: QTVHSIPLTINKEEALQRPVASDFE
QTVHSIPLTINKEWALMRSVADDFE

SEQ ID NO: 47584 - protein, 25 aa, synthetic construct
  source 1..25: note = Seed: QTVHSIPLTINKEEALQRPVASDFE
QTVHSIPLTINKEWALMRSVAEDFE

SEQ ID NO: 47585 - protein, 25 aa, synthetic construct
  source 1..25: note = Seed: QTVHSIPLTINKEEALQRPVASDFE
QTVHSIPLTINKEWALMRSVAGDFE

SEQ ID NO: 47586 - protein, 25 aa, synthetic construct
  source 1..25: note = Seed: QTVHSIPLTINKEEALQRPVASDFE
QTVHSIPLTINKEWALMRSVAHDFE

SEQ ID NO: 47587 - protein, 25 aa, synthetic construct
  source 1..25: note = Seed: QTVHSIPLTINKEEALQRPVASDFE
QTVHSIPLTINKEWALMRSVAIDFE

SEQ ID NO: 47588 - protein, 25 aa, synthetic construct
  source 1..25: note = Seed: QTVHSIPLTINKEEALQRPVASDFE
QTVHSIPLTINKEWALMRSVAKDFE

SEQ ID NO: 47589 - protein, 25 aa, synthetic construct
  source 1..25: note = Seed: QTVHSIPLTINKEEALQRPVASDFE
QTVHSIPLTINKEWALMRSVALDFE

SEQ ID NO: 47590 - protein, 25 aa, synthetic construct
  source 1..25: note = Seed: QTVHSIPLTINKEEALQRPVASDFE
QTVHSIPLTINKEWALMRSVAMDFE

SEQ ID NO: 47591 - protein, 25 aa, synthetic construct
  source 1..25: note = Seed: QTVHSIPLTINKEEALQRPVASDFE
QTVHSIPLTINKEWALMRSVANDFE

SEQ ID NO: 47592 - protein, 25 aa, synthetic construct
  source 1..25: note = Seed: QTVHSIPLTINKEEALQRPVASDFE
QTVHSIPLTINKEWALMRSVAPDFE

SEQ ID NO: 47593 - protein, 25 aa, synthetic construct
  source 1..25: note = Seed: QTVHSIPLTINKEEALQRPVASDFE
QTVHSIPLTINKEWALMRSVAQDFE

SEQ ID NO: 47594 - protein, 25 aa, synthetic construct
  source 1..25: note = Seed: QTVHSIPLTINKEEALQRPVASDFE
QTVHSIPLTINKEWALMRSVASDFE

SEQ ID NO: 47595 - protein, 25 aa, synthetic construct
  source 1..25: note = Seed: QTVHSIPLTINKEEALQRPVASDFE
QTVHSIPLTINKEWALMRSVATDFE

SEQ ID NO: 47596 - protein, 25 aa, synthetic construct
  source 1..25: note = Seed: QTVHSIPLTINKEEALQRPVASDFE
QTVHSIPLTINKEWALMRSVAVDFE

SEQ ID NO: 47597 - protein, 25 aa, synthetic construct
  source 1..25: note = Seed: QTVHSIPLTINKEEALQRPVASDFE
QTVHSIPLTINKEWALMRTVAADFE

SEQ ID NO: 47598 - protein, 25 aa, synthetic construct
  source 1..25: note = Seed: QTVHSIPLTINKEEALQRPVASDFE
QTVHSIPLTINKEWALMRTVADDFE

SEQ ID NO: 47599 - protein, 25 aa, synthetic construct
  source 1..25: note = Seed: QTVHSIPLTINKEEALQRPVASDFE
QTVHSIPLTINKEWALMRTVAEDFE

SEQ ID NO: 47600 - protein, 25 aa, synthetic construct
  source 1..25: note = Seed: QTVHSIPLTINKEEALQRPVASDFE
QTVHSIPLTINKEWALMRTVAGDFE

SEQ ID NO: 47601 - protein, 25 aa, synthetic construct
  source 1..25: note = Seed: QTVHSIPLTINKEEALQRPVASDFE
QTVHSIPLTINKEWALMRTVAHDFE

SEQ ID NO: 47602 - protein, 25 aa, synthetic construct
  source 1..25: note = Seed: QTVHSIPLTINKEEALQRPVASDFE
QTVHSIPLTINKEWALMRTVAIDFE

SEQ ID NO: 47603 - protein, 25 aa, synthetic construct
  source 1..25: note = Seed: QTVHSIPLTINKEEALQRPVASDFE
QTVHSIPLTINKEWALMRTVAKDFE

SEQ ID NO: 47604 - protein, 25 aa, synthetic construct
  source 1..25: note = Seed: QTVHSIPLTINKEEALQRPVASDFE
QTVHSIPLTINKEWALMRTVALDFE

SEQ ID NO: 47605 - protein, 25 aa, synthetic construct
  source 1..25: note = Seed: QTVHSIPLTINKEEALQRPVASDFE
QTVHSIPLTINKEWALMRTVAMDFE

SEQ ID NO: 47606 - protein, 25 aa, synthetic construct
  source 1..25: note = Seed: QTVHSIPLTINKEEALQRPVASDFE
QTVHSIPLTINKEWALMRTVANDFE

SEQ ID NO: 47607 - protein, 25 aa, synthetic construct
  source 1..25: note = Seed: QTVHSIPLTINKEEALQRPVASDFE
QTVHSIPLTINKEWALMRTVAPDFE

SEQ ID NO: 47608 - protein, 25 aa, synthetic construct
  source 1..25: note = Seed: QTVHSIPLTINKEEALQRPVASDFE
QTVHSIPLTINKEWALMRTVAQDFE

SEQ ID NO: 47609 - protein, 25 aa, synthetic construct
  source 1..25: note = Seed: QTVHSIPLTINKEEALQRPVASDFE
QTVHSIPLTINKEWALMRTVASDFE

SEQ ID NO: 47610 - protein, 25 aa, synthetic construct
  source 1..25: note = Seed: QTVHSIPLTINKEEALQRPVASDFE
QTVHSIPLTINKEWALMRTVATDFE

SEQ ID NO: 47611 - protein, 25 aa, synthetic construct
  source 1..25: note = Seed: QTVHSIPLTINKEEALQRPVASDFE
QTVHSIPLTINKEWALMRTVAVDFE

SEQ ID NO: 47612 - protein, 25 aa, synthetic construct
  source 1..25: note = Seed: QTVHSIPLTINKEEALQRPVASDFE
QTVHSIPLTINKEWALMRVVAADFE

SEQ ID NO: 47613 - protein, 25 aa, synthetic construct
  source 1..25: note = Seed: QTVHSIPLTINKEEALQRPVASDFE
QTVHSIPLTINKEWALMRVVADDFE

SEQ ID NO: 47614 - protein, 25 aa, synthetic construct
  source 1..25: note = Seed: QTVHSIPLTINKEEALQRPVASDFE
QTVHSIPLTINKEWALMRVVAEDFE

SEQ ID NO: 47615 - protein, 25 aa, synthetic construct
  source 1..25: note = Seed: QTVHSIPLTINKEEALQRPVASDFE
QTVHSIPLTINKEWALMRVVAGDFE

SEQ ID NO: 47616 - protein, 25 aa, synthetic construct
  source 1..25: note = Seed: QTVHSIPLTINKEEALQRPVASDFE
QTVHSIPLTINKEWALMRVVAHDFE

SEQ ID NO: 47617 - protein, 25 aa, synthetic construct
  source 1..25: note = Seed: QTVHSIPLTINKEEALQRPVASDFE
QTVHSIPLTINKEWALMRVVAKDFE

SEQ ID NO: 47618 - protein, 25 aa, synthetic construct
  source 1..25: note = Seed: QTVHSIPLTINKEEALQRPVASDFE
QTVHSIPLTINKEWALMRVVANDFE

SEQ ID NO: 47619 - protein, 25 aa, synthetic construct
  source 1..25: note = Seed: QTVHSIPLTINKEEALQRPVASDFE
QTVHSIPLTINKEWALMRVVAQDFE

SEQ ID NO: 47620 - protein, 25 aa, synthetic construct
  source 1..25: note = Seed: QTVHSIPLTINKEEALQRPVASDFE
QTVHSIPLTINKEWALMRVVASDFE

SEQ ID NO: 47621 - protein, 25 aa, synthetic construct
  source 1..25: note = Seed: QTVHSIPLTINKEEALQRPVASDFE
QTVHSIPLTINKEWALMRVVATDFE

SEQ ID NO: 47622 - protein, 25 aa, synthetic construct
  source 1..25: note = Seed: QTVHSIPLTINKEEALQRPVASDFE
QTVHSIPLTINKEWALNRAVAADFE

SEQ ID NO: 47623 - protein, 25 aa, synthetic construct
  source 1..25: note = Seed: QTVHSIPLTINKEEALQRPVASDFE
QTVHSIPLTINKEWALNRAVANDFE

SEQ ID NO: 47624 - protein, 25 aa, synthetic construct
  source 1..25: note = Seed: QTVHSIPLTINKEEALQRPVASDFE
QTVHSIPLTINKEWALNRAVASDFE

SEQ ID NO: 47625 - protein, 25 aa, synthetic construct
  source 1..25: note = Seed: QTVHSIPLTINKEEALQRPVASDFE
QTVHSIPLTINKEWALQRAVAADFE

SEQ ID NO: 47626 - protein, 25 aa, synthetic construct
  source 1..25: note = Seed: QTVHSIPLTINKEEALQRPVASDFE
QTVHSIPLTINKEWALQRAVAGDFE

SEQ ID NO: 47627 - protein, 25 aa, synthetic construct
  source 1..25: note = Seed: QTVHSIPLTINKEEALQRPVASDFE
QTVHSIPLTINKEWALQRAVAHDFE

SEQ ID NO: 47628 - protein, 25 aa, synthetic construct
  source 1..25: note = Seed: QTVHSIPLTINKEEALQRPVASDFE
QTVHSIPLTINKEWALQRAVAIDFE

SEQ ID NO: 47629 - protein, 25 aa, synthetic construct
  source 1..25: note = Seed: QTVHSIPLTINKEEALQRPVASDFE
QTVHSIPLTINKEWALQRAVALDFE

SEQ ID NO: 47630 - protein, 25 aa, synthetic construct
  source 1..25: note = Seed: QTVHSIPLTINKEEALQRPVASDFE
QTVHSIPLTINKEWALQRAVAMDFE

SEQ ID NO: 47631 - protein, 25 aa, synthetic construct
  source 1..25: note = Seed: QTVHSIPLTINKEEALQRPVASDFE
QTVHSIPLTINKEWALQRAVANDFE

SEQ ID NO: 47632 - protein, 25 aa, synthetic construct
  source 1..25: note = Seed: QTVHSIPLTINKEEALQRPVASDFE
QTVHSIPLTINKEWALQRAVAQDFE

SEQ ID NO: 47633 - protein, 25 aa, synthetic construct
  source 1..25: note = Seed: QTVHSIPLTINKEEALQRPVASDFE
QTVHSIPLTINKEWALQRAVASDFE

SEQ ID NO: 47634 - protein, 25 aa, synthetic construct
  source 1..25: note = Seed: QTVHSIPLTINKEEALQRPVASDFE
QTVHSIPLTINKEWALQRAVATDFE

SEQ ID NO: 47635 - protein, 25 aa, synthetic construct
  source 1..25: note = Seed: QTVHSIPLTINKEEALQRPVASDFE
QTVHSIPLTINKEWALQRAVAVDFE

SEQ ID NO: 47636 - protein, 25 aa, synthetic construct
  source 1..25: note = Seed: QTVHSIPLTINKEEALQRPVASDFE
QTVHSIPLTINKEWALQRGVAADFE

SEQ ID NO: 47637 - protein, 25 aa, synthetic construct
  source 1..25: note = Seed: QTVHSIPLTINKEEALQRPVASDFE
QTVHSIPLTINKEWALQRGVANDFE

SEQ ID NO: 47638 - protein, 25 aa, synthetic construct
  source 1..25: note = Seed: QTVHSIPLTINKEEALQRPVASDFE
QTVHSIPLTINKEWALQRGVASDFE

SEQ ID NO: 47639 - protein, 25 aa, synthetic construct
  source 1..25: note = Seed: QTVHSIPLTINKEEALQRPVASDFE
QTVHSIPLTINKEWALQRIVAADFE

SEQ ID NO: 47640 - protein, 25 aa, synthetic construct
  source 1..25: note = Seed: QTVHSIPLTINKEEALQRPVASDFE
QTVHSIPLTINKEWALQRIVANDFE

SEQ ID NO: 47641 - protein, 25 aa, synthetic construct
  source 1..25: note = Seed: QTVHSIPLTINKEEALQRPVASDFE
QTVHSIPLTINKEWALQRIVASDFE

SEQ ID NO: 47642 - protein, 25 aa, synthetic construct
  source 1..25: note = Seed: QTVHSIPLTINKEEALQRPVASDFE
QTVHSIPLTINKEWALQRNVAADFE

SEQ ID NO: 47643 - protein, 25 aa, synthetic construct
  source 1..25: note = Seed: QTVHSIPLTINKEEALQRPVASDFE
QTVHSIPLTINKEWALQRNVANDFE

SEQ ID NO: 47644 - protein, 25 aa, synthetic construct
  source 1..25: note = Seed: QTVHSIPLTINKEEALQRPVASDFE
QTVHSIPLTINKEWALQRNVASDFE

SEQ ID NO: 47645 - protein, 25 aa, synthetic construct
  source 1..25: note = Seed: QTVHSIPLTINKEEALQRPVASDFE
QTVHSIPLTINKEWALQRPVAADFE

SEQ ID NO: 47646 - protein, 25 aa, synthetic construct
  source 1..25: note = Seed: QTVHSIPLTINKEEALQRPVASDFE
QTVHSIPLTINKEWALQRPVAIDFE

SEQ ID NO: 47647 - protein, 25 aa, synthetic construct
  source 1..25: note = Seed: QTVHSIPLTINKEEALQRPVASDFE
QTVHSIPLTINKEWALQRPVALDFE

SEQ ID NO: 47648 - protein, 25 aa, synthetic construct
  source 1..25: note = Seed: QTVHSIPLTINKEEALQRPVASDFE
QTVHSIPLTINKEWALQRPVAMDFE

SEQ ID NO: 47649 - protein, 25 aa, synthetic construct
  source 1..25: note = Seed: QTVHSIPLTINKEEALQRPVASDFE
QTVHSIPLTINKEWALQRPVANDFE

SEQ ID NO: 47650 - protein, 25 aa, synthetic construct
  source 1..25: note = Seed: QTVHSIPLTINKEEALQRPVASDFE
QTVHSIPLTINKEWALQRPVASDFE

SEQ ID NO: 47651 - protein, 25 aa, synthetic construct
  source 1..25: note = Seed: QTVHSIPLTINKEEALQRPVASDFE
QTVHSIPLTINKEWALQRPVATDFE

SEQ ID NO: 47652 - protein, 25 aa, synthetic construct
  source 1..25: note = Seed: QTVHSIPLTINKEEALQRPVASDFE
QTVHSIPLTINKEWALQRPVAVDFE

SEQ ID NO: 47653 - protein, 25 aa, synthetic construct
  source 1..25: note = Seed: QTVHSIPLTINKEEALQRPVASDFE
QTVHSIPLTINKEWALQRSVAADFE

SEQ ID NO: 47654 - protein, 25 aa, synthetic construct
  source 1..25: note = Seed: QTVHSIPLTINKEEALQRPVASDFE
QTVHSIPLTINKEWALQRSVAGDFE

SEQ ID NO: 47655 - protein, 25 aa, synthetic construct
  source 1..25: note = Seed: QTVHSIPLTINKEEALQRPVASDFE
QTVHSIPLTINKEWALQRSVAIDFE

SEQ ID NO: 47656 - protein, 25 aa, synthetic construct
  source 1..25: note = Seed: QTVHSIPLTINKEEALQRPVASDFE
QTVHSIPLTINKEWALQRSVALDFE

SEQ ID NO: 47657 - protein, 25 aa, synthetic construct
  source 1..25: note = Seed: QTVHSIPLTINKEEALQRPVASDFE
QTVHSIPLTINKEWALQRSVAMDFE

SEQ ID NO: 47658 - protein, 25 aa, synthetic construct
  source 1..25: note = Seed: QTVHSIPLTINKEEALQRPVASDFE
QTVHSIPLTINKEWALQRSVANDFE

SEQ ID NO: 47659 - protein, 25 aa, synthetic construct
  source 1..25: note = Seed: QTVHSIPLTINKEEALQRPVASDFE
QTVHSIPLTINKEWALQRSVASDFE

SEQ ID NO: 47660 - protein, 25 aa, synthetic construct
  source 1..25: note = Seed: QTVHSIPLTINKEEALQRPVASDFE
QTVHSIPLTINKEWALQRSVATDFE

SEQ ID NO: 47661 - protein, 25 aa, synthetic construct
  source 1..25: note = Seed: QTVHSIPLTINKEEALQRPVASDFE
QTVHSIPLTINKEWALQRSVAVDFE

SEQ ID NO: 47662 - protein, 25 aa, synthetic construct
  source 1..25: note = Seed: QTVHSIPLTINKEEALQRPVASDFE
QTVHSIPLTINKEWALQRTVAADFE

SEQ ID NO: 47663 - protein, 25 aa, synthetic construct
  source 1..25: note = Seed: QTVHSIPLTINKEEALQRPVASDFE
QTVHSIPLTINKEWALQRTVAGDFE

SEQ ID NO: 47664 - protein, 25 aa, synthetic construct
  source 1..25: note = Seed: QTVHSIPLTINKEEALQRPVASDFE
QTVHSIPLTINKEWALQRTVAHDFE

SEQ ID NO: 47665 - protein, 25 aa, synthetic construct
  source 1..25: note = Seed: QTVHSIPLTINKEEALQRPVASDFE
QTVHSIPLTINKEWALQRTVAIDFE

SEQ ID NO: 47666 - protein, 25 aa, synthetic construct
  source 1..25: note = Seed: QTVHSIPLTINKEEALQRPVASDFE
QTVHSIPLTINKEWALQRTVALDFE

SEQ ID NO: 47667 - protein, 25 aa, synthetic construct
  source 1..25: note = Seed: QTVHSIPLTINKEEALQRPVASDFE
QTVHSIPLTINKEWALQRTVAMDFE

SEQ ID NO: 47668 - protein, 25 aa, synthetic construct
  source 1..25: note = Seed: QTVHSIPLTINKEEALQRPVASDFE
QTVHSIPLTINKEWALQRTVANDFE

SEQ ID NO: 47669 - protein, 25 aa, synthetic construct
  source 1..25: note = Seed: QTVHSIPLTINKEEALQRPVASDFE
QTVHSIPLTINKEWALQRTVASDFE

SEQ ID NO: 47670 - protein, 25 aa, synthetic construct
  source 1..25: note = Seed: QTVHSIPLTINKEEALQRPVASDFE
QTVHSIPLTINKEWALQRTVATDFE

SEQ ID NO: 47671 - protein, 25 aa, synthetic construct
  source 1..25: note = Seed: QTVHSIPLTINKEEALQRPVASDFE
QTVHSIPLTINKEWALQRTVAVDFE

SEQ ID NO: 47672 - protein, 25 aa, synthetic construct
  source 1..25: note = Seed: QTVHSIPLTINKEEALQRPVASDFE
QTVHSIPLTINKEWALQRVVAADFE

SEQ ID NO: 47673 - protein, 25 aa, synthetic construct
  source 1..25: note = Seed: QTVHSIPLTINKEEALQRPVASDFE
QTVHSIPLTINKEWALQRVVANDFE

SEQ ID NO: 47674 - protein, 25 aa, synthetic construct
  source 1..25: note = Seed: QTVHSIPLTINKEEALQRPVASDFE
QTVHSIPLTINKEWALQRVVASDFE

SEQ ID NO: 47675 - protein, 25 aa, synthetic construct
  source 1..25: note = Seed: QTVHSIPLTINKEEALQRPVASDFE
QTVHSIPLTINKEWALQRVVATDFE

SEQ ID NO: 47676 - protein, 25 aa, synthetic construct
  source 1..25: note = Seed: QTVHSIPLTINKEEALQRPVASDFE
QTVHSIPLTINKEWALSRAVAADFE

SEQ ID NO: 47677 - protein, 25 aa, synthetic construct
  source 1..25: note = Seed: QTVHSIPLTINKEEALQRPVASDFE
QTVHSIPLTINKEWALSRAVAGDFE

SEQ ID NO: 47678 - protein, 25 aa, synthetic construct
  source 1..25: note = Seed: QTVHSIPLTINKEEALQRPVASDFE
QTVHSIPLTINKEWALSRAVAHDFE

SEQ ID NO: 47679 - protein, 25 aa, synthetic construct
  source 1..25: note = Seed: QTVHSIPLTINKEEALQRPVASDFE
QTVHSIPLTINKEWALSRAVAIDFE

SEQ ID NO: 47680 - protein, 25 aa, synthetic construct
  source 1..25: note = Seed: QTVHSIPLTINKEEALQRPVASDFE
QTVHSIPLTINKEWALSRAVALDFE

SEQ ID NO: 47681 - protein, 25 aa, synthetic construct
  source 1..25: note = Seed: QTVHSIPLTINKEEALQRPVASDFE
QTVHSIPLTINKEWALSRAVAMDFE

SEQ ID NO: 47682 - protein, 25 aa, synthetic construct
  source 1..25: note = Seed: QTVHSIPLTINKEEALQRPVASDFE
QTVHSIPLTINKEWALSRAVANDFE

SEQ ID NO: 47683 - protein, 25 aa, synthetic construct
  source 1..25: note = Seed: QTVHSIPLTINKEEALQRPVASDFE
QTVHSIPLTINKEWALSRAVAQDFE

SEQ ID NO: 47684 - protein, 25 aa, synthetic construct
  source 1..25: note = Seed: QTVHSIPLTINKEEALQRPVASDFE
QTVHSIPLTINKEWALSRAVASDFE

SEQ ID NO: 47685 - protein, 25 aa, synthetic construct
  source 1..25: note = Seed: QTVHSIPLTINKEEALQRPVASDFE
QTVHSIPLTINKEWALSRAVATDFE

SEQ ID NO: 47686 - protein, 25 aa, synthetic construct
  source 1..25: note = Seed: QTVHSIPLTINKEEALQRPVASDFE
QTVHSIPLTINKEWALSRAVAVDFE

SEQ ID NO: 47687 - protein, 25 aa, synthetic construct
  source 1..25: note = Seed: QTVHSIPLTINKEEALQRPVASDFE
QTVHSIPLTINKEWALSRGVAADFE

SEQ ID NO: 47688 - protein, 25 aa, synthetic construct
  source 1..25: note = Seed: QTVHSIPLTINKEEALQRPVASDFE
QTVHSIPLTINKEWALSRIVANDFE

SEQ ID NO: 47689 - protein, 25 aa, synthetic construct
  source 1..25: note = Seed: QTVHSIPLTINKEEALQRPVASDFE
QTVHSIPLTINKEWALSRPVAADFE

SEQ ID NO: 47690 - protein, 25 aa, synthetic construct
  source 1..25: note = Seed: QTVHSIPLTINKEEALQRPVASDFE
QTVHSIPLTINKEWALSRPVAIDFE

SEQ ID NO: 47691 - protein, 25 aa, synthetic construct
  source 1..25: note = Seed: QTVHSIPLTINKEEALQRPVASDFE
QTVHSIPLTINKEWALSRPVAMDFE

SEQ ID NO: 47692 - protein, 25 aa, synthetic construct
  source 1..25: note = Seed: QTVHSIPLTINKEEALQRPVASDFE
QTVHSIPLTINKEWALSRPVANDFE

SEQ ID NO: 47693 - protein, 25 aa, synthetic construct
  source 1..25: note = Seed: QTVHSIPLTINKEEALQRPVASDFE
QTVHSIPLTINKEWALSRPVASDFE

SEQ ID NO: 47694 - protein, 25 aa, synthetic construct
  source 1..25: note = Seed: QTVHSIPLTINKEEALQRPVASDFE
QTVHSIPLTINKEWALSRPVAVDFE

SEQ ID NO: 47695 - protein, 25 aa, synthetic construct
  source 1..25: note = Seed: QTVHSIPLTINKEEALQRPVASDFE
QTVHSIPLTINKEWALSRSVAADFE

SEQ ID NO: 47696 - protein, 25 aa, synthetic construct
  source 1..25: note = Seed: QTVHSIPLTINKEEALQRPVASDFE
QTVHSIPLTINKEWALSRSVANDFE

SEQ ID NO: 47697 - protein, 25 aa, synthetic construct
  source 1..25: note = Seed: QTVHSIPLTINKEEALQRPVASDFE
QTVHSIPLTINKEWALSRSVASDFE

SEQ ID NO: 47698 - protein, 25 aa, synthetic construct
  source 1..25: note = Seed: QTVHSIPLTINKEEALQRPVASDFE
QTVHSIPLTINKEWALSRTVAADFE

SEQ ID NO: 47699 - protein, 25 aa, synthetic construct
  source 1..25: note = Seed: QTVHSIPLTINKEEALQRPVASDFE
QTVHSIPLTINKEWALSRTVANDFE

SEQ ID NO: 47700 - protein, 25 aa, synthetic construct
  source 1..25: note = Seed: QTVHSIPLTINKEEALQRPVASDFE
QTVHSIPLTINKEWALSRTVASDFE

SEQ ID NO: 47701 - protein, 25 aa, synthetic construct
  source 1..25: note = Seed: QTVHSIPLTINKEEALQRPVASDFE
QTVHSIPLTINKEWALSRTVATDFE

SEQ ID NO: 47702 - protein, 25 aa, synthetic construct
  source 1..25: note = Seed: QTVHSIPLTINKEEALQRPVASDFE
QTVHSIPLTINKEWALSRVVAADFE

SEQ ID NO: 47703 - protein, 25 aa, synthetic construct
  source 1..25: note = Seed: QTVHSIPLTINKEEALQRPVASDFE
QTVHSIPLTINKEWALSRVVANDFE

SEQ ID NO: 47704 - protein, 25 aa, synthetic construct
  source 1..25: note = Seed: QTVHSIPLTINKEEALQRPVASDFE
QTVHSIPLTINKEWALSRVVASDFE

SEQ ID NO: 47705 - protein, 25 aa, synthetic construct
  source 1..25: note = Seed: QTVHSIPLTINKEEALQRPVASDFE
QTVHSIPLTINKEWALTRAVAADFE

SEQ ID NO: 47706 - protein, 25 aa, synthetic construct
  source 1..25: note = Seed: QTVHSIPLTINKEEALQRPVASDFE
QTVHSIPLTINKEWALTRAVAIDFE

SEQ ID NO: 47707 - protein, 25 aa, synthetic construct
  source 1..25: note = Seed: QTVHSIPLTINKEEALQRPVASDFE
QTVHSIPLTINKEWALTRAVALDFE

SEQ ID NO: 47708 - protein, 25 aa, synthetic construct
  source 1..25: note = Seed: QTVHSIPLTINKEEALQRPVASDFE
QTVHSIPLTINKEWALTRAVAMDFE

SEQ ID NO: 47709 - protein, 25 aa, synthetic construct
  source 1..25: note = Seed: QTVHSIPLTINKEEALQRPVASDFE
QTVHSIPLTINKEWALTRAVANDFE

SEQ ID NO: 47710 - protein, 25 aa, synthetic construct
  source 1..25: note = Seed: QTVHSIPLTINKEEALQRPVASDFE
QTVHSIPLTINKEWALTRAVASDFE

SEQ ID NO: 47711 - protein, 25 aa, synthetic construct
  source 1..25: note = Seed: QTVHSIPLTINKEEALQRPVASDFE
QTVHSIPLTINKEWALTRAVATDFE

SEQ ID NO: 47712 - protein, 25 aa, synthetic construct
  source 1..25: note = Seed: QTVHSIPLTINKEEALQRPVASDFE
QTVHSIPLTINKEWALTRAVAVDFE

SEQ ID NO: 47713 - protein, 25 aa, synthetic construct
  source 1..25: note = Seed: QTVHSIPLTINKEEALQRPVASDFE
QTVHSIPLTINKEWALTRGVAADFE

SEQ ID NO: 47714 - protein, 25 aa, synthetic construct
  source 1..25: note = Seed: QTVHSIPLTINKEEALQRPVASDFE
QTVHSIPLTINKEWALTRPVAADFE

SEQ ID NO: 47715 - protein, 25 aa, synthetic construct
  source 1..25: note = Seed: QTVHSIPLTINKEEALQRPVASDFE
QTVHSIPLTINKEWALTRPVANDFE

SEQ ID NO: 47716 - protein, 25 aa, synthetic construct
  source 1..25: note = Seed: QTVHSIPLTINKEEALQRPVASDFE
QTVHSIPLTINKEWALTRPVASDFE

SEQ ID NO: 47717 - protein, 25 aa, synthetic construct
  source 1..25: note = Seed: QTVHSIPLTINKEEALQRPVASDFE
QTVHSIPLTINKEWALTRSVAADFE

SEQ ID NO: 47718 - protein, 25 aa, synthetic construct
  source 1..25: note = Seed: QTVHSIPLTINKEEALQRPVASDFE
QTVHSIPLTINKEWALTRSVANDFE

SEQ ID NO: 47719 - protein, 25 aa, synthetic construct
  source 1..25: note = Seed: QTVHSIPLTINKEEALQRPVASDFE
QTVHSIPLTINKEWALTRSVASDFE

SEQ ID NO: 47720 - protein, 25 aa, synthetic construct
  source 1..25: note = Seed: QTVHSIPLTINKEEALQRPVASDFE
QTVHSIPLTINKEWALTRTVAADFE

SEQ ID NO: 47721 - protein, 25 aa, synthetic construct
  source 1..25: note = Seed: QTVHSIPLTINKEEALQRPVASDFE
QTVHSIPLTINKEWALTRTVANDFE

SEQ ID NO: 47722 - protein, 25 aa, synthetic construct
  source 1..25: note = Seed: QTVHSIPLTINKEEALQRPVASDFE
QTVHSIPLTINKEWALTRTVASDFE

SEQ ID NO: 47723 - protein, 25 aa, synthetic construct
  source 1..25: note = Seed: QTVHSIPLTINKEEALQRPVASDFE
QTVHSIPLTINKEWALTRVVANDFE

SEQ ID NO: 47724 - protein, 25 aa, synthetic construct
  source 1..25: note = Seed: QTVHSIPLTINKEEALQRPVASDFE
QTVHSIPLTINKEWALVRAVAADFE

SEQ ID NO: 47725 - protein, 25 aa, synthetic construct
  source 1..25: note = Seed: QTVHSIPLTINKEEALQRPVASDFE
QTVHSIPLTINKEWALVRAVAGDFE

SEQ ID NO: 47726 - protein, 25 aa, synthetic construct
  source 1..25: note = Seed: QTVHSIPLTINKEEALQRPVASDFE
QTVHSIPLTINKEWALVRAVAHDFE

SEQ ID NO: 47727 - protein, 25 aa, synthetic construct
  source 1..25: note = Seed: QTVHSIPLTINKEEALQRPVASDFE
QTVHSIPLTINKEWALVRAVAMDFE

SEQ ID NO: 47728 - protein, 25 aa, synthetic construct
  source 1..25: note = Seed: QTVHSIPLTINKEEALQRPVASDFE
QTVHSIPLTINKEWALVRAVANDFE

SEQ ID NO: 47729 - protein, 25 aa, synthetic construct
  source 1..25: note = Seed: QTVHSIPLTINKEEALQRPVASDFE
QTVHSIPLTINKEWALVRAVAQDFE

SEQ ID NO: 47730 - protein, 25 aa, synthetic construct
  source 1..25: note = Seed: QTVHSIPLTINKEEALQRPVASDFE
QTVHSIPLTINKEWALVRAVASDFE

SEQ ID NO: 47731 - protein, 25 aa, synthetic construct
  source 1..25: note = Seed: QTVHSIPLTINKEEALQRPVASDFE
QTVHSIPLTINKEWALVRAVATDFE

SEQ ID NO: 47732 - protein, 25 aa, synthetic construct
  source 1..25: note = Seed: QTVHSIPLTINKEEALQRPVASDFE
QTVHSIPLTINKEWALVRAVAVDFE

SEQ ID NO: 47733 - protein, 25 aa, synthetic construct
  source 1..25: note = Seed: QTVHSIPLTINKEEALQRPVASDFE
QTVHSIPLTINKEWALVRGVAADFE

SEQ ID NO: 47734 - protein, 25 aa, synthetic construct
  source 1..25: note = Seed: QTVHSIPLTINKEEALQRPVASDFE
QTVHSIPLTINKEWALVRGVANDFE

SEQ ID NO: 47735 - protein, 25 aa, synthetic construct
  source 1..25: note = Seed: QTVHSIPLTINKEEALQRPVASDFE
QTVHSIPLTINKEWALVRGVASDFE

SEQ ID NO: 47736 - protein, 25 aa, synthetic construct
  source 1..25: note = Seed: QTVHSIPLTINKEEALQRPVASDFE
QTVHSIPLTINKEWALVRGVATDFE

SEQ ID NO: 47737 - protein, 25 aa, synthetic construct
  source 1..25: note = Seed: QTVHSIPLTINKEEALQRPVASDFE
QTVHSIPLTINKEWALVRIVANDFE

SEQ ID NO: 47738 - protein, 25 aa, synthetic construct
  source 1..25: note = Seed: QTVHSIPLTINKEEALQRPVASDFE
QTVHSIPLTINKEWALVRNVAADFE

SEQ ID NO: 47739 - protein, 25 aa, synthetic construct
  source 1..25: note = Seed: QTVHSIPLTINKEEALQRPVASDFE
QTVHSIPLTINKEWALVRNVANDFE

SEQ ID NO: 47740 - protein, 25 aa, synthetic construct
  source 1..25: note = Seed: QTVHSIPLTINKEEALQRPVASDFE
QTVHSIPLTINKEWALVRNVASDFE

SEQ ID NO: 47741 - protein, 25 aa, synthetic construct
  source 1..25: note = Seed: QTVHSIPLTINKEEALQRPVASDFE
QTVHSIPLTINKEWALVRNVATDFE

SEQ ID NO: 47742 - protein, 25 aa, synthetic construct
  source 1..25: note = Seed: QTVHSIPLTINKEEALQRPVASDFE
QTVHSIPLTINKEWALVRPVAADFE

SEQ ID NO: 47743 - protein, 25 aa, synthetic construct
  source 1..25: note = Seed: QTVHSIPLTINKEEALQRPVASDFE
QTVHSIPLTINKEWALVRPVAGDFE

SEQ ID NO: 47744 - protein, 25 aa, synthetic construct
  source 1..25: note = Seed: QTVHSIPLTINKEEALQRPVASDFE
QTVHSIPLTINKEWALVRPVAHDFE

SEQ ID NO: 47745 - protein, 25 aa, synthetic construct
  source 1..25: note = Seed: QTVHSIPLTINKEEALQRPVASDFE
QTVHSIPLTINKEWALVRPVAIDFE

SEQ ID NO: 47746 - protein, 25 aa, synthetic construct
  source 1..25: note = Seed: QTVHSIPLTINKEEALQRPVASDFE
QTVHSIPLTINKEWALVRPVALDFE

SEQ ID NO: 47747 - protein, 25 aa, synthetic construct
  source 1..25: note = Seed: QTVHSIPLTINKEEALQRPVASDFE
QTVHSIPLTINKEWALVRPVAMDFE

SEQ ID NO: 47748 - protein, 25 aa, synthetic construct
  source 1..25: note = Seed: QTVHSIPLTINKEEALQRPVASDFE
QTVHSIPLTINKEWALVRPVANDFE

SEQ ID NO: 47749 - protein, 25 aa, synthetic construct
  source 1..25: note = Seed: QTVHSIPLTINKEEALQRPVASDFE
QTVHSIPLTINKEWALVRPVAQDFE

SEQ ID NO: 47750 - protein, 25 aa, synthetic construct
  source 1..25: note = Seed: QTVHSIPLTINKEEALQRPVASDFE
QTVHSIPLTINKEWALVRPVASDFE

SEQ ID NO: 47751 - protein, 25 aa, synthetic construct
  source 1..25: note = Seed: QTVHSIPLTINKEEALQRPVASDFE
QTVHSIPLTINKEWALVRPVATDFE

SEQ ID NO: 47752 - protein, 25 aa, synthetic construct
  source 1..25: note = Seed: QTVHSIPLTINKEEALQRPVASDFE
QTVHSIPLTINKEWALVRPVAVDFE

SEQ ID NO: 47753 - protein, 25 aa, synthetic construct
  source 1..25: note = Seed: QTVHSIPLTINKEEALQRPVASDFE
QTVHSIPLTINKEWALVRSVAADFE

SEQ ID NO: 47754 - protein, 25 aa, synthetic construct
  source 1..25: note = Seed: QTVHSIPLTINKEEALQRPVASDFE
QTVHSIPLTINKEWALVRSVAGDFE

SEQ ID NO: 47755 - protein, 25 aa, synthetic construct
  source 1..25: note = Seed: QTVHSIPLTINKEEALQRPVASDFE
QTVHSIPLTINKEWALVRSVAHDFE

SEQ ID NO: 47756 - protein, 25 aa, synthetic construct
  source 1..25: note = Seed: QTVHSIPLTINKEEALQRPVASDFE
QTVHSIPLTINKEWALVRSVANDFE

SEQ ID NO: 47757 - protein, 25 aa, synthetic construct
  source 1..25: note = Seed: QTVHSIPLTINKEEALQRPVASDFE
QTVHSIPLTINKEWALVRSVASDFE

SEQ ID NO: 47758 - protein, 25 aa, synthetic construct
  source 1..25: note = Seed: QTVHSIPLTINKEEALQRPVASDFE
QTVHSIPLTINKEWALVRSVATDFE

SEQ ID NO: 47759 - protein, 25 aa, synthetic construct
  source 1..25: note = Seed: QTVHSIPLTINKEEALQRPVASDFE
QTVHSIPLTINKEWALVRSVAVDFE

SEQ ID NO: 47760 - protein, 25 aa, synthetic construct
  source 1..25: note = Seed: QTVHSIPLTINKEEALQRPVASDFE
QTVHSIPLTINKEWALVRTVAADFE

SEQ ID NO: 47761 - protein, 25 aa, synthetic construct
  source 1..25: note = Seed: QTVHSIPLTINKEEALQRPVASDFE
QTVHSIPLTINKEWALVRTVAGDFE

SEQ ID NO: 47762 - protein, 25 aa, synthetic construct
  source 1..25: note = Seed: QTVHSIPLTINKEEALQRPVASDFE
QTVHSIPLTINKEWALVRTVAHDFE

SEQ ID NO: 47763 - protein, 25 aa, synthetic construct
  source 1..25: note = Seed: QTVHSIPLTINKEEALQRPVASDFE
QTVHSIPLTINKEWALVRTVAMDFE

SEQ ID NO: 47764 - protein, 25 aa, synthetic construct
  source 1..25: note = Seed: QTVHSIPLTINKEEALQRPVASDFE
QTVHSIPLTINKEWALVRTVANDFE

SEQ ID NO: 47765 - protein, 25 aa, synthetic construct
  source 1..25: note = Seed: QTVHSIPLTINKEEALQRPVASDFE
QTVHSIPLTINKEWALVRTVASDFE

SEQ ID NO: 47766 - protein, 25 aa, synthetic construct
  source 1..25: note = Seed: QTVHSIPLTINKEEALQRPVASDFE
QTVHSIPLTINKEWALVRTVATDFE

SEQ ID NO: 47767 - protein, 25 aa, synthetic construct
  source 1..25: note = Seed: QTVHSIPLTINKEEALQRPVASDFE
QTVHSIPLTINKEWALVRTVAVDFE

SEQ ID NO: 47768 - protein, 25 aa, synthetic construct
  source 1..25: note = Seed: QTVHSIPLTINKEEALQRPVASDFE
QTVHSIPLTINKEWALVRVVANDFE

SEQ ID NO: 47769 - protein, 25 aa, synthetic construct
  source 1..25: note = Seed: QTVHSIPLTINKEEALQRPVASDFE
QTVHSIPLTINKEWALVRVVASDFE

SEQ ID NO: 47770 - protein, 25 aa, synthetic construct
  source 1..25: note = Seed: QTVHSIPLTINKEEALQRPVASDFE
QTVHSIPLTINKEWALWRAVAADFE

SEQ ID NO: 47771 - protein, 25 aa, synthetic construct
  source 1..25: note = Seed: QTVHSIPLTINKEEALQRPVASDFE
QTVHSIPLTINKEYALARAVAADFE

SEQ ID NO: 47772 - protein, 25 aa, synthetic construct
  source 1..25: note = Seed: QTVHSIPLTINKEEALQRPVASDFE
QTVHSIPLTINKEYALARAVACDFE

SEQ ID NO: 47773 - protein, 25 aa, synthetic construct
  source 1..25: note = Seed: QTVHSIPLTINKEEALQRPVASDFE
QTVHSIPLTINKEYALARAVADDFE

SEQ ID NO: 47774 - protein, 25 aa, synthetic construct
  source 1..25: note = Seed: QTVHSIPLTINKEEALQRPVASDFE
QTVHSIPLTINKEYALARAVAEDFE

SEQ ID NO: 47775 - protein, 25 aa, synthetic construct
  source 1..25: note = Seed: QTVHSIPLTINKEEALQRPVASDFE
QTVHSIPLTINKEYALARAVAFDFE

SEQ ID NO: 47776 - protein, 25 aa, synthetic construct
  source 1..25: note = Seed: QTVHSIPLTINKEEALQRPVASDFE
QTVHSIPLTINKEYALARAVAGDFE

SEQ ID NO: 47777 - protein, 25 aa, synthetic construct
  source 1..25: note = Seed: QTVHSIPLTINKEEALQRPVASDFE
QTVHSIPLTINKEYALARAVAHDFE

SEQ ID NO: 47778 - protein, 25 aa, synthetic construct
  source 1..25: note = Seed: QTVHSIPLTINKEEALQRPVASDFE
QTVHSIPLTINKEYALARAVAIDFE

SEQ ID NO: 47779 - protein, 25 aa, synthetic construct
  source 1..25: note = Seed: QTVHSIPLTINKEEALQRPVASDFE
QTVHSIPLTINKEYALARAVAKDFE

SEQ ID NO: 47780 - protein, 25 aa, synthetic construct
  source 1..25: note = Seed: QTVHSIPLTINKEEALQRPVASDFE
QTVHSIPLTINKEYALARAVALDFE

SEQ ID NO: 47781 - protein, 25 aa, synthetic construct
  source 1..25: note = Seed: QTVHSIPLTINKEEALQRPVASDFE
QTVHSIPLTINKEYALARAVAMDFE

SEQ ID NO: 47782 - protein, 25 aa, synthetic construct
  source 1..25: note = Seed: QTVHSIPLTINKEEALQRPVASDFE
QTVHSIPLTINKEYALARAVANDFE

SEQ ID NO: 47783 - protein, 25 aa, synthetic construct
  source 1..25: note = Seed: QTVHSIPLTINKEEALQRPVASDFE
QTVHSIPLTINKEYALARAVAPDFE

SEQ ID NO: 47784 - protein, 25 aa, synthetic construct
  source 1..25: note = Seed: QTVHSIPLTINKEEALQRPVASDFE
QTVHSIPLTINKEYALARAVAQDFE

SEQ ID NO: 47785 - protein, 25 aa, synthetic construct
  source 1..25: note = Seed: QTVHSIPLTINKEEALQRPVASDFE
QTVHSIPLTINKEYALARAVARDFE

SEQ ID NO: 47786 - protein, 25 aa, synthetic construct
  source 1..25: note = Seed: QTVHSIPLTINKEEALQRPVASDFE
QTVHSIPLTINKEYALARAVASDFE

SEQ ID NO: 47787 - protein, 25 aa, synthetic construct
  source 1..25: note = Seed: QTVHSIPLTINKEEALQRPVASDFE
QTVHSIPLTINKEYALARAVATDFE

SEQ ID NO: 47788 - protein, 25 aa, synthetic construct
  source 1..25: note = Seed: QTVHSIPLTINKEEALQRPVASDFE
QTVHSIPLTINKEYALARAVAVDFE

SEQ ID NO: 47789 - protein, 25 aa, synthetic construct
  source 1..25: note = Seed: QTVHSIPLTINKEEALQRPVASDFE
QTVHSIPLTINKEYALARAVAYDFE

SEQ ID NO: 47790 - protein, 25 aa, synthetic construct
  source 1..25: note = Seed: QTVHSIPLTINKEEALQRPVASDFE
QTVHSIPLTINKEYALARCVAADFE

SEQ ID NO: 47791 - protein, 25 aa, synthetic construct
  source 1..25: note = Seed: QTVHSIPLTINKEEALQRPVASDFE
QTVHSIPLTINKEYALARCVANDFE

SEQ ID NO: 47792 - protein, 25 aa, synthetic construct
  source 1..25: note = Seed: QTVHSIPLTINKEEALQRPVASDFE
QTVHSIPLTINKEYALARCVASDFE

SEQ ID NO: 47793 - protein, 25 aa, synthetic construct
  source 1..25: note = Seed: QTVHSIPLTINKEEALQRPVASDFE
QTVHSIPLTINKEYALARDVAADFE

SEQ ID NO: 47794 - protein, 25 aa, synthetic construct
  source 1..25: note = Seed: QTVHSIPLTINKEEALQRPVASDFE
QTVHSIPLTINKEYALAREVAADFE

SEQ ID NO: 47795 - protein, 25 aa, synthetic construct
  source 1..25: note = Seed: QTVHSIPLTINKEEALQRPVASDFE
QTVHSIPLTINKEYALAREVANDFE

SEQ ID NO: 47796 - protein, 25 aa, synthetic construct
  source 1..25: note = Seed: QTVHSIPLTINKEEALQRPVASDFE
QTVHSIPLTINKEYALAREVASDFE

SEQ ID NO: 47797 - protein, 25 aa, synthetic construct
  source 1..25: note = Seed: QTVHSIPLTINKEEALQRPVASDFE
QTVHSIPLTINKEYALARGVAADFE

SEQ ID NO: 47798 - protein, 25 aa, synthetic construct
  source 1..25: note = Seed: QTVHSIPLTINKEEALQRPVASDFE
QTVHSIPLTINKEYALARGVADDFE

SEQ ID NO: 47799 - protein, 25 aa, synthetic construct
  source 1..25: note = Seed: QTVHSIPLTINKEEALQRPVASDFE
QTVHSIPLTINKEYALARGVAEDFE

SEQ ID NO: 47800 - protein, 25 aa, synthetic construct
  source 1..25: note = Seed: QTVHSIPLTINKEEALQRPVASDFE
QTVHSIPLTINKEYALARGVAFDFE

SEQ ID NO: 47801 - protein, 25 aa, synthetic construct
  source 1..25: note = Seed: QTVHSIPLTINKEEALQRPVASDFE
QTVHSIPLTINKEYALARGVAGDFE

SEQ ID NO: 47802 - protein, 25 aa, synthetic construct
  source 1..25: note = Seed: QTVHSIPLTINKEEALQRPVASDFE
QTVHSIPLTINKEYALARGVAHDFE

SEQ ID NO: 47803 - protein, 25 aa, synthetic construct
  source 1..25: note = Seed: QTVHSIPLTINKEEALQRPVASDFE
QTVHSIPLTINKEYALARGVAIDFE

SEQ ID NO: 47804 - protein, 25 aa, synthetic construct
  source 1..25: note = Seed: QTVHSIPLTINKEEALQRPVASDFE
QTVHSIPLTINKEYALARGVALDFE

SEQ ID NO: 47805 - protein, 25 aa, synthetic construct
  source 1..25: note = Seed: QTVHSIPLTINKEEALQRPVASDFE
QTVHSIPLTINKEYALARGVAMDFE

SEQ ID NO: 47806 - protein, 25 aa, synthetic construct
  source 1..25: note = Seed: QTVHSIPLTINKEEALQRPVASDFE
QTVHSIPLTINKEYALARGVANDFE

SEQ ID NO: 47807 - protein, 25 aa, synthetic construct
  source 1..25: note = Seed: QTVHSIPLTINKEEALQRPVASDFE
QTVHSIPLTINKEYALARGVAPDFE

SEQ ID NO: 47808 - protein, 25 aa, synthetic construct
  source 1..25: note = Seed: QTVHSIPLTINKEEALQRPVASDFE
QTVHSIPLTINKEYALARGVAQDFE

SEQ ID NO: 47809 - protein, 25 aa, synthetic construct
  source 1..25: note = Seed: QTVHSIPLTINKEEALQRPVASDFE
QTVHSIPLTINKEYALARGVASDFE

SEQ ID NO: 47810 - protein, 25 aa, synthetic construct
  source 1..25: note = Seed: QTVHSIPLTINKEEALQRPVASDFE
QTVHSIPLTINKEYALARGVATDFE

SEQ ID NO: 47811 - protein, 25 aa, synthetic construct
  source 1..25: note = Seed: QTVHSIPLTINKEEALQRPVASDFE
QTVHSIPLTINKEYALARGVAVDFE

SEQ ID NO: 47812 - protein, 25 aa, synthetic construct
  source 1..25: note = Seed: QTVHSIPLTINKEEALQRPVASDFE
QTVHSIPLTINKEYALARGVAYDFE

SEQ ID NO: 47813 - protein, 25 aa, synthetic construct
  source 1..25: note = Seed: QTVHSIPLTINKEEALQRPVASDFE
QTVHSIPLTINKEYALARHVAADFE

SEQ ID NO: 47814 - protein, 25 aa, synthetic construct
  source 1..25: note = Seed: QTVHSIPLTINKEEALQRPVASDFE
QTVHSIPLTINKEYALARHVAIDFE

SEQ ID NO: 47815 - protein, 25 aa, synthetic construct
  source 1..25: note = Seed: QTVHSIPLTINKEEALQRPVASDFE
QTVHSIPLTINKEYALARHVALDFE

SEQ ID NO: 47816 - protein, 25 aa, synthetic construct
  source 1..25: note = Seed: QTVHSIPLTINKEEALQRPVASDFE
QTVHSIPLTINKEYALARHVAMDFE

SEQ ID NO: 47817 - protein, 25 aa, synthetic construct
  source 1..25: note = Seed: QTVHSIPLTINKEEALQRPVASDFE
QTVHSIPLTINKEYALARHVANDFE

SEQ ID NO: 47818 - protein, 25 aa, synthetic construct
  source 1..25: note = Seed: QTVHSIPLTINKEEALQRPVASDFE
QTVHSIPLTINKEYALARHVASDFE

SEQ ID NO: 47819 - protein, 25 aa, synthetic construct
  source 1..25: note = Seed: QTVHSIPLTINKEEALQRPVASDFE
QTVHSIPLTINKEYALARHVATDFE

SEQ ID NO: 47820 - protein, 25 aa, synthetic construct
  source 1..25: note = Seed: QTVHSIPLTINKEEALQRPVASDFE
QTVHSIPLTINKEYALARHVAVDFE

SEQ ID NO: 47821 - protein, 25 aa, synthetic construct
  source 1..25: note = Seed: QTVHSIPLTINKEEALQRPVASDFE
QTVHSIPLTINKEYALARIVAADFE

SEQ ID NO: 47822 - protein, 25 aa, synthetic construct
  source 1..25: note = Seed: QTVHSIPLTINKEEALQRPVASDFE
QTVHSIPLTINKEYALARIVADDFE

SEQ ID NO: 47823 - protein, 25 aa, synthetic construct
  source 1..25: note = Seed: QTVHSIPLTINKEEALQRPVASDFE
QTVHSIPLTINKEYALARIVAEDFE

SEQ ID NO: 47824 - protein, 25 aa, synthetic construct
  source 1..25: note = Seed: QTVHSIPLTINKEEALQRPVASDFE
QTVHSIPLTINKEYALARIVAGDFE

SEQ ID NO: 47825 - protein, 25 aa, synthetic construct
  source 1..25: note = Seed: QTVHSIPLTINKEEALQRPVASDFE
QTVHSIPLTINKEYALARIVAHDFE

SEQ ID NO: 47826 - protein, 25 aa, synthetic construct
  source 1..25: note = Seed: QTVHSIPLTINKEEALQRPVASDFE
QTVHSIPLTINKEYALARIVAIDFE

SEQ ID NO: 47827 - protein, 25 aa, synthetic construct
  source 1..25: note = Seed: QTVHSIPLTINKEEALQRPVASDFE
QTVHSIPLTINKEYALARIVAKDFE

SEQ ID NO: 47828 - protein, 25 aa, synthetic construct
  source 1..25: note = Seed: QTVHSIPLTINKEEALQRPVASDFE
QTVHSIPLTINKEYALARIVALDFE

SEQ ID NO: 47829 - protein, 25 aa, synthetic construct
  source 1..25: note = Seed: QTVHSIPLTINKEEALQRPVASDFE
QTVHSIPLTINKEYALARIVAMDFE

SEQ ID NO: 47830 - protein, 25 aa, synthetic construct
  source 1..25: note = Seed: QTVHSIPLTINKEEALQRPVASDFE
QTVHSIPLTINKEYALARIVANDFE

SEQ ID NO: 47831 - protein, 25 aa, synthetic construct
  source 1..25: note = Seed: QTVHSIPLTINKEEALQRPVASDFE
QTVHSIPLTINKEYALARIVAPDFE

SEQ ID NO: 47832 - protein, 25 aa, synthetic construct
  source 1..25: note = Seed: QTVHSIPLTINKEEALQRPVASDFE
QTVHSIPLTINKEYALARIVAQDFE

SEQ ID NO: 47833 - protein, 25 aa, synthetic construct
  source 1..25: note = Seed: QTVHSIPLTINKEEALQRPVASDFE
QTVHSIPLTINKEYALARIVASDFE

SEQ ID NO: 47834 - protein, 25 aa, synthetic construct
  source 1..25: note = Seed: QTVHSIPLTINKEEALQRPVASDFE
QTVHSIPLTINKEYALARIVATDFE

SEQ ID NO: 47835 - protein, 25 aa, synthetic construct
  source 1..25: note = Seed: QTVHSIPLTINKEEALQRPVASDFE
QTVHSIPLTINKEYALARIVAVDFE

SEQ ID NO: 47836 - protein, 25 aa, synthetic construct
  source 1..25: note = Seed: QTVHSIPLTINKEEALQRPVASDFE
QTVHSIPLTINKEYALARKVAADFE

SEQ ID NO: 47837 - protein, 25 aa, synthetic construct
  source 1..25: note = Seed: QTVHSIPLTINKEEALQRPVASDFE
QTVHSIPLTINKEYALARLVAADFE

SEQ ID NO: 47838 - protein, 25 aa, synthetic construct
  source 1..25: note = Seed: QTVHSIPLTINKEEALQRPVASDFE
QTVHSIPLTINKEYALARLVAGDFE

SEQ ID NO: 47839 - protein, 25 aa, synthetic construct
  source 1..25: note = Seed: QTVHSIPLTINKEEALQRPVASDFE
QTVHSIPLTINKEYALARLVAHDFE

SEQ ID NO: 47840 - protein, 25 aa, synthetic construct
  source 1..25: note = Seed: QTVHSIPLTINKEEALQRPVASDFE
QTVHSIPLTINKEYALARLVAMDFE

SEQ ID NO: 47841 - protein, 25 aa, synthetic construct
  source 1..25: note = Seed: QTVHSIPLTINKEEALQRPVASDFE
QTVHSIPLTINKEYALARLVANDFE

SEQ ID NO: 47842 - protein, 25 aa, synthetic construct
  source 1..25: note = Seed: QTVHSIPLTINKEEALQRPVASDFE
QTVHSIPLTINKEYALARLVASDFE

SEQ ID NO: 47843 - protein, 25 aa, synthetic construct
  source 1..25: note = Seed: QTVHSIPLTINKEEALQRPVASDFE
QTVHSIPLTINKEYALARLVATDFE

SEQ ID NO: 47844 - protein, 25 aa, synthetic construct
  source 1..25: note = Seed: QTVHSIPLTINKEEALQRPVASDFE
QTVHSIPLTINKEYALARLVAVDFE

SEQ ID NO: 47845 - protein, 25 aa, synthetic construct
  source 1..25: note = Seed: QTVHSIPLTINKEEALQRPVASDFE
QTVHSIPLTINKEYALARMVAADFE

SEQ ID NO: 47846 - protein, 25 aa, synthetic construct
  source 1..25: note = Seed: QTVHSIPLTINKEEALQRPVASDFE
QTVHSIPLTINKEYALARMVAGDFE

SEQ ID NO: 47847 - protein, 25 aa, synthetic construct
  source 1..25: note = Seed: QTVHSIPLTINKEEALQRPVASDFE
QTVHSIPLTINKEYALARMVAHDFE

SEQ ID NO: 47848 - protein, 25 aa, synthetic construct
  source 1..25: note = Seed: QTVHSIPLTINKEEALQRPVASDFE
QTVHSIPLTINKEYALARMVAIDFE

SEQ ID NO: 47849 - protein, 25 aa, synthetic construct
  source 1..25: note = Seed: QTVHSIPLTINKEEALQRPVASDFE
QTVHSIPLTINKEYALARMVALDFE

SEQ ID NO: 47850 - protein, 25 aa, synthetic construct
  source 1..25: note = Seed: QTVHSIPLTINKEEALQRPVASDFE
QTVHSIPLTINKEYALARMVAMDFE

SEQ ID NO: 47851 - protein, 25 aa, synthetic construct
  source 1..25: note = Seed: QTVHSIPLTINKEEALQRPVASDFE
QTVHSIPLTINKEYALARMVANDFE

SEQ ID NO: 47852 - protein, 25 aa, synthetic construct
  source 1..25: note = Seed: QTVHSIPLTINKEEALQRPVASDFE
QTVHSIPLTINKEYALARMVAQDFE

SEQ ID NO: 47853 - protein, 25 aa, synthetic construct
  source 1..25: note = Seed: QTVHSIPLTINKEEALQRPVASDFE
QTVHSIPLTINKEYALARMVASDFE

SEQ ID NO: 47854 - protein, 25 aa, synthetic construct
  source 1..25: note = Seed: QTVHSIPLTINKEEALQRPVASDFE
QTVHSIPLTINKEYALARMVATDFE

SEQ ID NO: 47855 - protein, 25 aa, synthetic construct
  source 1..25: note = Seed: QTVHSIPLTINKEEALQRPVASDFE
QTVHSIPLTINKEYALARMVAVDFE

SEQ ID NO: 47856 - protein, 25 aa, synthetic construct
  source 1..25: note = Seed: QTVHSIPLTINKEEALQRPVASDFE
QTVHSIPLTINKEYALARNVAADFE

SEQ ID NO: 47857 - protein, 25 aa, synthetic construct
  source 1..25: note = Seed: QTVHSIPLTINKEEALQRPVASDFE
QTVHSIPLTINKEYALARNVADDFE

SEQ ID NO: 47858 - protein, 25 aa, synthetic construct
  source 1..25: note = Seed: QTVHSIPLTINKEEALQRPVASDFE
QTVHSIPLTINKEYALARNVAEDFE

SEQ ID NO: 47859 - protein, 25 aa, synthetic construct
  source 1..25: note = Seed: QTVHSIPLTINKEEALQRPVASDFE
QTVHSIPLTINKEYALARNVAFDFE

SEQ ID NO: 47860 - protein, 25 aa, synthetic construct
  source 1..25: note = Seed: QTVHSIPLTINKEEALQRPVASDFE
QTVHSIPLTINKEYALARNVAGDFE

SEQ ID NO: 47861 - protein, 25 aa, synthetic construct
  source 1..25: note = Seed: QTVHSIPLTINKEEALQRPVASDFE
QTVHSIPLTINKEYALARNVAHDFE

SEQ ID NO: 47862 - protein, 25 aa, synthetic construct
  source 1..25: note = Seed: QTVHSIPLTINKEEALQRPVASDFE
QTVHSIPLTINKEYALARNVAIDFE

SEQ ID NO: 47863 - protein, 25 aa, synthetic construct
  source 1..25: note = Seed: QTVHSIPLTINKEEALQRPVASDFE
QTVHSIPLTINKEYALARNVALDFE

SEQ ID NO: 47864 - protein, 25 aa, synthetic construct
  source 1..25: note = Seed: QTVHSIPLTINKEEALQRPVASDFE
QTVHSIPLTINKEYALARNVAMDFE

SEQ ID NO: 47865 - protein, 25 aa, synthetic construct
  source 1..25: note = Seed: QTVHSIPLTINKEEALQRPVASDFE
QTVHSIPLTINKEYALARNVANDFE

SEQ ID NO: 47866 - protein, 25 aa, synthetic construct
  source 1..25: note = Seed: QTVHSIPLTINKEEALQRPVASDFE
QTVHSIPLTINKEYALARNVAPDFE

SEQ ID NO: 47867 - protein, 25 aa, synthetic construct
  source 1..25: note = Seed: QTVHSIPLTINKEEALQRPVASDFE
QTVHSIPLTINKEYALARNVAQDFE

SEQ ID NO: 47868 - protein, 25 aa, synthetic construct
  source 1..25: note = Seed: QTVHSIPLTINKEEALQRPVASDFE
QTVHSIPLTINKEYALARNVASDFE

SEQ ID NO: 47869 - protein, 25 aa, synthetic construct
  source 1..25: note = Seed: QTVHSIPLTINKEEALQRPVASDFE
QTVHSIPLTINKEYALARNVATDFE

SEQ ID NO: 47870 - protein, 25 aa, synthetic construct
  source 1..25: note = Seed: QTVHSIPLTINKEEALQRPVASDFE
QTVHSIPLTINKEYALARNVAVDFE

SEQ ID NO: 47871 - protein, 25 aa, synthetic construct
  source 1..25: note = Seed: QTVHSIPLTINKEEALQRPVASDFE
QTVHSIPLTINKEYALARNVAYDFE

SEQ ID NO: 47872 - protein, 25 aa, synthetic construct
  source 1..25: note = Seed: QTVHSIPLTINKEEALQRPVASDFE
QTVHSIPLTINKEYALARPVAADFE

SEQ ID NO: 47873 - protein, 25 aa, synthetic construct
  source 1..25: note = Seed: QTVHSIPLTINKEEALQRPVASDFE
QTVHSIPLTINKEYALARPVACDFE

SEQ ID NO: 47874 - protein, 25 aa, synthetic construct
  source 1..25: note = Seed: QTVHSIPLTINKEEALQRPVASDFE
QTVHSIPLTINKEYALARPVADDFE

SEQ ID NO: 47875 - protein, 25 aa, synthetic construct
  source 1..25: note = Seed: QTVHSIPLTINKEEALQRPVASDFE
QTVHSIPLTINKEYALARPVAEDFE

SEQ ID NO: 47876 - protein, 25 aa, synthetic construct
  source 1..25: note = Seed: QTVHSIPLTINKEEALQRPVASDFE
QTVHSIPLTINKEYALARPVAFDFE

SEQ ID NO: 47877 - protein, 25 aa, synthetic construct
  source 1..25: note = Seed: QTVHSIPLTINKEEALQRPVASDFE
QTVHSIPLTINKEYALARPVAGDFE

SEQ ID NO: 47878 - protein, 25 aa, synthetic construct
  source 1..25: note = Seed: QTVHSIPLTINKEEALQRPVASDFE
QTVHSIPLTINKEYALARPVAHDFE

SEQ ID NO: 47879 - protein, 25 aa, synthetic construct
  source 1..25: note = Seed: QTVHSIPLTINKEEALQRPVASDFE
QTVHSIPLTINKEYALARPVAIDFE

SEQ ID NO: 47880 - protein, 25 aa, synthetic construct
  source 1..25: note = Seed: QTVHSIPLTINKEEALQRPVASDFE
QTVHSIPLTINKEYALARPVAKDFE

SEQ ID NO: 47881 - protein, 25 aa, synthetic construct
  source 1..25: note = Seed: QTVHSIPLTINKEEALQRPVASDFE
QTVHSIPLTINKEYALARPVALDFE

SEQ ID NO: 47882 - protein, 25 aa, synthetic construct
  source 1..25: note = Seed: QTVHSIPLTINKEEALQRPVASDFE
QTVHSIPLTINKEYALARPVAMDFE

SEQ ID NO: 47883 - protein, 25 aa, synthetic construct
  source 1..25: note = Seed: QTVHSIPLTINKEEALQRPVASDFE
QTVHSIPLTINKEYALARPVANDFE

SEQ ID NO: 47884 - protein, 25 aa, synthetic construct
  source 1..25: note = Seed: QTVHSIPLTINKEEALQRPVASDFE
QTVHSIPLTINKEYALARPVAPDFE

SEQ ID NO: 47885 - protein, 25 aa, synthetic construct
  source 1..25: note = Seed: QTVHSIPLTINKEEALQRPVASDFE
QTVHSIPLTINKEYALARPVAQDFE

SEQ ID NO: 47886 - protein, 25 aa, synthetic construct
  source 1..25: note = Seed: QTVHSIPLTINKEEALQRPVASDFE
QTVHSIPLTINKEYALARPVARDFE

SEQ ID NO: 47887 - protein, 25 aa, synthetic construct
  source 1..25: note = Seed: QTVHSIPLTINKEEALQRPVASDFE
QTVHSIPLTINKEYALARPVASDFE

SEQ ID NO: 47888 - protein, 25 aa, synthetic construct
  source 1..25: note = Seed: QTVHSIPLTINKEEALQRPVASDFE
QTVHSIPLTINKEYALARPVATDFE

SEQ ID NO: 47889 - protein, 25 aa, synthetic construct
  source 1..25: note = Seed: QTVHSIPLTINKEEALQRPVASDFE
QTVHSIPLTINKEYALARPVAVDFE

SEQ ID NO: 47890 - protein, 25 aa, synthetic construct
  source 1..25: note = Seed: QTVHSIPLTINKEEALQRPVASDFE
QTVHSIPLTINKEYALARPVAWDFE

SEQ ID NO: 47891 - protein, 25 aa, synthetic construct
  source 1..25: note = Seed: QTVHSIPLTINKEEALQRPVASDFE
QTVHSIPLTINKEYALARPVAYDFE

SEQ ID NO: 47892 - protein, 25 aa, synthetic construct
  source 1..25: note = Seed: QTVHSIPLTINKEEALQRPVASDFE
QTVHSIPLTINKEYALARQVAADFE

SEQ ID NO: 47893 - protein, 25 aa, synthetic construct
  source 1..25: note = Seed: QTVHSIPLTINKEEALQRPVASDFE
QTVHSIPLTINKEYALARQVAIDFE

SEQ ID NO: 47894 - protein, 25 aa, synthetic construct
  source 1..25: note = Seed: QTVHSIPLTINKEEALQRPVASDFE
QTVHSIPLTINKEYALARQVALDFE

SEQ ID NO: 47895 - protein, 25 aa, synthetic construct
  source 1..25: note = Seed: QTVHSIPLTINKEEALQRPVASDFE
QTVHSIPLTINKEYALARQVAMDFE

SEQ ID NO: 47896 - protein, 25 aa, synthetic construct
  source 1..25: note = Seed: QTVHSIPLTINKEEALQRPVASDFE
QTVHSIPLTINKEYALARQVANDFE

SEQ ID NO: 47897 - protein, 25 aa, synthetic construct
  source 1..25: note = Seed: QTVHSIPLTINKEEALQRPVASDFE
QTVHSIPLTINKEYALARQVASDFE

SEQ ID NO: 47898 - protein, 25 aa, synthetic construct
  source 1..25: note = Seed: QTVHSIPLTINKEEALQRPVASDFE
QTVHSIPLTINKEYALARQVATDFE

SEQ ID NO: 47899 - protein, 25 aa, synthetic construct
  source 1..25: note = Seed: QTVHSIPLTINKEEALQRPVASDFE
QTVHSIPLTINKEYALARQVAVDFE

SEQ ID NO: 47900 - protein, 25 aa, synthetic construct
  source 1..25: note = Seed: QTVHSIPLTINKEEALQRPVASDFE
QTVHSIPLTINKEYALARSVAADFE

SEQ ID NO: 47901 - protein, 25 aa, synthetic construct
  source 1..25: note = Seed: QTVHSIPLTINKEEALQRPVASDFE
QTVHSIPLTINKEYALARSVACDFE

SEQ ID NO: 47902 - protein, 25 aa, synthetic construct
  source 1..25: note = Seed: QTVHSIPLTINKEEALQRPVASDFE
QTVHSIPLTINKEYALARSVADDFE

SEQ ID NO: 47903 - protein, 25 aa, synthetic construct
  source 1..25: note = Seed: QTVHSIPLTINKEEALQRPVASDFE
QTVHSIPLTINKEYALARSVAEDFE

SEQ ID NO: 47904 - protein, 25 aa, synthetic construct
  source 1..25: note = Seed: QTVHSIPLTINKEEALQRPVASDFE
QTVHSIPLTINKEYALARSVAFDFE

SEQ ID NO: 47905 - protein, 25 aa, synthetic construct
  source 1..25: note = Seed: QTVHSIPLTINKEEALQRPVASDFE
QTVHSIPLTINKEYALARSVAGDFE

SEQ ID NO: 47906 - protein, 25 aa, synthetic construct
  source 1..25: note = Seed: QTVHSIPLTINKEEALQRPVASDFE
QTVHSIPLTINKEYALARSVAHDFE

SEQ ID NO: 47907 - protein, 25 aa, synthetic construct
  source 1..25: note = Seed: QTVHSIPLTINKEEALQRPVASDFE
QTVHSIPLTINKEYALARSVAIDFE

SEQ ID NO: 47908 - protein, 25 aa, synthetic construct
  source 1..25: note = Seed: QTVHSIPLTINKEEALQRPVASDFE
QTVHSIPLTINKEYALARSVAKDFE

SEQ ID NO: 47909 - protein, 25 aa, synthetic construct
  source 1..25: note = Seed: QTVHSIPLTINKEEALQRPVASDFE
QTVHSIPLTINKEYALARSVALDFE

SEQ ID NO: 47910 - protein, 25 aa, synthetic construct
  source 1..25: note = Seed: QTVHSIPLTINKEEALQRPVASDFE
QTVHSIPLTINKEYALARSVAMDFE

SEQ ID NO: 47911 - protein, 25 aa, synthetic construct
  source 1..25: note = Seed: QTVHSIPLTINKEEALQRPVASDFE
QTVHSIPLTINKEYALARSVANDFE

SEQ ID NO: 47912 - protein, 25 aa, synthetic construct
  source 1..25: note = Seed: QTVHSIPLTINKEEALQRPVASDFE
QTVHSIPLTINKEYALARSVAPDFE

SEQ ID NO: 47913 - protein, 25 aa, synthetic construct
  source 1..25: note = Seed: QTVHSIPLTINKEEALQRPVASDFE
QTVHSIPLTINKEYALARSVAQDFE

SEQ ID NO: 47914 - protein, 25 aa, synthetic construct
  source 1..25: note = Seed: QTVHSIPLTINKEEALQRPVASDFE
QTVHSIPLTINKEYALARSVARDFE

SEQ ID NO: 47915 - protein, 25 aa, synthetic construct
  source 1..25: note = Seed: QTVHSIPLTINKEEALQRPVASDFE
QTVHSIPLTINKEYALARSVASDFE

SEQ ID NO: 47916 - protein, 25 aa, synthetic construct
  source 1..25: note = Seed: QTVHSIPLTINKEEALQRPVASDFE
QTVHSIPLTINKEYALARSVATDFE

SEQ ID NO: 47917 - protein, 25 aa, synthetic construct
  source 1..25: note = Seed: QTVHSIPLTINKEEALQRPVASDFE
QTVHSIPLTINKEYALARSVAVDFE

SEQ ID NO: 47918 - protein, 25 aa, synthetic construct
  source 1..25: note = Seed: QTVHSIPLTINKEEALQRPVASDFE
QTVHSIPLTINKEYALARSVAYDFE

SEQ ID NO: 47919 - protein, 25 aa, synthetic construct
  source 1..25: note = Seed: QTVHSIPLTINKEEALQRPVASDFE
QTVHSIPLTINKEYALARTVAADFE

SEQ ID NO: 47920 - protein, 25 aa, synthetic construct
  source 1..25: note = Seed: QTVHSIPLTINKEEALQRPVASDFE
QTVHSIPLTINKEYALARTVACDFE

SEQ ID NO: 47921 - protein, 25 aa, synthetic construct
  source 1..25: note = Seed: QTVHSIPLTINKEEALQRPVASDFE
QTVHSIPLTINKEYALARTVADDFE

SEQ ID NO: 47922 - protein, 25 aa, synthetic construct
  source 1..25: note = Seed: QTVHSIPLTINKEEALQRPVASDFE
QTVHSIPLTINKEYALARTVAEDFE

SEQ ID NO: 47923 - protein, 25 aa, synthetic construct
  source 1..25: note = Seed: QTVHSIPLTINKEEALQRPVASDFE
QTVHSIPLTINKEYALARTVAFDFE

SEQ ID NO: 47924 - protein, 25 aa, synthetic construct
  source 1..25: note = Seed: QTVHSIPLTINKEEALQRPVASDFE
QTVHSIPLTINKEYALARTVAGDFE

SEQ ID NO: 47925 - protein, 25 aa, synthetic construct
  source 1..25: note = Seed: QTVHSIPLTINKEEALQRPVASDFE
QTVHSIPLTINKEYALARTVAHDFE

SEQ ID NO: 47926 - protein, 25 aa, synthetic construct
  source 1..25: note = Seed: QTVHSIPLTINKEEALQRPVASDFE
QTVHSIPLTINKEYALARTVAIDFE

SEQ ID NO: 47927 - protein, 25 aa, synthetic construct
  source 1..25: note = Seed: QTVHSIPLTINKEEALQRPVASDFE
QTVHSIPLTINKEYALARTVAKDFE

SEQ ID NO: 47928 - protein, 25 aa, synthetic construct
  source 1..25: note = Seed: QTVHSIPLTINKEEALQRPVASDFE
QTVHSIPLTINKEYALARTVALDFE

SEQ ID NO: 47929 - protein, 25 aa, synthetic construct
  source 1..25: note = Seed: QTVHSIPLTINKEEALQRPVASDFE
QTVHSIPLTINKEYALARTVAMDFE

SEQ ID NO: 47930 - protein, 25 aa, synthetic construct
  source 1..25: note = Seed: QTVHSIPLTINKEEALQRPVASDFE
QTVHSIPLTINKEYALARTVANDFE

SEQ ID NO: 47931 - protein, 25 aa, synthetic construct
  source 1..25: note = Seed: QTVHSIPLTINKEEALQRPVASDFE
QTVHSIPLTINKEYALARTVAPDFE

SEQ ID NO: 47932 - protein, 25 aa, synthetic construct
  source 1..25: note = Seed: QTVHSIPLTINKEEALQRPVASDFE
QTVHSIPLTINKEYALARTVAQDFE

SEQ ID NO: 47933 - protein, 25 aa, synthetic construct
  source 1..25: note = Seed: QTVHSIPLTINKEEALQRPVASDFE
QTVHSIPLTINKEYALARTVARDFE

SEQ ID NO: 47934 - protein, 25 aa, synthetic construct
  source 1..25: note = Seed: QTVHSIPLTINKEEALQRPVASDFE
QTVHSIPLTINKEYALARTVASDFE

SEQ ID NO: 47935 - protein, 25 aa, synthetic construct
  source 1..25: note = Seed: QTVHSIPLTINKEEALQRPVASDFE
QTVHSIPLTINKEYALARTVATDFE

SEQ ID NO: 47936 - protein, 25 aa, synthetic construct
  source 1..25: note = Seed: QTVHSIPLTINKEEALQRPVASDFE
QTVHSIPLTINKEYALARTVAVDFE

SEQ ID NO: 47937 - protein, 25 aa, synthetic construct
  source 1..25: note = Seed: QTVHSIPLTINKEEALQRPVASDFE
QTVHSIPLTINKEYALARTVAYDFE

SEQ ID NO: 47938 - protein, 25 aa, synthetic construct
  source 1..25: note = Seed: QTVHSIPLTINKEEALQRPVASDFE
QTVHSIPLTINKEYALARVVAADFE

SEQ ID NO: 47939 - protein, 25 aa, synthetic construct
  source 1..25: note = Seed: QTVHSIPLTINKEEALQRPVASDFE
QTVHSIPLTINKEYALARVVADDFE

SEQ ID NO: 47940 - protein, 25 aa, synthetic construct
  source 1..25: note = Seed: QTVHSIPLTINKEEALQRPVASDFE
QTVHSIPLTINKEYALARVVAEDFE

SEQ ID NO: 47941 - protein, 25 aa, synthetic construct
  source 1..25: note = Seed: QTVHSIPLTINKEEALQRPVASDFE
QTVHSIPLTINKEYALARVVAGDFE

SEQ ID NO: 47942 - protein, 25 aa, synthetic construct
  source 1..25: note = Seed: QTVHSIPLTINKEEALQRPVASDFE
QTVHSIPLTINKEYALARVVAHDFE

SEQ ID NO: 47943 - protein, 25 aa, synthetic construct
  source 1..25: note = Seed: QTVHSIPLTINKEEALQRPVASDFE
QTVHSIPLTINKEYALARVVAIDFE

SEQ ID NO: 47944 - protein, 25 aa, synthetic construct
  source 1..25: note = Seed: QTVHSIPLTINKEEALQRPVASDFE
QTVHSIPLTINKEYALARVVAKDFE

SEQ ID NO: 47945 - protein, 25 aa, synthetic construct
  source 1..25: note = Seed: QTVHSIPLTINKEEALQRPVASDFE
QTVHSIPLTINKEYALARVVALDFE

SEQ ID NO: 47946 - protein, 25 aa, synthetic construct
  source 1..25: note = Seed: QTVHSIPLTINKEEALQRPVASDFE
QTVHSIPLTINKEYALARVVAMDFE

SEQ ID NO: 47947 - protein, 25 aa, synthetic construct
  source 1..25: note = Seed: QTVHSIPLTINKEEALQRPVASDFE
QTVHSIPLTINKEYALARVVANDFE

SEQ ID NO: 47948 - protein, 25 aa, synthetic construct
  source 1..25: note = Seed: QTVHSIPLTINKEEALQRPVASDFE
QTVHSIPLTINKEYALARVVAPDFE

SEQ ID NO: 47949 - protein, 25 aa, synthetic construct
  source 1..25: note = Seed: QTVHSIPLTINKEEALQRPVASDFE
QTVHSIPLTINKEYALARVVAQDFE

SEQ ID NO: 47950 - protein, 25 aa, synthetic construct
  source 1..25: note = Seed: QTVHSIPLTINKEEALQRPVASDFE
QTVHSIPLTINKEYALARVVARDFE

SEQ ID NO: 47951 - protein, 25 aa, synthetic construct
  source 1..25: note = Seed: QTVHSIPLTINKEEALQRPVASDFE
QTVHSIPLTINKEYALARVVASDFE

SEQ ID NO: 47952 - protein, 25 aa, synthetic construct
  source 1..25: note = Seed: QTVHSIPLTINKEEALQRPVASDFE
QTVHSIPLTINKEYALARVVATDFE

SEQ ID NO: 47953 - protein, 25 aa, synthetic construct
  source 1..25: note = Seed: QTVHSIPLTINKEEALQRPVASDFE
QTVHSIPLTINKEYALARVVAVDFE

SEQ ID NO: 47954 - protein, 25 aa, synthetic construct
  source 1..25: note = Seed: QTVHSIPLTINKEEALQRPVASDFE
QTVHSIPLTINKEYALARVVAYDFE

SEQ ID NO: 47955 - protein, 25 aa, synthetic construct
  source 1..25: note = Seed: QTVHSIPLTINKEEALQRPVASDFE
QTVHSIPLTINKEYALARWVAADFE

SEQ ID NO: 47956 - protein, 25 aa, synthetic construct
  source 1..25: note = Seed: QTVHSIPLTINKEEALQRPVASDFE
QTVHSIPLTINKEYALARWVANDFE

SEQ ID NO: 47957 - protein, 25 aa, synthetic construct
  source 1..25: note = Seed: QTVHSIPLTINKEEALQRPVASDFE
QTVHSIPLTINKEYALARWVASDFE

SEQ ID NO: 47958 - protein, 25 aa, synthetic construct
  source 1..25: note = Seed: QTVHSIPLTINKEEALQRPVASDFE
QTVHSIPLTINKEYALARYVAADFE

SEQ ID NO: 47959 - protein, 25 aa, synthetic construct
  source 1..25: note = Seed: QTVHSIPLTINKEEALQRPVASDFE
QTVHSIPLTINKEYALCRAVAADFE

SEQ ID NO: 47960 - protein, 25 aa, synthetic construct
  source 1..25: note = Seed: QTVHSIPLTINKEEALQRPVASDFE
QTVHSIPLTINKEYALCRAVAIDFE

SEQ ID NO: 47961 - protein, 25 aa, synthetic construct
  source 1..25: note = Seed: QTVHSIPLTINKEEALQRPVASDFE
QTVHSIPLTINKEYALCRAVALDFE

SEQ ID NO: 47962 - protein, 25 aa, synthetic construct
  source 1..25: note = Seed: QTVHSIPLTINKEEALQRPVASDFE
QTVHSIPLTINKEYALCRAVAMDFE

SEQ ID NO: 47963 - protein, 25 aa, synthetic construct
  source 1..25: note = Seed: QTVHSIPLTINKEEALQRPVASDFE
QTVHSIPLTINKEYALCRAVANDFE

SEQ ID NO: 47964 - protein, 25 aa, synthetic construct
  source 1..25: note = Seed: QTVHSIPLTINKEEALQRPVASDFE
QTVHSIPLTINKEYALCRAVASDFE

SEQ ID NO: 47965 - protein, 25 aa, synthetic construct
  source 1..25: note = Seed: QTVHSIPLTINKEEALQRPVASDFE
QTVHSIPLTINKEYALCRAVATDFE

SEQ ID NO: 47966 - protein, 25 aa, synthetic construct
  source 1..25: note = Seed: QTVHSIPLTINKEEALQRPVASDFE
QTVHSIPLTINKEYALCRAVAVDFE

SEQ ID NO: 47967 - protein, 25 aa, synthetic construct
  source 1..25: note = Seed: QTVHSIPLTINKEEALQRPVASDFE
QTVHSIPLTINKEYALCRPVAADFE

SEQ ID NO: 47968 - protein, 25 aa, synthetic construct
  source 1..25: note = Seed: QTVHSIPLTINKEEALQRPVASDFE
QTVHSIPLTINKEYALCRPVANDFE

SEQ ID NO: 47969 - protein, 25 aa, synthetic construct
  source 1..25: note = Seed: QTVHSIPLTINKEEALQRPVASDFE
QTVHSIPLTINKEYALCRPVASDFE

SEQ ID NO: 47970 - protein, 25 aa, synthetic construct
  source 1..25: note = Seed: QTVHSIPLTINKEEALQRPVASDFE
QTVHSIPLTINKEYALCRSVAADFE

SEQ ID NO: 47971 - protein, 25 aa, synthetic construct
  source 1..25: note = Seed: QTVHSIPLTINKEEALQRPVASDFE
QTVHSIPLTINKEYALCRSVANDFE

SEQ ID NO: 47972 - protein, 25 aa, synthetic construct
  source 1..25: note = Seed: QTVHSIPLTINKEEALQRPVASDFE
QTVHSIPLTINKEYALCRSVASDFE

SEQ ID NO: 47973 - protein, 25 aa, synthetic construct
  source 1..25: note = Seed: QTVHSIPLTINKEEALQRPVASDFE
QTVHSIPLTINKEYALCRSVAVDFE

SEQ ID NO: 47974 - protein, 25 aa, synthetic construct
  source 1..25: note = Seed: QTVHSIPLTINKEEALQRPVASDFE
QTVHSIPLTINKEYALCRTVAADFE

SEQ ID NO: 47975 - protein, 25 aa, synthetic construct
  source 1..25: note = Seed: QTVHSIPLTINKEEALQRPVASDFE
QTVHSIPLTINKEYALCRTVANDFE

SEQ ID NO: 47976 - protein, 25 aa, synthetic construct
  source 1..25: note = Seed: QTVHSIPLTINKEEALQRPVASDFE
QTVHSIPLTINKEYALCRTVASDFE

SEQ ID NO: 47977 - protein, 25 aa, synthetic construct
  source 1..25: note = Seed: QTVHSIPLTINKEEALQRPVASDFE
QTVHSIPLTINKEYALCRVVAADFE

SEQ ID NO: 47978 - protein, 25 aa, synthetic construct
  source 1..25: note = Seed: QTVHSIPLTINKEEALQRPVASDFE
QTVHSIPLTINKEYALCRVVANDFE

SEQ ID NO: 47979 - protein, 25 aa, synthetic construct
  source 1..25: note = Seed: QTVHSIPLTINKEEALQRPVASDFE
QTVHSIPLTINKEYALCRVVASDFE

SEQ ID NO: 47980 - protein, 25 aa, synthetic construct
  source 1..25: note = Seed: QTVHSIPLTINKEEALQRPVASDFE
QTVHSIPLTINKEYALDRAVAADFE

SEQ ID NO: 47981 - protein, 25 aa, synthetic construct
  source 1..25: note = Seed: QTVHSIPLTINKEEALQRPVASDFE
QTVHSIPLTINKEYALDRAVASDFE

SEQ ID NO: 47982 - protein, 25 aa, synthetic construct
  source 1..25: note = Seed: QTVHSIPLTINKEEALQRPVASDFE
QTVHSIPLTINKEYALERAVAADFE

SEQ ID NO: 47983 - protein, 25 aa, synthetic construct
  source 1..25: note = Seed: QTVHSIPLTINKEEALQRPVASDFE
QTVHSIPLTINKEYALERAVAGDFE

SEQ ID NO: 47984 - protein, 25 aa, synthetic construct
  source 1..25: note = Seed: QTVHSIPLTINKEEALQRPVASDFE
QTVHSIPLTINKEYALERAVAHDFE

SEQ ID NO: 47985 - protein, 25 aa, synthetic construct
  source 1..25: note = Seed: QTVHSIPLTINKEEALQRPVASDFE
QTVHSIPLTINKEYALERAVAIDFE

SEQ ID NO: 47986 - protein, 25 aa, synthetic construct
  source 1..25: note = Seed: QTVHSIPLTINKEEALQRPVASDFE
QTVHSIPLTINKEYALERAVALDFE

SEQ ID NO: 47987 - protein, 25 aa, synthetic construct
  source 1..25: note = Seed: QTVHSIPLTINKEEALQRPVASDFE
QTVHSIPLTINKEYALERAVAMDFE

SEQ ID NO: 47988 - protein, 25 aa, synthetic construct
  source 1..25: note = Seed: QTVHSIPLTINKEEALQRPVASDFE
QTVHSIPLTINKEYALERAVANDFE

SEQ ID NO: 47989 - protein, 25 aa, synthetic construct
  source 1..25: note = Seed: QTVHSIPLTINKEEALQRPVASDFE
QTVHSIPLTINKEYALERAVAQDFE

SEQ ID NO: 47990 - protein, 25 aa, synthetic construct
  source 1..25: note = Seed: QTVHSIPLTINKEEALQRPVASDFE
QTVHSIPLTINKEYALERAVASDFE

SEQ ID NO: 47991 - protein, 25 aa, synthetic construct
  source 1..25: note = Seed: QTVHSIPLTINKEEALQRPVASDFE
QTVHSIPLTINKEYALERAVATDFE

SEQ ID NO: 47992 - protein, 25 aa, synthetic construct
  source 1..25: note = Seed: QTVHSIPLTINKEEALQRPVASDFE
QTVHSIPLTINKEYALERAVAVDFE

SEQ ID NO: 47993 - protein, 25 aa, synthetic construct
  source 1..25: note = Seed: QTVHSIPLTINKEEALQRPVASDFE
QTVHSIPLTINKEYALERGVAADFE

SEQ ID NO: 47994 - protein, 25 aa, synthetic construct
  source 1..25: note = Seed: QTVHSIPLTINKEEALQRPVASDFE
QTVHSIPLTINKEYALERGVANDFE

SEQ ID NO: 47995 - protein, 25 aa, synthetic construct
  source 1..25: note = Seed: QTVHSIPLTINKEEALQRPVASDFE
QTVHSIPLTINKEYALERGVASDFE

SEQ ID NO: 47996 - protein, 25 aa, synthetic construct
  source 1..25: note = Seed: QTVHSIPLTINKEEALQRPVASDFE
QTVHSIPLTINKEYALERGVATDFE

SEQ ID NO: 47997 - protein, 25 aa, synthetic construct
  source 1..25: note = Seed: QTVHSIPLTINKEEALQRPVASDFE
QTVHSIPLTINKEYALERGVAVDFE

SEQ ID NO: 47998 - protein, 25 aa, synthetic construct
  source 1..25: note = Seed: QTVHSIPLTINKEEALQRPVASDFE
QTVHSIPLTINKEYALERIVAADFE

SEQ ID NO: 47999 - protein, 25 aa, synthetic construct
  source 1..25: note = Seed: QTVHSIPLTINKEEALQRPVASDFE
QTVHSIPLTINKEYALERIVANDFE

SEQ ID NO: 48000 - protein, 25 aa, synthetic construct
  source 1..25: note = Seed: QTVHSIPLTINKEEALQRPVASDFE
QTVHSIPLTINKEYALERIVASDFE

SEQ ID NO: 48001 - protein, 25 aa, synthetic construct
  source 1..25: note = Seed: QTVHSIPLTINKEEALQRPVASDFE
QTVHSIPLTINKEYALERIVATDFE

SEQ ID NO: 48002 - protein, 25 aa, synthetic construct
  source 1..25: note = Seed: QTVHSIPLTINKEEALQRPVASDFE
QTVHSIPLTINKEYALERNVAADFE

SEQ ID NO: 48003 - protein, 25 aa, synthetic construct
  source 1..25: note = Seed: QTVHSIPLTINKEEALQRPVASDFE
QTVHSIPLTINKEYALERNVANDFE

SEQ ID NO: 48004 - protein, 25 aa, synthetic construct
  source 1..25: note = Seed: QTVHSIPLTINKEEALQRPVASDFE
QTVHSIPLTINKEYALERNVASDFE

SEQ ID NO: 48005 - protein, 25 aa, synthetic construct
  source 1..25: note = Seed: QTVHSIPLTINKEEALQRPVASDFE
QTVHSIPLTINKEYALERPVAADFE

SEQ ID NO: 48006 - protein, 25 aa, synthetic construct
  source 1..25: note = Seed: QTVHSIPLTINKEEALQRPVASDFE
QTVHSIPLTINKEYALERPVAGDFE

SEQ ID NO: 48007 - protein, 25 aa, synthetic construct
  source 1..25: note = Seed: QTVHSIPLTINKEEALQRPVASDFE
QTVHSIPLTINKEYALERPVAHDFE

SEQ ID NO: 48008 - protein, 25 aa, synthetic construct
  source 1..25: note = Seed: QTVHSIPLTINKEEALQRPVASDFE
QTVHSIPLTINKEYALERPVAIDFE

SEQ ID NO: 48009 - protein, 25 aa, synthetic construct
  source 1..25: note = Seed: QTVHSIPLTINKEEALQRPVASDFE
QTVHSIPLTINKEYALERPVALDFE

SEQ ID NO: 48010 - protein, 25 aa, synthetic construct
  source 1..25: note = Seed: QTVHSIPLTINKEEALQRPVASDFE
QTVHSIPLTINKEYALERPVAMDFE

SEQ ID NO: 48011 - protein, 25 aa, synthetic construct
  source 1..25: note = Seed: QTVHSIPLTINKEEALQRPVASDFE
QTVHSIPLTINKEYALERPVANDFE

SEQ ID NO: 48012 - protein, 25 aa, synthetic construct
  source 1..25: note = Seed: QTVHSIPLTINKEEALQRPVASDFE
QTVHSIPLTINKEYALERPVASDFE

SEQ ID NO: 48013 - protein, 25 aa, synthetic construct
  source 1..25: note = Seed: QTVHSIPLTINKEEALQRPVASDFE
QTVHSIPLTINKEYALERPVATDFE

SEQ ID NO: 48014 - protein, 25 aa, synthetic construct
  source 1..25: note = Seed: QTVHSIPLTINKEEALQRPVASDFE
QTVHSIPLTINKEYALERPVAVDFE

SEQ ID NO: 48015 - protein, 25 aa, synthetic construct
  source 1..25: note = Seed: QTVHSIPLTINKEEALQRPVASDFE
QTVHSIPLTINKEYALERSVAADFE

SEQ ID NO: 48016 - protein, 25 aa, synthetic construct
  source 1..25: note = Seed: QTVHSIPLTINKEEALQRPVASDFE
QTVHSIPLTINKEYALERSVAGDFE

SEQ ID NO: 48017 - protein, 25 aa, synthetic construct
  source 1..25: note = Seed: QTVHSIPLTINKEEALQRPVASDFE
QTVHSIPLTINKEYALERSVAIDFE

SEQ ID NO: 48018 - protein, 25 aa, synthetic construct
  source 1..25: note = Seed: QTVHSIPLTINKEEALQRPVASDFE
QTVHSIPLTINKEYALERSVALDFE

SEQ ID NO: 48019 - protein, 25 aa, synthetic construct
  source 1..25: note = Seed: QTVHSIPLTINKEEALQRPVASDFE
QTVHSIPLTINKEYALERSVAMDFE

SEQ ID NO: 48020 - protein, 25 aa, synthetic construct
  source 1..25: note = Seed: QTVHSIPLTINKEEALQRPVASDFE
QTVHSIPLTINKEYALERSVANDFE

SEQ ID NO: 48021 - protein, 25 aa, synthetic construct
  source 1..25: note = Seed: QTVHSIPLTINKEEALQRPVASDFE
QTVHSIPLTINKEYALERSVASDFE

SEQ ID NO: 48022 - protein, 25 aa, synthetic construct
  source 1..25: note = Seed: QTVHSIPLTINKEEALQRPVASDFE
QTVHSIPLTINKEYALERSVATDFE

SEQ ID NO: 48023 - protein, 25 aa, synthetic construct
  source 1..25: note = Seed: QTVHSIPLTINKEEALQRPVASDFE
QTVHSIPLTINKEYALERSVAVDFE

SEQ ID NO: 48024 - protein, 25 aa, synthetic construct
  source 1..25: note = Seed: QTVHSIPLTINKEEALQRPVASDFE
QTVHSIPLTINKEYALERTVAADFE

SEQ ID NO: 48025 - protein, 25 aa, synthetic construct
  source 1..25: note = Seed: QTVHSIPLTINKEEALQRPVASDFE
QTVHSIPLTINKEYALERTVAGDFE

SEQ ID NO: 48026 - protein, 25 aa, synthetic construct
  source 1..25: note = Seed: QTVHSIPLTINKEEALQRPVASDFE
QTVHSIPLTINKEYALERTVAIDFE

SEQ ID NO: 48027 - protein, 25 aa, synthetic construct
  source 1..25: note = Seed: QTVHSIPLTINKEEALQRPVASDFE
QTVHSIPLTINKEYALERTVALDFE

SEQ ID NO: 48028 - protein, 25 aa, synthetic construct
  source 1..25: note = Seed: QTVHSIPLTINKEEALQRPVASDFE
QTVHSIPLTINKEYALERTVAMDFE

SEQ ID NO: 48029 - protein, 25 aa, synthetic construct
  source 1..25: note = Seed: QTVHSIPLTINKEEALQRPVASDFE
QTVHSIPLTINKEYALERTVANDFE

SEQ ID NO: 48030 - protein, 25 aa, synthetic construct
  source 1..25: note = Seed: QTVHSIPLTINKEEALQRPVASDFE
QTVHSIPLTINKEYALERTVASDFE

SEQ ID NO: 48031 - protein, 25 aa, synthetic construct
  source 1..25: note = Seed: QTVHSIPLTINKEEALQRPVASDFE
QTVHSIPLTINKEYALERTVATDFE

SEQ ID NO: 48032 - protein, 25 aa, synthetic construct
  source 1..25: note = Seed: QTVHSIPLTINKEEALQRPVASDFE
QTVHSIPLTINKEYALERTVAVDFE

SEQ ID NO: 48033 - protein, 25 aa, synthetic construct
  source 1..25: note = Seed: QTVHSIPLTINKEEALQRPVASDFE
QTVHSIPLTINKEYALERVVAADFE

SEQ ID NO: 48034 - protein, 25 aa, synthetic construct
  source 1..25: note = Seed: QTVHSIPLTINKEEALQRPVASDFE
QTVHSIPLTINKEYALERVVAGDFE

SEQ ID NO: 48035 - protein, 25 aa, synthetic construct
  source 1..25: note = Seed: QTVHSIPLTINKEEALQRPVASDFE
QTVHSIPLTINKEYALERVVAHDFE

SEQ ID NO: 48036 - protein, 25 aa, synthetic construct
  source 1..25: note = Seed: QTVHSIPLTINKEEALQRPVASDFE
QTVHSIPLTINKEYALERVVANDFE

SEQ ID NO: 48037 - protein, 25 aa, synthetic construct
  source 1..25: note = Seed: QTVHSIPLTINKEEALQRPVASDFE
QTVHSIPLTINKEYALERVVASDFE

SEQ ID NO: 48038 - protein, 25 aa, synthetic construct
  source 1..25: note = Seed: QTVHSIPLTINKEEALQRPVASDFE
QTVHSIPLTINKEYALERVVATDFE

SEQ ID NO: 48039 - protein, 25 aa, synthetic construct
  source 1..25: note = Seed: QTVHSIPLTINKEEALQRPVASDFE
QTVHSIPLTINKEYALERVVAVDFE

SEQ ID NO: 48040 - protein, 25 aa, synthetic construct
  source 1..25: note = Seed: QTVHSIPLTINKEEALQRPVASDFE
QTVHSIPLTINKEYALFRAVAADFE

SEQ ID NO: 48041 - protein, 25 aa, synthetic construct
  source 1..25: note = Seed: QTVHSIPLTINKEEALQRPVASDFE
QTVHSIPLTINKEYALFRAVADDFE

SEQ ID NO: 48042 - protein, 25 aa, synthetic construct
  source 1..25: note = Seed: QTVHSIPLTINKEEALQRPVASDFE
QTVHSIPLTINKEYALFRAVAEDFE

SEQ ID NO: 48043 - protein, 25 aa, synthetic construct
  source 1..25: note = Seed: QTVHSIPLTINKEEALQRPVASDFE
QTVHSIPLTINKEYALFRAVAGDFE

SEQ ID NO: 48044 - protein, 25 aa, synthetic construct
  source 1..25: note = Seed: QTVHSIPLTINKEEALQRPVASDFE
QTVHSIPLTINKEYALFRAVAHDFE

SEQ ID NO: 48045 - protein, 25 aa, synthetic construct
  source 1..25: note = Seed: QTVHSIPLTINKEEALQRPVASDFE
QTVHSIPLTINKEYALFRAVAIDFE

SEQ ID NO: 48046 - protein, 25 aa, synthetic construct
  source 1..25: note = Seed: QTVHSIPLTINKEEALQRPVASDFE
QTVHSIPLTINKEYALFRAVALDFE

SEQ ID NO: 48047 - protein, 25 aa, synthetic construct
  source 1..25: note = Seed: QTVHSIPLTINKEEALQRPVASDFE
QTVHSIPLTINKEYALFRAVAMDFE

SEQ ID NO: 48048 - protein, 25 aa, synthetic construct
  source 1..25: note = Seed: QTVHSIPLTINKEEALQRPVASDFE
QTVHSIPLTINKEYALFRAVANDFE

SEQ ID NO: 48049 - protein, 25 aa, synthetic construct
  source 1..25: note = Seed: QTVHSIPLTINKEEALQRPVASDFE
QTVHSIPLTINKEYALFRAVAPDFE

SEQ ID NO: 48050 - protein, 25 aa, synthetic construct
  source 1..25: note = Seed: QTVHSIPLTINKEEALQRPVASDFE
QTVHSIPLTINKEYALFRAVAQDFE

SEQ ID NO: 48051 - protein, 25 aa, synthetic construct
  source 1..25: note = Seed: QTVHSIPLTINKEEALQRPVASDFE
QTVHSIPLTINKEYALFRAVASDFE

SEQ ID NO: 48052 - protein, 25 aa, synthetic construct
  source 1..25: note = Seed: QTVHSIPLTINKEEALQRPVASDFE
QTVHSIPLTINKEYALFRAVATDFE

SEQ ID NO: 48053 - protein, 25 aa, synthetic construct
  source 1..25: note = Seed: QTVHSIPLTINKEEALQRPVASDFE
QTVHSIPLTINKEYALFRAVAVDFE

SEQ ID NO: 48054 - protein, 25 aa, synthetic construct
  source 1..25: note = Seed: QTVHSIPLTINKEEALQRPVASDFE
QTVHSIPLTINKEYALFRGVAADFE

SEQ ID NO: 48055 - protein, 25 aa, synthetic construct
  source 1..25: note = Seed: QTVHSIPLTINKEEALQRPVASDFE
QTVHSIPLTINKEYALFRGVAGDFE

SEQ ID NO: 48056 - protein, 25 aa, synthetic construct
  source 1..25: note = Seed: QTVHSIPLTINKEEALQRPVASDFE
QTVHSIPLTINKEYALFRGVANDFE

SEQ ID NO: 48057 - protein, 25 aa, synthetic construct
  source 1..25: note = Seed: QTVHSIPLTINKEEALQRPVASDFE
QTVHSIPLTINKEYALFRGVASDFE

SEQ ID NO: 48058 - protein, 25 aa, synthetic construct
  source 1..25: note = Seed: QTVHSIPLTINKEEALQRPVASDFE
QTVHSIPLTINKEYALFRGVATDFE

SEQ ID NO: 48059 - protein, 25 aa, synthetic construct
  source 1..25: note = Seed: QTVHSIPLTINKEEALQRPVASDFE
QTVHSIPLTINKEYALFRGVAVDFE

SEQ ID NO: 48060 - protein, 25 aa, synthetic construct
  source 1..25: note = Seed: QTVHSIPLTINKEEALQRPVASDFE
QTVHSIPLTINKEYALFRIVANDFE

SEQ ID NO: 48061 - protein, 25 aa, synthetic construct
  source 1..25: note = Seed: QTVHSIPLTINKEEALQRPVASDFE
QTVHSIPLTINKEYALFRNVAADFE

SEQ ID NO: 48062 - protein, 25 aa, synthetic construct
  source 1..25: note = Seed: QTVHSIPLTINKEEALQRPVASDFE
QTVHSIPLTINKEYALFRNVAGDFE

SEQ ID NO: 48063 - protein, 25 aa, synthetic construct
  source 1..25: note = Seed: QTVHSIPLTINKEEALQRPVASDFE
QTVHSIPLTINKEYALFRNVANDFE

SEQ ID NO: 48064 - protein, 25 aa, synthetic construct
  source 1..25: note = Seed: QTVHSIPLTINKEEALQRPVASDFE
QTVHSIPLTINKEYALFRNVASDFE

SEQ ID NO: 48065 - protein, 25 aa, synthetic construct
  source 1..25: note = Seed: QTVHSIPLTINKEEALQRPVASDFE
QTVHSIPLTINKEYALFRNVATDFE

SEQ ID NO: 48066 - protein, 25 aa, synthetic construct
  source 1..25: note = Seed: QTVHSIPLTINKEEALQRPVASDFE
QTVHSIPLTINKEYALFRNVAVDFE

SEQ ID NO: 48067 - protein, 25 aa, synthetic construct
  source 1..25: note = Seed: QTVHSIPLTINKEEALQRPVASDFE
QTVHSIPLTINKEYALFRPVAADFE

SEQ ID NO: 48068 - protein, 25 aa, synthetic construct
  source 1..25: note = Seed: QTVHSIPLTINKEEALQRPVASDFE
QTVHSIPLTINKEYALFRPVADDFE

SEQ ID NO: 48069 - protein, 25 aa, synthetic construct
  source 1..25: note = Seed: QTVHSIPLTINKEEALQRPVASDFE
QTVHSIPLTINKEYALFRPVAGDFE

SEQ ID NO: 48070 - protein, 25 aa, synthetic construct
  source 1..25: note = Seed: QTVHSIPLTINKEEALQRPVASDFE
QTVHSIPLTINKEYALFRPVAHDFE

SEQ ID NO: 48071 - protein, 25 aa, synthetic construct
  source 1..25: note = Seed: QTVHSIPLTINKEEALQRPVASDFE
QTVHSIPLTINKEYALFRPVAIDFE

SEQ ID NO: 48072 - protein, 25 aa, synthetic construct
  source 1..25: note = Seed: QTVHSIPLTINKEEALQRPVASDFE
QTVHSIPLTINKEYALFRPVALDFE

SEQ ID NO: 48073 - protein, 25 aa, synthetic construct
  source 1..25: note = Seed: QTVHSIPLTINKEEALQRPVASDFE
QTVHSIPLTINKEYALFRPVAMDFE

SEQ ID NO: 48074 - protein, 25 aa, synthetic construct
  source 1..25: note = Seed: QTVHSIPLTINKEEALQRPVASDFE
QTVHSIPLTINKEYALFRPVANDFE

SEQ ID NO: 48075 - protein, 25 aa, synthetic construct
  source 1..25: note = Seed: QTVHSIPLTINKEEALQRPVASDFE
QTVHSIPLTINKEYALFRPVAPDFE

SEQ ID NO: 48076 - protein, 25 aa, synthetic construct
  source 1..25: note = Seed: QTVHSIPLTINKEEALQRPVASDFE
QTVHSIPLTINKEYALFRPVAQDFE

SEQ ID NO: 48077 - protein, 25 aa, synthetic construct
  source 1..25: note = Seed: QTVHSIPLTINKEEALQRPVASDFE
QTVHSIPLTINKEYALFRPVASDFE

SEQ ID NO: 48078 - protein, 25 aa, synthetic construct
  source 1..25: note = Seed: QTVHSIPLTINKEEALQRPVASDFE
QTVHSIPLTINKEYALFRPVATDFE

SEQ ID NO: 48079 - protein, 25 aa, synthetic construct
  source 1..25: note = Seed: QTVHSIPLTINKEEALQRPVASDFE
QTVHSIPLTINKEYALFRPVAVDFE

SEQ ID NO: 48080 - protein, 25 aa, synthetic construct
  source 1..25: note = Seed: QTVHSIPLTINKEEALQRPVASDFE
QTVHSIPLTINKEYALFRSVAADFE

SEQ ID NO: 48081 - protein, 25 aa, synthetic construct
  source 1..25: note = Seed: QTVHSIPLTINKEEALQRPVASDFE
QTVHSIPLTINKEYALFRSVAGDFE

SEQ ID NO: 48082 - protein, 25 aa, synthetic construct
  source 1..25: note = Seed: QTVHSIPLTINKEEALQRPVASDFE
QTVHSIPLTINKEYALFRSVAHDFE

SEQ ID NO: 48083 - protein, 25 aa, synthetic construct
  source 1..25: note = Seed: QTVHSIPLTINKEEALQRPVASDFE
QTVHSIPLTINKEYALFRSVAIDFE

SEQ ID NO: 48084 - protein, 25 aa, synthetic construct
  source 1..25: note = Seed: QTVHSIPLTINKEEALQRPVASDFE
QTVHSIPLTINKEYALFRSVALDFE

SEQ ID NO: 48085 - protein, 25 aa, synthetic construct
  source 1..25: note = Seed: QTVHSIPLTINKEEALQRPVASDFE
QTVHSIPLTINKEYALFRSVAMDFE

SEQ ID NO: 48086 - protein, 25 aa, synthetic construct
  source 1..25: note = Seed: QTVHSIPLTINKEEALQRPVASDFE
QTVHSIPLTINKEYALFRSVANDFE

SEQ ID NO: 48087 - protein, 25 aa, synthetic construct
  source 1..25: note = Seed: QTVHSIPLTINKEEALQRPVASDFE
QTVHSIPLTINKEYALFRSVASDFE

SEQ ID NO: 48088 - protein, 25 aa, synthetic construct
  source 1..25: note = Seed: QTVHSIPLTINKEEALQRPVASDFE
QTVHSIPLTINKEYALFRSVATDFE

SEQ ID NO: 48089 - protein, 25 aa, synthetic construct
  source 1..25: note = Seed: QTVHSIPLTINKEEALQRPVASDFE
QTVHSIPLTINKEYALFRSVAVDFE

SEQ ID NO: 48090 - protein, 25 aa, synthetic construct
  source 1..25: note = Seed: QTVHSIPLTINKEEALQRPVASDFE
QTVHSIPLTINKEYALFRTVAADFE

SEQ ID NO: 48091 - protein, 25 aa, synthetic construct
  source 1..25: note = Seed: QTVHSIPLTINKEEALQRPVASDFE
QTVHSIPLTINKEYALFRTVAGDFE

SEQ ID NO: 48092 - protein, 25 aa, synthetic construct
  source 1..25: note = Seed: QTVHSIPLTINKEEALQRPVASDFE
QTVHSIPLTINKEYALFRTVAHDFE

SEQ ID NO: 48093 - protein, 25 aa, synthetic construct
  source 1..25: note = Seed: QTVHSIPLTINKEEALQRPVASDFE
QTVHSIPLTINKEYALFRTVAIDFE

SEQ ID NO: 48094 - protein, 25 aa, synthetic construct
  source 1..25: note = Seed: QTVHSIPLTINKEEALQRPVASDFE
QTVHSIPLTINKEYALFRTVALDFE

SEQ ID NO: 48095 - protein, 25 aa, synthetic construct
  source 1..25: note = Seed: QTVHSIPLTINKEEALQRPVASDFE
QTVHSIPLTINKEYALFRTVAMDFE

SEQ ID NO: 48096 - protein, 25 aa, synthetic construct
  source 1..25: note = Seed: QTVHSIPLTINKEEALQRPVASDFE
QTVHSIPLTINKEYALFRTVANDFE

SEQ ID NO: 48097 - protein, 25 aa, synthetic construct
  source 1..25: note = Seed: QTVHSIPLTINKEEALQRPVASDFE
QTVHSIPLTINKEYALFRTVAQDFE

SEQ ID NO: 48098 - protein, 25 aa, synthetic construct
  source 1..25: note = Seed: QTVHSIPLTINKEEALQRPVASDFE
QTVHSIPLTINKEYALFRTVASDFE

SEQ ID NO: 48099 - protein, 25 aa, synthetic construct
  source 1..25: note = Seed: QTVHSIPLTINKEEALQRPVASDFE
QTVHSIPLTINKEYALFRTVATDFE

SEQ ID NO: 48100 - protein, 25 aa, synthetic construct
  source 1..25: note = Seed: QTVHSIPLTINKEEALQRPVASDFE
QTVHSIPLTINKEYALFRTVAVDFE

SEQ ID NO: 48101 - protein, 25 aa, synthetic construct
  source 1..25: note = Seed: QTVHSIPLTINKEEALQRPVASDFE
QTVHSIPLTINKEYALFRVVAADFE

SEQ ID NO: 48102 - protein, 25 aa, synthetic construct
  source 1..25: note = Seed: QTVHSIPLTINKEEALQRPVASDFE
QTVHSIPLTINKEYALFRVVAHDFE

SEQ ID NO: 48103 - protein, 25 aa, synthetic construct
  source 1..25: note = Seed: QTVHSIPLTINKEEALQRPVASDFE
QTVHSIPLTINKEYALFRVVANDFE

SEQ ID NO: 48104 - protein, 25 aa, synthetic construct
  source 1..25: note = Seed: QTVHSIPLTINKEEALQRPVASDFE
QTVHSIPLTINKEYALFRVVASDFE

SEQ ID NO: 48105 - protein, 25 aa, synthetic construct
  source 1..25: note = Seed: QTVHSIPLTINKEEALQRPVASDFE
QTVHSIPLTINKEYALGRAVAADFE

SEQ ID NO: 48106 - protein, 25 aa, synthetic construct
  source 1..25: note = Seed: QTVHSIPLTINKEEALQRPVASDFE
QTVHSIPLTINKEYALGRAVAHDFE

SEQ ID NO: 48107 - protein, 25 aa, synthetic construct
  source 1..25: note = Seed: QTVHSIPLTINKEEALQRPVASDFE
QTVHSIPLTINKEYALGRAVAIDFE

SEQ ID NO: 48108 - protein, 25 aa, synthetic construct
  source 1..25: note = Seed: QTVHSIPLTINKEEALQRPVASDFE
QTVHSIPLTINKEYALGRAVALDFE

SEQ ID NO: 48109 - protein, 25 aa, synthetic construct
  source 1..25: note = Seed: QTVHSIPLTINKEEALQRPVASDFE
QTVHSIPLTINKEYALGRAVAMDFE

SEQ ID NO: 48110 - protein, 25 aa, synthetic construct
  source 1..25: note = Seed: QTVHSIPLTINKEEALQRPVASDFE
QTVHSIPLTINKEYALGRAVANDFE

SEQ ID NO: 48111 - protein, 25 aa, synthetic construct
  source 1..25: note = Seed: QTVHSIPLTINKEEALQRPVASDFE
QTVHSIPLTINKEYALGRAVAQDFE

SEQ ID NO: 48112 - protein, 25 aa, synthetic construct
  source 1..25: note = Seed: QTVHSIPLTINKEEALQRPVASDFE
QTVHSIPLTINKEYALGRAVASDFE

SEQ ID NO: 48113 - protein, 25 aa, synthetic construct
  source 1..25: note = Seed: QTVHSIPLTINKEEALQRPVASDFE
QTVHSIPLTINKEYALGRAVATDFE

SEQ ID NO: 48114 - protein, 25 aa, synthetic construct
  source 1..25: note = Seed: QTVHSIPLTINKEEALQRPVASDFE
QTVHSIPLTINKEYALGRAVAVDFE

SEQ ID NO: 48115 - protein, 25 aa, synthetic construct
  source 1..25: note = Seed: QTVHSIPLTINKEEALQRPVASDFE
QTVHSIPLTINKEYALGRIVAADFE

SEQ ID NO: 48116 - protein, 25 aa, synthetic construct
  source 1..25: note = Seed: QTVHSIPLTINKEEALQRPVASDFE
QTVHSIPLTINKEYALGRIVANDFE

SEQ ID NO: 48117 - protein, 25 aa, synthetic construct
  source 1..25: note = Seed: QTVHSIPLTINKEEALQRPVASDFE
QTVHSIPLTINKEYALGRIVASDFE

SEQ ID NO: 48118 - protein, 25 aa, synthetic construct
  source 1..25: note = Seed: QTVHSIPLTINKEEALQRPVASDFE
QTVHSIPLTINKEYALGRNVAADFE

SEQ ID NO: 48119 - protein, 25 aa, synthetic construct
  source 1..25: note = Seed: QTVHSIPLTINKEEALQRPVASDFE
QTVHSIPLTINKEYALGRNVANDFE

SEQ ID NO: 48120 - protein, 25 aa, synthetic construct
  source 1..25: note = Seed: QTVHSIPLTINKEEALQRPVASDFE
QTVHSIPLTINKEYALGRPVAADFE

SEQ ID NO: 48121 - protein, 25 aa, synthetic construct
  source 1..25: note = Seed: QTVHSIPLTINKEEALQRPVASDFE
QTVHSIPLTINKEYALGRPVAIDFE

SEQ ID NO: 48122 - protein, 25 aa, synthetic construct
  source 1..25: note = Seed: QTVHSIPLTINKEEALQRPVASDFE
QTVHSIPLTINKEYALGRPVALDFE

SEQ ID NO: 48123 - protein, 25 aa, synthetic construct
  source 1..25: note = Seed: QTVHSIPLTINKEEALQRPVASDFE
QTVHSIPLTINKEYALGRPVAMDFE

SEQ ID NO: 48124 - protein, 25 aa, synthetic construct
  source 1..25: note = Seed: QTVHSIPLTINKEEALQRPVASDFE
QTVHSIPLTINKEYALGRPVANDFE

SEQ ID NO: 48125 - protein, 25 aa, synthetic construct
  source 1..25: note = Seed: QTVHSIPLTINKEEALQRPVASDFE
QTVHSIPLTINKEYALGRPVASDFE

SEQ ID NO: 48126 - protein, 25 aa, synthetic construct
  source 1..25: note = Seed: QTVHSIPLTINKEEALQRPVASDFE
QTVHSIPLTINKEYALGRPVAVDFE

SEQ ID NO: 48127 - protein, 25 aa, synthetic construct
  source 1..25: note = Seed: QTVHSIPLTINKEEALQRPVASDFE
QTVHSIPLTINKEYALGRSVAADFE

SEQ ID NO: 48128 - protein, 25 aa, synthetic construct
  source 1..25: note = Seed: QTVHSIPLTINKEEALQRPVASDFE
QTVHSIPLTINKEYALGRSVAIDFE

SEQ ID NO: 48129 - protein, 25 aa, synthetic construct
  source 1..25: note = Seed: QTVHSIPLTINKEEALQRPVASDFE
QTVHSIPLTINKEYALGRSVALDFE

SEQ ID NO: 48130 - protein, 25 aa, synthetic construct
  source 1..25: note = Seed: QTVHSIPLTINKEEALQRPVASDFE
QTVHSIPLTINKEYALGRSVAMDFE

SEQ ID NO: 48131 - protein, 25 aa, synthetic construct
  source 1..25: note = Seed: QTVHSIPLTINKEEALQRPVASDFE
QTVHSIPLTINKEYALGRSVANDFE

SEQ ID NO: 48132 - protein, 25 aa, synthetic construct
  source 1..25: note = Seed: QTVHSIPLTINKEEALQRPVASDFE
QTVHSIPLTINKEYALGRSVASDFE

SEQ ID NO: 48133 - protein, 25 aa, synthetic construct
  source 1..25: note = Seed: QTVHSIPLTINKEEALQRPVASDFE
QTVHSIPLTINKEYALGRSVATDFE

SEQ ID NO: 48134 - protein, 25 aa, synthetic construct
  source 1..25: note = Seed: QTVHSIPLTINKEEALQRPVASDFE
QTVHSIPLTINKEYALGRSVAVDFE

SEQ ID NO: 48135 - protein, 25 aa, synthetic construct
  source 1..25: note = Seed: QTVHSIPLTINKEEALQRPVASDFE
QTVHSIPLTINKEYALGRTVAADFE

SEQ ID NO: 48136 - protein, 25 aa, synthetic construct
  source 1..25: note = Seed: QTVHSIPLTINKEEALQRPVASDFE
QTVHSIPLTINKEYALGRTVAIDFE

SEQ ID NO: 48137 - protein, 25 aa, synthetic construct
  source 1..25: note = Seed: QTVHSIPLTINKEEALQRPVASDFE
QTVHSIPLTINKEYALGRTVALDFE

SEQ ID NO: 48138 - protein, 25 aa, synthetic construct
  source 1..25: note = Seed: QTVHSIPLTINKEEALQRPVASDFE
QTVHSIPLTINKEYALGRTVAMDFE

SEQ ID NO: 48139 - protein, 25 aa, synthetic construct
  source 1..25: note = Seed: QTVHSIPLTINKEEALQRPVASDFE
QTVHSIPLTINKEYALGRTVANDFE

SEQ ID NO: 48140 - protein, 25 aa, synthetic construct
  source 1..25: note = Seed: QTVHSIPLTINKEEALQRPVASDFE
QTVHSIPLTINKEYALGRTVASDFE

SEQ ID NO: 48141 - protein, 25 aa, synthetic construct
  source 1..25: note = Seed: QTVHSIPLTINKEEALQRPVASDFE
QTVHSIPLTINKEYALGRTVATDFE

SEQ ID NO: 48142 - protein, 25 aa, synthetic construct
  source 1..25: note = Seed: QTVHSIPLTINKEEALQRPVASDFE
QTVHSIPLTINKEYALGRTVAVDFE

SEQ ID NO: 48143 - protein, 25 aa, synthetic construct
  source 1..25: note = Seed: QTVHSIPLTINKEEALQRPVASDFE
QTVHSIPLTINKEYALGRVVAADFE

SEQ ID NO: 48144 - protein, 25 aa, synthetic construct
  source 1..25: note = Seed: QTVHSIPLTINKEEALQRPVASDFE
QTVHSIPLTINKEYALGRVVAIDFE

SEQ ID NO: 48145 - protein, 25 aa, synthetic construct
  source 1..25: note = Seed: QTVHSIPLTINKEEALQRPVASDFE
QTVHSIPLTINKEYALGRVVALDFE

SEQ ID NO: 48146 - protein, 25 aa, synthetic construct
  source 1..25: note = Seed: QTVHSIPLTINKEEALQRPVASDFE
QTVHSIPLTINKEYALGRVVAMDFE

SEQ ID NO: 48147 - protein, 25 aa, synthetic construct
  source 1..25: note = Seed: QTVHSIPLTINKEEALQRPVASDFE
QTVHSIPLTINKEYALGRVVANDFE

SEQ ID NO: 48148 - protein, 25 aa, synthetic construct
  source 1..25: note = Seed: QTVHSIPLTINKEEALQRPVASDFE
QTVHSIPLTINKEYALGRVVASDFE

SEQ ID NO: 48149 - protein, 25 aa, synthetic construct
  source 1..25: note = Seed: QTVHSIPLTINKEEALQRPVASDFE
QTVHSIPLTINKEYALGRVVATDFE

SEQ ID NO: 48150 - protein, 25 aa, synthetic construct
  source 1..25: note = Seed: QTVHSIPLTINKEEALQRPVASDFE
QTVHSIPLTINKEYALGRVVAVDFE

SEQ ID NO: 48151 - protein, 25 aa, synthetic construct
  source 1..25: note = Seed: QTVHSIPLTINKEEALQRPVASDFE
QTVHSIPLTINKEYALHRAVAADFE

SEQ ID NO: 48152 - protein, 25 aa, synthetic construct
  source 1..25: note = Seed: QTVHSIPLTINKEEALQRPVASDFE
QTVHSIPLTINKEYALHRAVAIDFE

SEQ ID NO: 48153 - protein, 25 aa, synthetic construct
  source 1..25: note = Seed: QTVHSIPLTINKEEALQRPVASDFE
QTVHSIPLTINKEYALHRAVALDFE

SEQ ID NO: 48154 - protein, 25 aa, synthetic construct
  source 1..25: note = Seed: QTVHSIPLTINKEEALQRPVASDFE
QTVHSIPLTINKEYALHRAVAMDFE

SEQ ID NO: 48155 - protein, 25 aa, synthetic construct
  source 1..25: note = Seed: QTVHSIPLTINKEEALQRPVASDFE
QTVHSIPLTINKEYALHRAVANDFE

SEQ ID NO: 48156 - protein, 25 aa, synthetic construct
  source 1..25: note = Seed: QTVHSIPLTINKEEALQRPVASDFE
QTVHSIPLTINKEYALHRAVASDFE

SEQ ID NO: 48157 - protein, 25 aa, synthetic construct
  source 1..25: note = Seed: QTVHSIPLTINKEEALQRPVASDFE
QTVHSIPLTINKEYALHRAVATDFE

SEQ ID NO: 48158 - protein, 25 aa, synthetic construct
  source 1..25: note = Seed: QTVHSIPLTINKEEALQRPVASDFE
QTVHSIPLTINKEYALHRAVAVDFE

SEQ ID NO: 48159 - protein, 25 aa, synthetic construct
  source 1..25: note = Seed: QTVHSIPLTINKEEALQRPVASDFE
QTVHSIPLTINKEYALHRGVAADFE

SEQ ID NO: 48160 - protein, 25 aa, synthetic construct
  source 1..25: note = Seed: QTVHSIPLTINKEEALQRPVASDFE
QTVHSIPLTINKEYALHRIVAADFE

SEQ ID NO: 48161 - protein, 25 aa, synthetic construct
  source 1..25: note = Seed: QTVHSIPLTINKEEALQRPVASDFE
QTVHSIPLTINKEYALHRIVANDFE

SEQ ID NO: 48162 - protein, 25 aa, synthetic construct
  source 1..25: note = Seed: QTVHSIPLTINKEEALQRPVASDFE
QTVHSIPLTINKEYALHRPVAADFE

SEQ ID NO: 48163 - protein, 25 aa, synthetic construct
  source 1..25: note = Seed: QTVHSIPLTINKEEALQRPVASDFE
QTVHSIPLTINKEYALHRPVANDFE

SEQ ID NO: 48164 - protein, 25 aa, synthetic construct
  source 1..25: note = Seed: QTVHSIPLTINKEEALQRPVASDFE
QTVHSIPLTINKEYALHRPVASDFE

SEQ ID NO: 48165 - protein, 25 aa, synthetic construct
  source 1..25: note = Seed: QTVHSIPLTINKEEALQRPVASDFE
QTVHSIPLTINKEYALHRSVAADFE

SEQ ID NO: 48166 - protein, 25 aa, synthetic construct
  source 1..25: note = Seed: QTVHSIPLTINKEEALQRPVASDFE
QTVHSIPLTINKEYALHRSVANDFE

SEQ ID NO: 48167 - protein, 25 aa, synthetic construct
  source 1..25: note = Seed: QTVHSIPLTINKEEALQRPVASDFE
QTVHSIPLTINKEYALHRSVASDFE

SEQ ID NO: 48168 - protein, 25 aa, synthetic construct
  source 1..25: note = Seed: QTVHSIPLTINKEEALQRPVASDFE
QTVHSIPLTINKEYALHRSVAVDFE

SEQ ID NO: 48169 - protein, 25 aa, synthetic construct
  source 1..25: note = Seed: QTVHSIPLTINKEEALQRPVASDFE
QTVHSIPLTINKEYALHRTVAADFE

SEQ ID NO: 48170 - protein, 25 aa, synthetic construct
  source 1..25: note = Seed: QTVHSIPLTINKEEALQRPVASDFE
QTVHSIPLTINKEYALHRTVANDFE

SEQ ID NO: 48171 - protein, 25 aa, synthetic construct
  source 1..25: note = Seed: QTVHSIPLTINKEEALQRPVASDFE
QTVHSIPLTINKEYALHRTVASDFE

SEQ ID NO: 48172 - protein, 25 aa, synthetic construct
  source 1..25: note = Seed: QTVHSIPLTINKEEALQRPVASDFE
QTVHSIPLTINKEYALHRTVAVDFE

SEQ ID NO: 48173 - protein, 25 aa, synthetic construct
  source 1..25: note = Seed: QTVHSIPLTINKEEALQRPVASDFE
QTVHSIPLTINKEYALHRVVAADFE

SEQ ID NO: 48174 - protein, 25 aa, synthetic construct
  source 1..25: note = Seed: QTVHSIPLTINKEEALQRPVASDFE
QTVHSIPLTINKEYALHRVVANDFE

SEQ ID NO: 48175 - protein, 25 aa, synthetic construct
  source 1..25: note = Seed: QTVHSIPLTINKEEALQRPVASDFE
QTVHSIPLTINKEYALHRVVASDFE

SEQ ID NO: 48176 - protein, 25 aa, synthetic construct
  source 1..25: note = Seed: QTVHSIPLTINKEEALQRPVASDFE
QTVHSIPLTINKEYALIRAVAADFE

SEQ ID NO: 48177 - protein, 25 aa, synthetic construct
  source 1..25: note = Seed: QTVHSIPLTINKEEALQRPVASDFE
QTVHSIPLTINKEYALIRAVACDFE

SEQ ID NO: 48178 - protein, 25 aa, synthetic construct
  source 1..25: note = Seed: QTVHSIPLTINKEEALQRPVASDFE
QTVHSIPLTINKEYALIRAVADDFE

SEQ ID NO: 48179 - protein, 25 aa, synthetic construct
  source 1..25: note = Seed: QTVHSIPLTINKEEALQRPVASDFE
QTVHSIPLTINKEYALIRAVAEDFE

SEQ ID NO: 48180 - protein, 25 aa, synthetic construct
  source 1..25: note = Seed: QTVHSIPLTINKEEALQRPVASDFE
QTVHSIPLTINKEYALIRAVAFDFE

SEQ ID NO: 48181 - protein, 25 aa, synthetic construct
  source 1..25: note = Seed: QTVHSIPLTINKEEALQRPVASDFE
QTVHSIPLTINKEYALIRAVAGDFE

SEQ ID NO: 48182 - protein, 25 aa, synthetic construct
  source 1..25: note = Seed: QTVHSIPLTINKEEALQRPVASDFE
QTVHSIPLTINKEYALIRAVAHDFE

SEQ ID NO: 48183 - protein, 25 aa, synthetic construct
  source 1..25: note = Seed: QTVHSIPLTINKEEALQRPVASDFE
QTVHSIPLTINKEYALIRAVAIDFE

SEQ ID NO: 48184 - protein, 25 aa, synthetic construct
  source 1..25: note = Seed: QTVHSIPLTINKEEALQRPVASDFE
QTVHSIPLTINKEYALIRAVAKDFE

SEQ ID NO: 48185 - protein, 25 aa, synthetic construct
  source 1..25: note = Seed: QTVHSIPLTINKEEALQRPVASDFE
QTVHSIPLTINKEYALIRAVALDFE

SEQ ID NO: 48186 - protein, 25 aa, synthetic construct
  source 1..25: note = Seed: QTVHSIPLTINKEEALQRPVASDFE
QTVHSIPLTINKEYALIRAVAMDFE

SEQ ID NO: 48187 - protein, 25 aa, synthetic construct
  source 1..25: note = Seed: QTVHSIPLTINKEEALQRPVASDFE
QTVHSIPLTINKEYALIRAVANDFE

SEQ ID NO: 48188 - protein, 25 aa, synthetic construct
  source 1..25: note = Seed: QTVHSIPLTINKEEALQRPVASDFE
QTVHSIPLTINKEYALIRAVAPDFE

SEQ ID NO: 48189 - protein, 25 aa, synthetic construct
  source 1..25: note = Seed: QTVHSIPLTINKEEALQRPVASDFE
QTVHSIPLTINKEYALIRAVAQDFE

SEQ ID NO: 48190 - protein, 25 aa, synthetic construct
  source 1..25: note = Seed: QTVHSIPLTINKEEALQRPVASDFE
QTVHSIPLTINKEYALIRAVARDFE

SEQ ID NO: 48191 - protein, 25 aa, synthetic construct
  source 1..25: note = Seed: QTVHSIPLTINKEEALQRPVASDFE
QTVHSIPLTINKEYALIRAVASDFE

SEQ ID NO: 48192 - protein, 25 aa, synthetic construct
  source 1..25: note = Seed: QTVHSIPLTINKEEALQRPVASDFE
QTVHSIPLTINKEYALIRAVATDFE

SEQ ID NO: 48193 - protein, 25 aa, synthetic construct
  source 1..25: note = Seed: QTVHSIPLTINKEEALQRPVASDFE
QTVHSIPLTINKEYALIRAVAVDFE

SEQ ID NO: 48194 - protein, 25 aa, synthetic construct
  source 1..25: note = Seed: QTVHSIPLTINKEEALQRPVASDFE
QTVHSIPLTINKEYALIRAVAYDFE

SEQ ID NO: 48195 - protein, 25 aa, synthetic construct
  source 1..25: note = Seed: QTVHSIPLTINKEEALQRPVASDFE
QTVHSIPLTINKEYALIRCVANDFE

SEQ ID NO: 48196 - protein, 25 aa, synthetic construct
  source 1..25: note = Seed: QTVHSIPLTINKEEALQRPVASDFE
QTVHSIPLTINKEYALIRDVAADFE

SEQ ID NO: 48197 - protein, 25 aa, synthetic construct
  source 1..25: note = Seed: QTVHSIPLTINKEEALQRPVASDFE
QTVHSIPLTINKEYALIRDVASDFE

SEQ ID NO: 48198 - protein, 25 aa, synthetic construct
  source 1..25: note = Seed: QTVHSIPLTINKEEALQRPVASDFE
QTVHSIPLTINKEYALIREVAADFE

SEQ ID NO: 48199 - protein, 25 aa, synthetic construct
  source 1..25: note = Seed: QTVHSIPLTINKEEALQRPVASDFE
QTVHSIPLTINKEYALIREVANDFE

SEQ ID NO: 48200 - protein, 25 aa, synthetic construct
  source 1..25: note = Seed: QTVHSIPLTINKEEALQRPVASDFE
QTVHSIPLTINKEYALIREVASDFE

SEQ ID NO: 48201 - protein, 25 aa, synthetic construct
  source 1..25: note = Seed: QTVHSIPLTINKEEALQRPVASDFE
QTVHSIPLTINKEYALIREVATDFE

SEQ ID NO: 48202 - protein, 25 aa, synthetic construct
  source 1..25: note = Seed: QTVHSIPLTINKEEALQRPVASDFE
QTVHSIPLTINKEYALIRGVAADFE

SEQ ID NO: 48203 - protein, 25 aa, synthetic construct
  source 1..25: note = Seed: QTVHSIPLTINKEEALQRPVASDFE
QTVHSIPLTINKEYALIRGVADDFE

SEQ ID NO: 48204 - protein, 25 aa, synthetic construct
  source 1..25: note = Seed: QTVHSIPLTINKEEALQRPVASDFE
QTVHSIPLTINKEYALIRGVAEDFE

SEQ ID NO: 48205 - protein, 25 aa, synthetic construct
  source 1..25: note = Seed: QTVHSIPLTINKEEALQRPVASDFE
QTVHSIPLTINKEYALIRGVAGDFE

SEQ ID NO: 48206 - protein, 25 aa, synthetic construct
  source 1..25: note = Seed: QTVHSIPLTINKEEALQRPVASDFE
QTVHSIPLTINKEYALIRGVAHDFE

SEQ ID NO: 48207 - protein, 25 aa, synthetic construct
  source 1..25: note = Seed: QTVHSIPLTINKEEALQRPVASDFE
QTVHSIPLTINKEYALIRGVAIDFE

SEQ ID NO: 48208 - protein, 25 aa, synthetic construct
  source 1..25: note = Seed: QTVHSIPLTINKEEALQRPVASDFE
QTVHSIPLTINKEYALIRGVALDFE

SEQ ID NO: 48209 - protein, 25 aa, synthetic construct
  source 1..25: note = Seed: QTVHSIPLTINKEEALQRPVASDFE
QTVHSIPLTINKEYALIRGVAMDFE

SEQ ID NO: 48210 - protein, 25 aa, synthetic construct
  source 1..25: note = Seed: QTVHSIPLTINKEEALQRPVASDFE
QTVHSIPLTINKEYALIRGVANDFE

SEQ ID NO: 48211 - protein, 25 aa, synthetic construct
  source 1..25: note = Seed: QTVHSIPLTINKEEALQRPVASDFE
QTVHSIPLTINKEYALIRGVAPDFE

SEQ ID NO: 48212 - protein, 25 aa, synthetic construct
  source 1..25: note = Seed: QTVHSIPLTINKEEALQRPVASDFE
QTVHSIPLTINKEYALIRGVAQDFE

SEQ ID NO: 48213 - protein, 25 aa, synthetic construct
  source 1..25: note = Seed: QTVHSIPLTINKEEALQRPVASDFE
QTVHSIPLTINKEYALIRGVASDFE

SEQ ID NO: 48214 - protein, 25 aa, synthetic construct
  source 1..25: note = Seed: QTVHSIPLTINKEEALQRPVASDFE
QTVHSIPLTINKEYALIRGVATDFE

SEQ ID NO: 48215 - protein, 25 aa, synthetic construct
  source 1..25: note = Seed: QTVHSIPLTINKEEALQRPVASDFE
QTVHSIPLTINKEYALIRGVAVDFE

SEQ ID NO: 48216 - protein, 25 aa, synthetic construct
  source 1..25: note = Seed: QTVHSIPLTINKEEALQRPVASDFE
QTVHSIPLTINKEYALIRHVAADFE

SEQ ID NO: 48217 - protein, 25 aa, synthetic construct
  source 1..25: note = Seed: QTVHSIPLTINKEEALQRPVASDFE
QTVHSIPLTINKEYALIRHVANDFE

SEQ ID NO: 48218 - protein, 25 aa, synthetic construct
  source 1..25: note = Seed: QTVHSIPLTINKEEALQRPVASDFE
QTVHSIPLTINKEYALIRHVASDFE

SEQ ID NO: 48219 - protein, 25 aa, synthetic construct
  source 1..25: note = Seed: QTVHSIPLTINKEEALQRPVASDFE
QTVHSIPLTINKEYALIRHVATDFE

SEQ ID NO: 48220 - protein, 25 aa, synthetic construct
  source 1..25: note = Seed: QTVHSIPLTINKEEALQRPVASDFE
QTVHSIPLTINKEYALIRHVAVDFE

SEQ ID NO: 48221 - protein, 25 aa, synthetic construct
  source 1..25: note = Seed: QTVHSIPLTINKEEALQRPVASDFE
QTVHSIPLTINKEYALIRIVAADFE

SEQ ID NO: 48222 - protein, 25 aa, synthetic construct
  source 1..25: note = Seed: QTVHSIPLTINKEEALQRPVASDFE
QTVHSIPLTINKEYALIRIVADDFE

SEQ ID NO: 48223 - protein, 25 aa, synthetic construct
  source 1..25: note = Seed: QTVHSIPLTINKEEALQRPVASDFE
QTVHSIPLTINKEYALIRIVAEDFE

SEQ ID NO: 48224 - protein, 25 aa, synthetic construct
  source 1..25: note = Seed: QTVHSIPLTINKEEALQRPVASDFE
QTVHSIPLTINKEYALIRIVAGDFE

SEQ ID NO: 48225 - protein, 25 aa, synthetic construct
  source 1..25: note = Seed: QTVHSIPLTINKEEALQRPVASDFE
QTVHSIPLTINKEYALIRIVAHDFE

SEQ ID NO: 48226 - protein, 25 aa, synthetic construct
  source 1..25: note = Seed: QTVHSIPLTINKEEALQRPVASDFE
QTVHSIPLTINKEYALIRIVAKDFE

SEQ ID NO: 48227 - protein, 25 aa, synthetic construct
  source 1..25: note = Seed: QTVHSIPLTINKEEALQRPVASDFE
QTVHSIPLTINKEYALIRIVAMDFE

SEQ ID NO: 48228 - protein, 25 aa, synthetic construct
  source 1..25: note = Seed: QTVHSIPLTINKEEALQRPVASDFE
QTVHSIPLTINKEYALIRIVANDFE

SEQ ID NO: 48229 - protein, 25 aa, synthetic construct
  source 1..25: note = Seed: QTVHSIPLTINKEEALQRPVASDFE
QTVHSIPLTINKEYALIRIVAPDFE

SEQ ID NO: 48230 - protein, 25 aa, synthetic construct
  source 1..25: note = Seed: QTVHSIPLTINKEEALQRPVASDFE
QTVHSIPLTINKEYALIRIVAQDFE

SEQ ID NO: 48231 - protein, 25 aa, synthetic construct
  source 1..25: note = Seed: QTVHSIPLTINKEEALQRPVASDFE
QTVHSIPLTINKEYALIRIVASDFE

SEQ ID NO: 48232 - protein, 25 aa, synthetic construct
  source 1..25: note = Seed: QTVHSIPLTINKEEALQRPVASDFE
QTVHSIPLTINKEYALIRIVATDFE

SEQ ID NO: 48233 - protein, 25 aa, synthetic construct
  source 1..25: note = Seed: QTVHSIPLTINKEEALQRPVASDFE
QTVHSIPLTINKEYALIRIVAVDFE

SEQ ID NO: 48234 - protein, 25 aa, synthetic construct
  source 1..25: note = Seed: QTVHSIPLTINKEEALQRPVASDFE
QTVHSIPLTINKEYALIRLVAADFE

SEQ ID NO: 48235 - protein, 25 aa, synthetic construct
  source 1..25: note = Seed: QTVHSIPLTINKEEALQRPVASDFE
QTVHSIPLTINKEYALIRLVAHDFE

SEQ ID NO: 48236 - protein, 25 aa, synthetic construct
  source 1..25: note = Seed: QTVHSIPLTINKEEALQRPVASDFE
QTVHSIPLTINKEYALIRLVANDFE

SEQ ID NO: 48237 - protein, 25 aa, synthetic construct
  source 1..25: note = Seed: QTVHSIPLTINKEEALQRPVASDFE
QTVHSIPLTINKEYALIRLVASDFE

SEQ ID NO: 48238 - protein, 25 aa, synthetic construct
  source 1..25: note = Seed: QTVHSIPLTINKEEALQRPVASDFE
QTVHSIPLTINKEYALIRMVAADFE

SEQ ID NO: 48239 - protein, 25 aa, synthetic construct
  source 1..25: note = Seed: QTVHSIPLTINKEEALQRPVASDFE
QTVHSIPLTINKEYALIRMVAHDFE

SEQ ID NO: 48240 - protein, 25 aa, synthetic construct
  source 1..25: note = Seed: QTVHSIPLTINKEEALQRPVASDFE
QTVHSIPLTINKEYALIRMVANDFE

SEQ ID NO: 48241 - protein, 25 aa, synthetic construct
  source 1..25: note = Seed: QTVHSIPLTINKEEALQRPVASDFE
QTVHSIPLTINKEYALIRMVASDFE

SEQ ID NO: 48242 - protein, 25 aa, synthetic construct
  source 1..25: note = Seed: QTVHSIPLTINKEEALQRPVASDFE
QTVHSIPLTINKEYALIRMVATDFE

SEQ ID NO: 48243 - protein, 25 aa, synthetic construct
  source 1..25: note = Seed: QTVHSIPLTINKEEALQRPVASDFE
QTVHSIPLTINKEYALIRNVAADFE

SEQ ID NO: 48244 - protein, 25 aa, synthetic construct
  source 1..25: note = Seed: QTVHSIPLTINKEEALQRPVASDFE
QTVHSIPLTINKEYALIRNVACDFE

SEQ ID NO: 48245 - protein, 25 aa, synthetic construct
  source 1..25: note = Seed: QTVHSIPLTINKEEALQRPVASDFE
QTVHSIPLTINKEYALIRNVADDFE

SEQ ID NO: 48246 - protein, 25 aa, synthetic construct
  source 1..25: note = Seed: QTVHSIPLTINKEEALQRPVASDFE
QTVHSIPLTINKEYALIRNVAEDFE

SEQ ID NO: 48247 - protein, 25 aa, synthetic construct
  source 1..25: note = Seed: QTVHSIPLTINKEEALQRPVASDFE
QTVHSIPLTINKEYALIRNVAGDFE

SEQ ID NO: 48248 - protein, 25 aa, synthetic construct
  source 1..25: note = Seed: QTVHSIPLTINKEEALQRPVASDFE
QTVHSIPLTINKEYALIRNVAHDFE

SEQ ID NO: 48249 - protein, 25 aa, synthetic construct
  source 1..25: note = Seed: QTVHSIPLTINKEEALQRPVASDFE
QTVHSIPLTINKEYALIRNVAIDFE

SEQ ID NO: 48250 - protein, 25 aa, synthetic construct
  source 1..25: note = Seed: QTVHSIPLTINKEEALQRPVASDFE
QTVHSIPLTINKEYALIRNVALDFE

SEQ ID NO: 48251 - protein, 25 aa, synthetic construct
  source 1..25: note = Seed: QTVHSIPLTINKEEALQRPVASDFE
QTVHSIPLTINKEYALIRNVAMDFE

SEQ ID NO: 48252 - protein, 25 aa, synthetic construct
  source 1..25: note = Seed: QTVHSIPLTINKEEALQRPVASDFE
QTVHSIPLTINKEYALIRNVANDFE

SEQ ID NO: 48253 - protein, 25 aa, synthetic construct
  source 1..25: note = Seed: QTVHSIPLTINKEEALQRPVASDFE
QTVHSIPLTINKEYALIRNVAPDFE

SEQ ID NO: 48254 - protein, 25 aa, synthetic construct
  source 1..25: note = Seed: QTVHSIPLTINKEEALQRPVASDFE
QTVHSIPLTINKEYALIRNVAQDFE

SEQ ID NO: 48255 - protein, 25 aa, synthetic construct
  source 1..25: note = Seed: QTVHSIPLTINKEEALQRPVASDFE
QTVHSIPLTINKEYALIRNVASDFE

SEQ ID NO: 48256 - protein, 25 aa, synthetic construct
  source 1..25: note = Seed: QTVHSIPLTINKEEALQRPVASDFE
QTVHSIPLTINKEYALIRNVATDFE

SEQ ID NO: 48257 - protein, 25 aa, synthetic construct
  source 1..25: note = Seed: QTVHSIPLTINKEEALQRPVASDFE
QTVHSIPLTINKEYALIRNVAVDFE

SEQ ID NO: 48258 - protein, 25 aa, synthetic construct
  source 1..25: note = Seed: QTVHSIPLTINKEEALQRPVASDFE
QTVHSIPLTINKEYALIRNVAYDFE

SEQ ID NO: 48259 - protein, 25 aa, synthetic construct
  source 1..25: note = Seed: QTVHSIPLTINKEEALQRPVASDFE
QTVHSIPLTINKEYALIRPVAADFE

SEQ ID NO: 48260 - protein, 25 aa, synthetic construct
  source 1..25: note = Seed: QTVHSIPLTINKEEALQRPVASDFE
QTVHSIPLTINKEYALIRPVACDFE

SEQ ID NO: 48261 - protein, 25 aa, synthetic construct
  source 1..25: note = Seed: QTVHSIPLTINKEEALQRPVASDFE
QTVHSIPLTINKEYALIRPVADDFE

SEQ ID NO: 48262 - protein, 25 aa, synthetic construct
  source 1..25: note = Seed: QTVHSIPLTINKEEALQRPVASDFE
QTVHSIPLTINKEYALIRPVAEDFE

SEQ ID NO: 48263 - protein, 25 aa, synthetic construct
  source 1..25: note = Seed: QTVHSIPLTINKEEALQRPVASDFE
QTVHSIPLTINKEYALIRPVAFDFE

SEQ ID NO: 48264 - protein, 25 aa, synthetic construct
  source 1..25: note = Seed: QTVHSIPLTINKEEALQRPVASDFE
QTVHSIPLTINKEYALIRPVAGDFE

SEQ ID NO: 48265 - protein, 25 aa, synthetic construct
  source 1..25: note = Seed: QTVHSIPLTINKEEALQRPVASDFE
QTVHSIPLTINKEYALIRPVAHDFE

SEQ ID NO: 48266 - protein, 25 aa, synthetic construct
  source 1..25: note = Seed: QTVHSIPLTINKEEALQRPVASDFE
QTVHSIPLTINKEYALIRPVAIDFE

SEQ ID NO: 48267 - protein, 25 aa, synthetic construct
  source 1..25: note = Seed: QTVHSIPLTINKEEALQRPVASDFE
QTVHSIPLTINKEYALIRPVAKDFE

SEQ ID NO: 48268 - protein, 25 aa, synthetic construct
  source 1..25: note = Seed: QTVHSIPLTINKEEALQRPVASDFE
QTVHSIPLTINKEYALIRPVALDFE

SEQ ID NO: 48269 - protein, 25 aa, synthetic construct
  source 1..25: note = Seed: QTVHSIPLTINKEEALQRPVASDFE
QTVHSIPLTINKEYALIRPVAMDFE

SEQ ID NO: 48270 - protein, 25 aa, synthetic construct
  source 1..25: note = Seed: QTVHSIPLTINKEEALQRPVASDFE
QTVHSIPLTINKEYALIRPVANDFE

SEQ ID NO: 48271 - protein, 25 aa, synthetic construct
  source 1..25: note = Seed: QTVHSIPLTINKEEALQRPVASDFE
QTVHSIPLTINKEYALIRPVAPDFE

SEQ ID NO: 48272 - protein, 25 aa, synthetic construct
  source 1..25: note = Seed: QTVHSIPLTINKEEALQRPVASDFE
QTVHSIPLTINKEYALIRPVAQDFE

SEQ ID NO: 48273 - protein, 25 aa, synthetic construct
  source 1..25: note = Seed: QTVHSIPLTINKEEALQRPVASDFE
QTVHSIPLTINKEYALIRPVARDFE

SEQ ID NO: 48274 - protein, 25 aa, synthetic construct
  source 1..25: note = Seed: QTVHSIPLTINKEEALQRPVASDFE
QTVHSIPLTINKEYALIRPVASDFE

SEQ ID NO: 48275 - protein, 25 aa, synthetic construct
  source 1..25: note = Seed: QTVHSIPLTINKEEALQRPVASDFE
QTVHSIPLTINKEYALIRPVATDFE

SEQ ID NO: 48276 - protein, 25 aa, synthetic construct
  source 1..25: note = Seed: QTVHSIPLTINKEEALQRPVASDFE
QTVHSIPLTINKEYALIRPVAVDFE

SEQ ID NO: 48277 - protein, 25 aa, synthetic construct
  source 1..25: note = Seed: QTVHSIPLTINKEEALQRPVASDFE
QTVHSIPLTINKEYALIRPVAWDFE

SEQ ID NO: 48278 - protein, 25 aa, synthetic construct
  source 1..25: note = Seed: QTVHSIPLTINKEEALQRPVASDFE
QTVHSIPLTINKEYALIRPVAYDFE

SEQ ID NO: 48279 - protein, 25 aa, synthetic construct
  source 1..25: note = Seed: QTVHSIPLTINKEEALQRPVASDFE
QTVHSIPLTINKEYALIRQVAADFE

SEQ ID NO: 48280 - protein, 25 aa, synthetic construct
  source 1..25: note = Seed: QTVHSIPLTINKEEALQRPVASDFE
QTVHSIPLTINKEYALIRQVANDFE

SEQ ID NO: 48281 - protein, 25 aa, synthetic construct
  source 1..25: note = Seed: QTVHSIPLTINKEEALQRPVASDFE
QTVHSIPLTINKEYALIRQVASDFE

SEQ ID NO: 48282 - protein, 25 aa, synthetic construct
  source 1..25: note = Seed: QTVHSIPLTINKEEALQRPVASDFE
QTVHSIPLTINKEYALIRQVATDFE

SEQ ID NO: 48283 - protein, 25 aa, synthetic construct
  source 1..25: note = Seed: QTVHSIPLTINKEEALQRPVASDFE
QTVHSIPLTINKEYALIRSVAADFE

SEQ ID NO: 48284 - protein, 25 aa, synthetic construct
  source 1..25: note = Seed: QTVHSIPLTINKEEALQRPVASDFE
QTVHSIPLTINKEYALIRSVACDFE

SEQ ID NO: 48285 - protein, 25 aa, synthetic construct
  source 1..25: note = Seed: QTVHSIPLTINKEEALQRPVASDFE
QTVHSIPLTINKEYALIRSVADDFE

SEQ ID NO: 48286 - protein, 25 aa, synthetic construct
  source 1..25: note = Seed: QTVHSIPLTINKEEALQRPVASDFE
QTVHSIPLTINKEYALIRSVAEDFE

SEQ ID NO: 48287 - protein, 25 aa, synthetic construct
  source 1..25: note = Seed: QTVHSIPLTINKEEALQRPVASDFE
QTVHSIPLTINKEYALIRSVAFDFE

SEQ ID NO: 48288 - protein, 25 aa, synthetic construct
  source 1..25: note = Seed: QTVHSIPLTINKEEALQRPVASDFE
QTVHSIPLTINKEYALIRSVAGDFE

SEQ ID NO: 48289 - protein, 25 aa, synthetic construct
  source 1..25: note = Seed: QTVHSIPLTINKEEALQRPVASDFE
QTVHSIPLTINKEYALIRSVAHDFE

SEQ ID NO: 48290 - protein, 25 aa, synthetic construct
  source 1..25: note = Seed: QTVHSIPLTINKEEALQRPVASDFE
QTVHSIPLTINKEYALIRSVAIDFE

SEQ ID NO: 48291 - protein, 25 aa, synthetic construct
  source 1..25: note = Seed: QTVHSIPLTINKEEALQRPVASDFE
QTVHSIPLTINKEYALIRSVAKDFE

SEQ ID NO: 48292 - protein, 25 aa, synthetic construct
  source 1..25: note = Seed: QTVHSIPLTINKEEALQRPVASDFE
QTVHSIPLTINKEYALIRSVALDFE

SEQ ID NO: 48293 - protein, 25 aa, synthetic construct
  source 1..25: note = Seed: QTVHSIPLTINKEEALQRPVASDFE
QTVHSIPLTINKEYALIRSVAMDFE

SEQ ID NO: 48294 - protein, 25 aa, synthetic construct
  source 1..25: note = Seed: QTVHSIPLTINKEEALQRPVASDFE
QTVHSIPLTINKEYALIRSVANDFE

SEQ ID NO: 48295 - protein, 25 aa, synthetic construct
  source 1..25: note = Seed: QTVHSIPLTINKEEALQRPVASDFE
QTVHSIPLTINKEYALIRSVAPDFE

SEQ ID NO: 48296 - protein, 25 aa, synthetic construct
  source 1..25: note = Seed: QTVHSIPLTINKEEALQRPVASDFE
QTVHSIPLTINKEYALIRSVAQDFE

SEQ ID NO: 48297 - protein, 25 aa, synthetic construct
  source 1..25: note = Seed: QTVHSIPLTINKEEALQRPVASDFE
QTVHSIPLTINKEYALIRSVARDFE

SEQ ID NO: 48298 - protein, 25 aa, synthetic construct
  source 1..25: note = Seed: QTVHSIPLTINKEEALQRPVASDFE
QTVHSIPLTINKEYALIRSVASDFE

SEQ ID NO: 48299 - protein, 25 aa, synthetic construct
  source 1..25: note = Seed: QTVHSIPLTINKEEALQRPVASDFE
QTVHSIPLTINKEYALIRSVATDFE

SEQ ID NO: 48300 - protein, 25 aa, synthetic construct
  source 1..25: note = Seed: QTVHSIPLTINKEEALQRPVASDFE
QTVHSIPLTINKEYALIRSVAVDFE

SEQ ID NO: 48301 - protein, 25 aa, synthetic construct
  source 1..25: note = Seed: QTVHSIPLTINKEEALQRPVASDFE
QTVHSIPLTINKEYALIRSVAYDFE

SEQ ID NO: 48302 - protein, 25 aa, synthetic construct
  source 1..25: note = Seed: QTVHSIPLTINKEEALQRPVASDFE
QTVHSIPLTINKEYALIRTVAADFE

SEQ ID NO: 48303 - protein, 25 aa, synthetic construct
  source 1..25: note = Seed: QTVHSIPLTINKEEALQRPVASDFE
QTVHSIPLTINKEYALIRTVACDFE

SEQ ID NO: 48304 - protein, 25 aa, synthetic construct
  source 1..25: note = Seed: QTVHSIPLTINKEEALQRPVASDFE
QTVHSIPLTINKEYALIRTVADDFE

SEQ ID NO: 48305 - protein, 25 aa, synthetic construct
  source 1..25: note = Seed: QTVHSIPLTINKEEALQRPVASDFE
QTVHSIPLTINKEYALIRTVAEDFE

SEQ ID NO: 48306 - protein, 25 aa, synthetic construct
  source 1..25: note = Seed: QTVHSIPLTINKEEALQRPVASDFE
QTVHSIPLTINKEYALIRTVAFDFE

SEQ ID NO: 48307 - protein, 25 aa, synthetic construct
  source 1..25: note = Seed: QTVHSIPLTINKEEALQRPVASDFE
QTVHSIPLTINKEYALIRTVAGDFE

SEQ ID NO: 48308 - protein, 25 aa, synthetic construct
  source 1..25: note = Seed: QTVHSIPLTINKEEALQRPVASDFE
QTVHSIPLTINKEYALIRTVAHDFE

SEQ ID NO: 48309 - protein, 25 aa, synthetic construct
  source 1..25: note = Seed: QTVHSIPLTINKEEALQRPVASDFE
QTVHSIPLTINKEYALIRTVAIDFE

SEQ ID NO: 48310 - protein, 25 aa, synthetic construct
  source 1..25: note = Seed: QTVHSIPLTINKEEALQRPVASDFE
QTVHSIPLTINKEYALIRTVAKDFE

SEQ ID NO: 48311 - protein, 25 aa, synthetic construct
  source 1..25: note = Seed: QTVHSIPLTINKEEALQRPVASDFE
QTVHSIPLTINKEYALIRTVALDFE

SEQ ID NO: 48312 - protein, 25 aa, synthetic construct
  source 1..25: note = Seed: QTVHSIPLTINKEEALQRPVASDFE
QTVHSIPLTINKEYALIRTVAMDFE

SEQ ID NO: 48313 - protein, 25 aa, synthetic construct
  source 1..25: note = Seed: QTVHSIPLTINKEEALQRPVASDFE
QTVHSIPLTINKEYALIRTVANDFE

SEQ ID NO: 48314 - protein, 25 aa, synthetic construct
  source 1..25: note = Seed: QTVHSIPLTINKEEALQRPVASDFE
QTVHSIPLTINKEYALIRTVAPDFE

SEQ ID NO: 48315 - protein, 25 aa, synthetic construct
  source 1..25: note = Seed: QTVHSIPLTINKEEALQRPVASDFE
QTVHSIPLTINKEYALIRTVAQDFE

SEQ ID NO: 48316 - protein, 25 aa, synthetic construct
  source 1..25: note = Seed: QTVHSIPLTINKEEALQRPVASDFE
QTVHSIPLTINKEYALIRTVARDFE

SEQ ID NO: 48317 - protein, 25 aa, synthetic construct
  source 1..25: note = Seed: QTVHSIPLTINKEEALQRPVASDFE
QTVHSIPLTINKEYALIRTVASDFE

SEQ ID NO: 48318 - protein, 25 aa, synthetic construct
  source 1..25: note = Seed: QTVHSIPLTINKEEALQRPVASDFE
QTVHSIPLTINKEYALIRTVATDFE

SEQ ID NO: 48319 - protein, 25 aa, synthetic construct
  source 1..25: note = Seed: QTVHSIPLTINKEEALQRPVASDFE
QTVHSIPLTINKEYALIRTVAVDFE

SEQ ID NO: 48320 - protein, 25 aa, synthetic construct
  source 1..25: note = Seed: QTVHSIPLTINKEEALQRPVASDFE
QTVHSIPLTINKEYALIRTVAYDFE

SEQ ID NO: 48321 - protein, 25 aa, synthetic construct
  source 1..25: note = Seed: QTVHSIPLTINKEEALQRPVASDFE
QTVHSIPLTINKEYALIRVVAADFE

SEQ ID NO: 48322 - protein, 25 aa, synthetic construct
  source 1..25: note = Seed: QTVHSIPLTINKEEALQRPVASDFE
QTVHSIPLTINKEYALIRVVADDFE

SEQ ID NO: 48323 - protein, 25 aa, synthetic construct
  source 1..25: note = Seed: QTVHSIPLTINKEEALQRPVASDFE
QTVHSIPLTINKEYALIRVVAEDFE

SEQ ID NO: 48324 - protein, 25 aa, synthetic construct
  source 1..25: note = Seed: QTVHSIPLTINKEEALQRPVASDFE
QTVHSIPLTINKEYALIRVVAGDFE

SEQ ID NO: 48325 - protein, 25 aa, synthetic construct
  source 1..25: note = Seed: QTVHSIPLTINKEEALQRPVASDFE
QTVHSIPLTINKEYALIRVVAHDFE

SEQ ID NO: 48326 - protein, 25 aa, synthetic construct
  source 1..25: note = Seed: QTVHSIPLTINKEEALQRPVASDFE
QTVHSIPLTINKEYALIRVVAIDFE

SEQ ID NO: 48327 - protein, 25 aa, synthetic construct
  source 1..25: note = Seed: QTVHSIPLTINKEEALQRPVASDFE
QTVHSIPLTINKEYALIRVVAKDFE

SEQ ID NO: 48328 - protein, 25 aa, synthetic construct
  source 1..25: note = Seed: QTVHSIPLTINKEEALQRPVASDFE
QTVHSIPLTINKEYALIRVVALDFE

SEQ ID NO: 48329 - protein, 25 aa, synthetic construct
  source 1..25: note = Seed: QTVHSIPLTINKEEALQRPVASDFE
QTVHSIPLTINKEYALIRVVAMDFE

SEQ ID NO: 48330 - protein, 25 aa, synthetic construct
  source 1..25: note = Seed: QTVHSIPLTINKEEALQRPVASDFE
QTVHSIPLTINKEYALIRVVANDFE

SEQ ID NO: 48331 - protein, 25 aa, synthetic construct
  source 1..25: note = Seed: QTVHSIPLTINKEEALQRPVASDFE
QTVHSIPLTINKEYALIRVVAPDFE

SEQ ID NO: 48332 - protein, 25 aa, synthetic construct
  source 1..25: note = Seed: QTVHSIPLTINKEEALQRPVASDFE
QTVHSIPLTINKEYALIRVVAQDFE

SEQ ID NO: 48333 - protein, 25 aa, synthetic construct
  source 1..25: note = Seed: QTVHSIPLTINKEEALQRPVASDFE
QTVHSIPLTINKEYALIRVVARDFE

SEQ ID NO: 48334 - protein, 25 aa, synthetic construct
  source 1..25: note = Seed: QTVHSIPLTINKEEALQRPVASDFE
QTVHSIPLTINKEYALIRVVASDFE

SEQ ID NO: 48335 - protein, 25 aa, synthetic construct
  source 1..25: note = Seed: QTVHSIPLTINKEEALQRPVASDFE
QTVHSIPLTINKEYALIRVVATDFE

SEQ ID NO: 48336 - protein, 25 aa, synthetic construct
  source 1..25: note = Seed: QTVHSIPLTINKEEALQRPVASDFE
QTVHSIPLTINKEYALIRVVAVDFE

SEQ ID NO: 48337 - protein, 25 aa, synthetic construct
  source 1..25: note = Seed: QTVHSIPLTINKEEALQRPVASDFE
QTVHSIPLTINKEYALKRAVAADFE

SEQ ID NO: 48338 - protein, 25 aa, synthetic construct
  source 1..25: note = Seed: QTVHSIPLTINKEEALQRPVASDFE
QTVHSIPLTINKEYALLRAVAADFE

SEQ ID NO: 48339 - protein, 25 aa, synthetic construct
  source 1..25: note = Seed: QTVHSIPLTINKEEALQRPVASDFE
QTVHSIPLTINKEYALLRAVACDFE

SEQ ID NO: 48340 - protein, 25 aa, synthetic construct
  source 1..25: note = Seed: QTVHSIPLTINKEEALQRPVASDFE
QTVHSIPLTINKEYALLRAVADDFE

SEQ ID NO: 48341 - protein, 25 aa, synthetic construct
  source 1..25: note = Seed: QTVHSIPLTINKEEALQRPVASDFE
QTVHSIPLTINKEYALLRAVAEDFE

SEQ ID NO: 48342 - protein, 25 aa, synthetic construct
  source 1..25: note = Seed: QTVHSIPLTINKEEALQRPVASDFE
QTVHSIPLTINKEYALLRAVAFDFE

SEQ ID NO: 48343 - protein, 25 aa, synthetic construct
  source 1..25: note = Seed: QTVHSIPLTINKEEALQRPVASDFE
QTVHSIPLTINKEYALLRAVAGDFE

SEQ ID NO: 48344 - protein, 25 aa, synthetic construct
  source 1..25: note = Seed: QTVHSIPLTINKEEALQRPVASDFE
QTVHSIPLTINKEYALLRAVAHDFE

SEQ ID NO: 48345 - protein, 25 aa, synthetic construct
  source 1..25: note = Seed: QTVHSIPLTINKEEALQRPVASDFE
QTVHSIPLTINKEYALLRAVAIDFE

SEQ ID NO: 48346 - protein, 25 aa, synthetic construct
  source 1..25: note = Seed: QTVHSIPLTINKEEALQRPVASDFE
QTVHSIPLTINKEYALLRAVAKDFE

SEQ ID NO: 48347 - protein, 25 aa, synthetic construct
  source 1..25: note = Seed: QTVHSIPLTINKEEALQRPVASDFE
QTVHSIPLTINKEYALLRAVALDFE

SEQ ID NO: 48348 - protein, 25 aa, synthetic construct
  source 1..25: note = Seed: QTVHSIPLTINKEEALQRPVASDFE
QTVHSIPLTINKEYALLRAVAMDFE

SEQ ID NO: 48349 - protein, 25 aa, synthetic construct
  source 1..25: note = Seed: QTVHSIPLTINKEEALQRPVASDFE
QTVHSIPLTINKEYALLRAVANDFE

SEQ ID NO: 48350 - protein, 25 aa, synthetic construct
  source 1..25: note = Seed: QTVHSIPLTINKEEALQRPVASDFE
QTVHSIPLTINKEYALLRAVAPDFE

SEQ ID NO: 48351 - protein, 25 aa, synthetic construct
  source 1..25: note = Seed: QTVHSIPLTINKEEALQRPVASDFE
QTVHSIPLTINKEYALLRAVAQDFE

SEQ ID NO: 48352 - protein, 25 aa, synthetic construct
  source 1..25: note = Seed: QTVHSIPLTINKEEALQRPVASDFE
QTVHSIPLTINKEYALLRAVARDFE

SEQ ID NO: 48353 - protein, 25 aa, synthetic construct
  source 1..25: note = Seed: QTVHSIPLTINKEEALQRPVASDFE
QTVHSIPLTINKEYALLRAVASDFE

SEQ ID NO: 48354 - protein, 25 aa, synthetic construct
  source 1..25: note = Seed: QTVHSIPLTINKEEALQRPVASDFE
QTVHSIPLTINKEYALLRAVATDFE

SEQ ID NO: 48355 - protein, 25 aa, synthetic construct
  source 1..25: note = Seed: QTVHSIPLTINKEEALQRPVASDFE
QTVHSIPLTINKEYALLRAVAVDFE

SEQ ID NO: 48356 - protein, 25 aa, synthetic construct
  source 1..25: note = Seed: QTVHSIPLTINKEEALQRPVASDFE
QTVHSIPLTINKEYALLRAVAYDFE

SEQ ID NO: 48357 - protein, 25 aa, synthetic construct
  source 1..25: note = Seed: QTVHSIPLTINKEEALQRPVASDFE
QTVHSIPLTINKEYALLRCVANDFE

SEQ ID NO: 48358 - protein, 25 aa, synthetic construct
  source 1..25: note = Seed: QTVHSIPLTINKEEALQRPVASDFE
QTVHSIPLTINKEYALLRDVAADFE

SEQ ID NO: 48359 - protein, 25 aa, synthetic construct
  source 1..25: note = Seed: QTVHSIPLTINKEEALQRPVASDFE
QTVHSIPLTINKEYALLRDVANDFE

SEQ ID NO: 48360 - protein, 25 aa, synthetic construct
  source 1..25: note = Seed: QTVHSIPLTINKEEALQRPVASDFE
QTVHSIPLTINKEYALLRDVASDFE

SEQ ID NO: 48361 - protein, 25 aa, synthetic construct
  source 1..25: note = Seed: QTVHSIPLTINKEEALQRPVASDFE
QTVHSIPLTINKEYALLRDVATDFE

SEQ ID NO: 48362 - protein, 25 aa, synthetic construct
  source 1..25: note = Seed: QTVHSIPLTINKEEALQRPVASDFE
QTVHSIPLTINKEYALLRDVAVDFE

SEQ ID NO: 48363 - protein, 25 aa, synthetic construct
  source 1..25: note = Seed: QTVHSIPLTINKEEALQRPVASDFE
QTVHSIPLTINKEYALLREVAADFE

SEQ ID NO: 48364 - protein, 25 aa, synthetic construct
  source 1..25: note = Seed: QTVHSIPLTINKEEALQRPVASDFE
QTVHSIPLTINKEYALLREVANDFE

SEQ ID NO: 48365 - protein, 25 aa, synthetic construct
  source 1..25: note = Seed: QTVHSIPLTINKEEALQRPVASDFE
QTVHSIPLTINKEYALLREVASDFE

SEQ ID NO: 48366 - protein, 25 aa, synthetic construct
  source 1..25: note = Seed: QTVHSIPLTINKEEALQRPVASDFE
QTVHSIPLTINKEYALLREVATDFE

SEQ ID NO: 48367 - protein, 25 aa, synthetic construct
  source 1..25: note = Seed: QTVHSIPLTINKEEALQRPVASDFE
QTVHSIPLTINKEYALLRGVAADFE

SEQ ID NO: 48368 - protein, 25 aa, synthetic construct
  source 1..25: note = Seed: QTVHSIPLTINKEEALQRPVASDFE
QTVHSIPLTINKEYALLRGVADDFE

SEQ ID NO: 48369 - protein, 25 aa, synthetic construct
  source 1..25: note = Seed: QTVHSIPLTINKEEALQRPVASDFE
QTVHSIPLTINKEYALLRGVAEDFE

SEQ ID NO: 48370 - protein, 25 aa, synthetic construct
  source 1..25: note = Seed: QTVHSIPLTINKEEALQRPVASDFE
QTVHSIPLTINKEYALLRGVAGDFE

SEQ ID NO: 48371 - protein, 25 aa, synthetic construct
  source 1..25: note = Seed: QTVHSIPLTINKEEALQRPVASDFE
QTVHSIPLTINKEYALLRGVAHDFE

SEQ ID NO: 48372 - protein, 25 aa, synthetic construct
  source 1..25: note = Seed: QTVHSIPLTINKEEALQRPVASDFE
QTVHSIPLTINKEYALLRGVAIDFE

SEQ ID NO: 48373 - protein, 25 aa, synthetic construct
  source 1..25: note = Seed: QTVHSIPLTINKEEALQRPVASDFE
QTVHSIPLTINKEYALLRGVALDFE

SEQ ID NO: 48374 - protein, 25 aa, synthetic construct
  source 1..25: note = Seed: QTVHSIPLTINKEEALQRPVASDFE
QTVHSIPLTINKEYALLRGVAMDFE

SEQ ID NO: 48375 - protein, 25 aa, synthetic construct
  source 1..25: note = Seed: QTVHSIPLTINKEEALQRPVASDFE
QTVHSIPLTINKEYALLRGVANDFE

SEQ ID NO: 48376 - protein, 25 aa, synthetic construct
  source 1..25: note = Seed: QTVHSIPLTINKEEALQRPVASDFE
QTVHSIPLTINKEYALLRGVAPDFE

SEQ ID NO: 48377 - protein, 25 aa, synthetic construct
  source 1..25: note = Seed: QTVHSIPLTINKEEALQRPVASDFE
QTVHSIPLTINKEYALLRGVAQDFE

SEQ ID NO: 48378 - protein, 25 aa, synthetic construct
  source 1..25: note = Seed: QTVHSIPLTINKEEALQRPVASDFE
QTVHSIPLTINKEYALLRGVASDFE

SEQ ID NO: 48379 - protein, 25 aa, synthetic construct
  source 1..25: note = Seed: QTVHSIPLTINKEEALQRPVASDFE
QTVHSIPLTINKEYALLRGVATDFE

SEQ ID NO: 48380 - protein, 25 aa, synthetic construct
  source 1..25: note = Seed: QTVHSIPLTINKEEALQRPVASDFE
QTVHSIPLTINKEYALLRGVAVDFE

SEQ ID NO: 48381 - protein, 25 aa, synthetic construct
  source 1..25: note = Seed: QTVHSIPLTINKEEALQRPVASDFE
QTVHSIPLTINKEYALLRGVAYDFE

SEQ ID NO: 48382 - protein, 25 aa, synthetic construct
  source 1..25: note = Seed: QTVHSIPLTINKEEALQRPVASDFE
QTVHSIPLTINKEYALLRHVAADFE

SEQ ID NO: 48383 - protein, 25 aa, synthetic construct
  source 1..25: note = Seed: QTVHSIPLTINKEEALQRPVASDFE
QTVHSIPLTINKEYALLRHVANDFE

SEQ ID NO: 48384 - protein, 25 aa, synthetic construct
  source 1..25: note = Seed: QTVHSIPLTINKEEALQRPVASDFE
QTVHSIPLTINKEYALLRHVASDFE

SEQ ID NO: 48385 - protein, 25 aa, synthetic construct
  source 1..25: note = Seed: QTVHSIPLTINKEEALQRPVASDFE
QTVHSIPLTINKEYALLRHVATDFE

SEQ ID NO: 48386 - protein, 25 aa, synthetic construct
  source 1..25: note = Seed: QTVHSIPLTINKEEALQRPVASDFE
QTVHSIPLTINKEYALLRHVAVDFE

SEQ ID NO: 48387 - protein, 25 aa, synthetic construct
  source 1..25: note = Seed: QTVHSIPLTINKEEALQRPVASDFE
QTVHSIPLTINKEYALLRIVAADFE

SEQ ID NO: 48388 - protein, 25 aa, synthetic construct
  source 1..25: note = Seed: QTVHSIPLTINKEEALQRPVASDFE
QTVHSIPLTINKEYALLRIVADDFE

SEQ ID NO: 48389 - protein, 25 aa, synthetic construct
  source 1..25: note = Seed: QTVHSIPLTINKEEALQRPVASDFE
QTVHSIPLTINKEYALLRIVAEDFE

SEQ ID NO: 48390 - protein, 25 aa, synthetic construct
  source 1..25: note = Seed: QTVHSIPLTINKEEALQRPVASDFE
QTVHSIPLTINKEYALLRIVAGDFE

SEQ ID NO: 48391 - protein, 25 aa, synthetic construct
  source 1..25: note = Seed: QTVHSIPLTINKEEALQRPVASDFE
QTVHSIPLTINKEYALLRIVAHDFE

SEQ ID NO: 48392 - protein, 25 aa, synthetic construct
  source 1..25: note = Seed: QTVHSIPLTINKEEALQRPVASDFE
QTVHSIPLTINKEYALLRIVAIDFE

SEQ ID NO: 48393 - protein, 25 aa, synthetic construct
  source 1..25: note = Seed: QTVHSIPLTINKEEALQRPVASDFE
QTVHSIPLTINKEYALLRIVAKDFE

SEQ ID NO: 48394 - protein, 25 aa, synthetic construct
  source 1..25: note = Seed: QTVHSIPLTINKEEALQRPVASDFE
QTVHSIPLTINKEYALLRIVAMDFE

SEQ ID NO: 48395 - protein, 25 aa, synthetic construct
  source 1..25: note = Seed: QTVHSIPLTINKEEALQRPVASDFE
QTVHSIPLTINKEYALLRIVANDFE

SEQ ID NO: 48396 - protein, 25 aa, synthetic construct
  source 1..25: note = Seed: QTVHSIPLTINKEEALQRPVASDFE
QTVHSIPLTINKEYALLRIVAPDFE

SEQ ID NO: 48397 - protein, 25 aa, synthetic construct
  source 1..25: note = Seed: QTVHSIPLTINKEEALQRPVASDFE
QTVHSIPLTINKEYALLRIVAQDFE

SEQ ID NO: 48398 - protein, 25 aa, synthetic construct
  source 1..25: note = Seed: QTVHSIPLTINKEEALQRPVASDFE
QTVHSIPLTINKEYALLRIVASDFE

SEQ ID NO: 48399 - protein, 25 aa, synthetic construct
  source 1..25: note = Seed: QTVHSIPLTINKEEALQRPVASDFE
QTVHSIPLTINKEYALLRIVATDFE

SEQ ID NO: 48400 - protein, 25 aa, synthetic construct
  source 1..25: note = Seed: QTVHSIPLTINKEEALQRPVASDFE
QTVHSIPLTINKEYALLRIVAVDFE

SEQ ID NO: 48401 - protein, 25 aa, synthetic construct
  source 1..25: note = Seed: QTVHSIPLTINKEEALQRPVASDFE
QTVHSIPLTINKEYALLRLVAADFE

SEQ ID NO: 48402 - protein, 25 aa, synthetic construct
  source 1..25: note = Seed: QTVHSIPLTINKEEALQRPVASDFE
QTVHSIPLTINKEYALLRLVAHDFE

SEQ ID NO: 48403 - protein, 25 aa, synthetic construct
  source 1..25: note = Seed: QTVHSIPLTINKEEALQRPVASDFE
QTVHSIPLTINKEYALLRLVANDFE

SEQ ID NO: 48404 - protein, 25 aa, synthetic construct
  source 1..25: note = Seed: QTVHSIPLTINKEEALQRPVASDFE
QTVHSIPLTINKEYALLRLVASDFE

SEQ ID NO: 48405 - protein, 25 aa, synthetic construct
  source 1..25: note = Seed: QTVHSIPLTINKEEALQRPVASDFE
QTVHSIPLTINKEYALLRMVAADFE

SEQ ID NO: 48406 - protein, 25 aa, synthetic construct
  source 1..25: note = Seed: QTVHSIPLTINKEEALQRPVASDFE
QTVHSIPLTINKEYALLRMVAHDFE

SEQ ID NO: 48407 - protein, 25 aa, synthetic construct
  source 1..25: note = Seed: QTVHSIPLTINKEEALQRPVASDFE
QTVHSIPLTINKEYALLRMVANDFE

SEQ ID NO: 48408 - protein, 25 aa, synthetic construct
  source 1..25: note = Seed: QTVHSIPLTINKEEALQRPVASDFE
QTVHSIPLTINKEYALLRMVASDFE

SEQ ID NO: 48409 - protein, 25 aa, synthetic construct
  source 1..25: note = Seed: QTVHSIPLTINKEEALQRPVASDFE
QTVHSIPLTINKEYALLRMVATDFE

SEQ ID NO: 48410 - protein, 25 aa, synthetic construct
  source 1..25: note = Seed: QTVHSIPLTINKEEALQRPVASDFE
QTVHSIPLTINKEYALLRNVAADFE

SEQ ID NO: 48411 - protein, 25 aa, synthetic construct
  source 1..25: note = Seed: QTVHSIPLTINKEEALQRPVASDFE
QTVHSIPLTINKEYALLRNVACDFE

SEQ ID NO: 48412 - protein, 25 aa, synthetic construct
  source 1..25: note = Seed: QTVHSIPLTINKEEALQRPVASDFE
QTVHSIPLTINKEYALLRNVADDFE

SEQ ID NO: 48413 - protein, 25 aa, synthetic construct
  source 1..25: note = Seed: QTVHSIPLTINKEEALQRPVASDFE
QTVHSIPLTINKEYALLRNVAEDFE

SEQ ID NO: 48414 - protein, 25 aa, synthetic construct
  source 1..25: note = Seed: QTVHSIPLTINKEEALQRPVASDFE
QTVHSIPLTINKEYALLRNVAFDFE

SEQ ID NO: 48415 - protein, 25 aa, synthetic construct
  source 1..25: note = Seed: QTVHSIPLTINKEEALQRPVASDFE
QTVHSIPLTINKEYALLRNVAGDFE

SEQ ID NO: 48416 - protein, 25 aa, synthetic construct
  source 1..25: note = Seed: QTVHSIPLTINKEEALQRPVASDFE
QTVHSIPLTINKEYALLRNVAHDFE

SEQ ID NO: 48417 - protein, 25 aa, synthetic construct
  source 1..25: note = Seed: QTVHSIPLTINKEEALQRPVASDFE
QTVHSIPLTINKEYALLRNVAIDFE

SEQ ID NO: 48418 - protein, 25 aa, synthetic construct
  source 1..25: note = Seed: QTVHSIPLTINKEEALQRPVASDFE
QTVHSIPLTINKEYALLRNVALDFE

SEQ ID NO: 48419 - protein, 25 aa, synthetic construct
  source 1..25: note = Seed: QTVHSIPLTINKEEALQRPVASDFE
QTVHSIPLTINKEYALLRNVAMDFE

SEQ ID NO: 48420 - protein, 25 aa, synthetic construct
  source 1..25: note = Seed: QTVHSIPLTINKEEALQRPVASDFE
QTVHSIPLTINKEYALLRNVANDFE

SEQ ID NO: 48421 - protein, 25 aa, synthetic construct
  source 1..25: note = Seed: QTVHSIPLTINKEEALQRPVASDFE
QTVHSIPLTINKEYALLRNVAPDFE

SEQ ID NO: 48422 - protein, 25 aa, synthetic construct
  source 1..25: note = Seed: QTVHSIPLTINKEEALQRPVASDFE
QTVHSIPLTINKEYALLRNVAQDFE

SEQ ID NO: 48423 - protein, 25 aa, synthetic construct
  source 1..25: note = Seed: QTVHSIPLTINKEEALQRPVASDFE
QTVHSIPLTINKEYALLRNVASDFE

SEQ ID NO: 48424 - protein, 25 aa, synthetic construct
  source 1..25: note = Seed: QTVHSIPLTINKEEALQRPVASDFE
QTVHSIPLTINKEYALLRNVATDFE

SEQ ID NO: 48425 - protein, 25 aa, synthetic construct
  source 1..25: note = Seed: QTVHSIPLTINKEEALQRPVASDFE
QTVHSIPLTINKEYALLRNVAVDFE

SEQ ID NO: 48426 - protein, 25 aa, synthetic construct
  source 1..25: note = Seed: QTVHSIPLTINKEEALQRPVASDFE
QTVHSIPLTINKEYALLRNVAYDFE

SEQ ID NO: 48427 - protein, 25 aa, synthetic construct
  source 1..25: note = Seed: QTVHSIPLTINKEEALQRPVASDFE
QTVHSIPLTINKEYALLRPVAADFE

SEQ ID NO: 48428 - protein, 25 aa, synthetic construct
  source 1..25: note = Seed: QTVHSIPLTINKEEALQRPVASDFE
QTVHSIPLTINKEYALLRPVACDFE

SEQ ID NO: 48429 - protein, 25 aa, synthetic construct
  source 1..25: note = Seed: QTVHSIPLTINKEEALQRPVASDFE
QTVHSIPLTINKEYALLRPVADDFE

SEQ ID NO: 48430 - protein, 25 aa, synthetic construct
  source 1..25: note = Seed: QTVHSIPLTINKEEALQRPVASDFE
QTVHSIPLTINKEYALLRPVAEDFE

SEQ ID NO: 48431 - protein, 25 aa, synthetic construct
  source 1..25: note = Seed: QTVHSIPLTINKEEALQRPVASDFE
QTVHSIPLTINKEYALLRPVAFDFE

SEQ ID NO: 48432 - protein, 25 aa, synthetic construct
  source 1..25: note = Seed: QTVHSIPLTINKEEALQRPVASDFE
QTVHSIPLTINKEYALLRPVAGDFE

SEQ ID NO: 48433 - protein, 25 aa, synthetic construct
  source 1..25: note = Seed: QTVHSIPLTINKEEALQRPVASDFE
QTVHSIPLTINKEYALLRPVAHDFE

SEQ ID NO: 48434 - protein, 25 aa, synthetic construct
  source 1..25: note = Seed: QTVHSIPLTINKEEALQRPVASDFE
QTVHSIPLTINKEYALLRPVAIDFE

SEQ ID NO: 48435 - protein, 25 aa, synthetic construct
  source 1..25: note = Seed: QTVHSIPLTINKEEALQRPVASDFE
QTVHSIPLTINKEYALLRPVAKDFE

SEQ ID NO: 48436 - protein, 25 aa, synthetic construct
  source 1..25: note = Seed: QTVHSIPLTINKEEALQRPVASDFE
QTVHSIPLTINKEYALLRPVALDFE

SEQ ID NO: 48437 - protein, 25 aa, synthetic construct
  source 1..25: note = Seed: QTVHSIPLTINKEEALQRPVASDFE
QTVHSIPLTINKEYALLRPVAMDFE

SEQ ID NO: 48438 - protein, 25 aa, synthetic construct
  source 1..25: note = Seed: QTVHSIPLTINKEEALQRPVASDFE
QTVHSIPLTINKEYALLRPVANDFE

SEQ ID NO: 48439 - protein, 25 aa, synthetic construct
  source 1..25: note = Seed: QTVHSIPLTINKEEALQRPVASDFE
QTVHSIPLTINKEYALLRPVAPDFE

SEQ ID NO: 48440 - protein, 25 aa, synthetic construct
  source 1..25: note = Seed: QTVHSIPLTINKEEALQRPVASDFE
QTVHSIPLTINKEYALLRPVAQDFE

SEQ ID NO: 48441 - protein, 25 aa, synthetic construct
  source 1..25: note = Seed: QTVHSIPLTINKEEALQRPVASDFE
QTVHSIPLTINKEYALLRPVARDFE

SEQ ID NO: 48442 - protein, 25 aa, synthetic construct
  source 1..25: note = Seed: QTVHSIPLTINKEEALQRPVASDFE
QTVHSIPLTINKEYALLRPVASDFE

SEQ ID NO: 48443 - protein, 25 aa, synthetic construct
  source 1..25: note = Seed: QTVHSIPLTINKEEALQRPVASDFE
QTVHSIPLTINKEYALLRPVATDFE

SEQ ID NO: 48444 - protein, 25 aa, synthetic construct
  source 1..25: note = Seed: QTVHSIPLTINKEEALQRPVASDFE
QTVHSIPLTINKEYALLRPVAVDFE

SEQ ID NO: 48445 - protein, 25 aa, synthetic construct
  source 1..25: note = Seed: QTVHSIPLTINKEEALQRPVASDFE
QTVHSIPLTINKEYALLRPVAWDFE

SEQ ID NO: 48446 - protein, 25 aa, synthetic construct
  source 1..25: note = Seed: QTVHSIPLTINKEEALQRPVASDFE
QTVHSIPLTINKEYALLRPVAYDFE

SEQ ID NO: 48447 - protein, 25 aa, synthetic construct
  source 1..25: note = Seed: QTVHSIPLTINKEEALQRPVASDFE
QTVHSIPLTINKEYALLRQVAADFE

SEQ ID NO: 48448 - protein, 25 aa, synthetic construct
  source 1..25: note = Seed: QTVHSIPLTINKEEALQRPVASDFE
QTVHSIPLTINKEYALLRQVANDFE

SEQ ID NO: 48449 - protein, 25 aa, synthetic construct
  source 1..25: note = Seed: QTVHSIPLTINKEEALQRPVASDFE
QTVHSIPLTINKEYALLRQVASDFE

SEQ ID NO: 48450 - protein, 25 aa, synthetic construct
  source 1..25: note = Seed: QTVHSIPLTINKEEALQRPVASDFE
QTVHSIPLTINKEYALLRQVATDFE

SEQ ID NO: 48451 - protein, 25 aa, synthetic construct
  source 1..25: note = Seed: QTVHSIPLTINKEEALQRPVASDFE
QTVHSIPLTINKEYALLRSVAADFE

SEQ ID NO: 48452 - protein, 25 aa, synthetic construct
  source 1..25: note = Seed: QTVHSIPLTINKEEALQRPVASDFE
QTVHSIPLTINKEYALLRSVACDFE

SEQ ID NO: 48453 - protein, 25 aa, synthetic construct
  source 1..25: note = Seed: QTVHSIPLTINKEEALQRPVASDFE
QTVHSIPLTINKEYALLRSVADDFE

SEQ ID NO: 48454 - protein, 25 aa, synthetic construct
  source 1..25: note = Seed: QTVHSIPLTINKEEALQRPVASDFE
QTVHSIPLTINKEYALLRSVAEDFE

SEQ ID NO: 48455 - protein, 25 aa, synthetic construct
  source 1..25: note = Seed: QTVHSIPLTINKEEALQRPVASDFE
QTVHSIPLTINKEYALLRSVAFDFE

SEQ ID NO: 48456 - protein, 25 aa, synthetic construct
  source 1..25: note = Seed: QTVHSIPLTINKEEALQRPVASDFE
QTVHSIPLTINKEYALLRSVAGDFE

SEQ ID NO: 48457 - protein, 25 aa, synthetic construct
  source 1..25: note = Seed: QTVHSIPLTINKEEALQRPVASDFE
QTVHSIPLTINKEYALLRSVAHDFE

SEQ ID NO: 48458 - protein, 25 aa, synthetic construct
  source 1..25: note = Seed: QTVHSIPLTINKEEALQRPVASDFE
QTVHSIPLTINKEYALLRSVAIDFE

SEQ ID NO: 48459 - protein, 25 aa, synthetic construct
  source 1..25: note = Seed: QTVHSIPLTINKEEALQRPVASDFE
QTVHSIPLTINKEYALLRSVAKDFE

SEQ ID NO: 48460 - protein, 25 aa, synthetic construct
  source 1..25: note = Seed: QTVHSIPLTINKEEALQRPVASDFE
QTVHSIPLTINKEYALLRSVALDFE

SEQ ID NO: 48461 - protein, 25 aa, synthetic construct
  source 1..25: note = Seed: QTVHSIPLTINKEEALQRPVASDFE
QTVHSIPLTINKEYALLRSVAMDFE

SEQ ID NO: 48462 - protein, 25 aa, synthetic construct
  source 1..25: note = Seed: QTVHSIPLTINKEEALQRPVASDFE
QTVHSIPLTINKEYALLRSVANDFE

SEQ ID NO: 48463 - protein, 25 aa, synthetic construct
  source 1..25: note = Seed: QTVHSIPLTINKEEALQRPVASDFE
QTVHSIPLTINKEYALLRSVAPDFE

SEQ ID NO: 48464 - protein, 25 aa, synthetic construct
  source 1..25: note = Seed: QTVHSIPLTINKEEALQRPVASDFE
QTVHSIPLTINKEYALLRSVAQDFE

SEQ ID NO: 48465 - protein, 25 aa, synthetic construct
  source 1..25: note = Seed: QTVHSIPLTINKEEALQRPVASDFE
QTVHSIPLTINKEYALLRSVARDFE

SEQ ID NO: 48466 - protein, 25 aa, synthetic construct
  source 1..25: note = Seed: QTVHSIPLTINKEEALQRPVASDFE
QTVHSIPLTINKEYALLRSVASDFE

SEQ ID NO: 48467 - protein, 25 aa, synthetic construct
  source 1..25: note = Seed: QTVHSIPLTINKEEALQRPVASDFE
QTVHSIPLTINKEYALLRSVATDFE

SEQ ID NO: 48468 - protein, 25 aa, synthetic construct
  source 1..25: note = Seed: QTVHSIPLTINKEEALQRPVASDFE
QTVHSIPLTINKEYALLRSVAVDFE

SEQ ID NO: 48469 - protein, 25 aa, synthetic construct
  source 1..25: note = Seed: QTVHSIPLTINKEEALQRPVASDFE
QTVHSIPLTINKEYALLRSVAYDFE

SEQ ID NO: 48470 - protein, 25 aa, synthetic construct
  source 1..25: note = Seed: QTVHSIPLTINKEEALQRPVASDFE
QTVHSIPLTINKEYALLRTVAADFE

SEQ ID NO: 48471 - protein, 25 aa, synthetic construct
  source 1..25: note = Seed: QTVHSIPLTINKEEALQRPVASDFE
QTVHSIPLTINKEYALLRTVACDFE

SEQ ID NO: 48472 - protein, 25 aa, synthetic construct
  source 1..25: note = Seed: QTVHSIPLTINKEEALQRPVASDFE
QTVHSIPLTINKEYALLRTVADDFE

SEQ ID NO: 48473 - protein, 25 aa, synthetic construct
  source 1..25: note = Seed: QTVHSIPLTINKEEALQRPVASDFE
QTVHSIPLTINKEYALLRTVAEDFE

SEQ ID NO: 48474 - protein, 25 aa, synthetic construct
  source 1..25: note = Seed: QTVHSIPLTINKEEALQRPVASDFE
QTVHSIPLTINKEYALLRTVAFDFE

SEQ ID NO: 48475 - protein, 25 aa, synthetic construct
  source 1..25: note = Seed: QTVHSIPLTINKEEALQRPVASDFE
QTVHSIPLTINKEYALLRTVAGDFE

SEQ ID NO: 48476 - protein, 25 aa, synthetic construct
  source 1..25: note = Seed: QTVHSIPLTINKEEALQRPVASDFE
QTVHSIPLTINKEYALLRTVAHDFE

SEQ ID NO: 48477 - protein, 25 aa, synthetic construct
  source 1..25: note = Seed: QTVHSIPLTINKEEALQRPVASDFE
QTVHSIPLTINKEYALLRTVAIDFE

SEQ ID NO: 48478 - protein, 25 aa, synthetic construct
  source 1..25: note = Seed: QTVHSIPLTINKEEALQRPVASDFE
QTVHSIPLTINKEYALLRTVAKDFE

SEQ ID NO: 48479 - protein, 25 aa, synthetic construct
  source 1..25: note = Seed: QTVHSIPLTINKEEALQRPVASDFE
QTVHSIPLTINKEYALLRTVALDFE

SEQ ID NO: 48480 - protein, 25 aa, synthetic construct
  source 1..25: note = Seed: QTVHSIPLTINKEEALQRPVASDFE
QTVHSIPLTINKEYALLRTVAMDFE

SEQ ID NO: 48481 - protein, 25 aa, synthetic construct
  source 1..25: note = Seed: QTVHSIPLTINKEEALQRPVASDFE
QTVHSIPLTINKEYALLRTVANDFE

SEQ ID NO: 48482 - protein, 25 aa, synthetic construct
  source 1..25: note = Seed: QTVHSIPLTINKEEALQRPVASDFE
QTVHSIPLTINKEYALLRTVAPDFE

SEQ ID NO: 48483 - protein, 25 aa, synthetic construct
  source 1..25: note = Seed: QTVHSIPLTINKEEALQRPVASDFE
QTVHSIPLTINKEYALLRTVAQDFE

SEQ ID NO: 48484 - protein, 25 aa, synthetic construct
  source 1..25: note = Seed: QTVHSIPLTINKEEALQRPVASDFE
QTVHSIPLTINKEYALLRTVARDFE

SEQ ID NO: 48485 - protein, 25 aa, synthetic construct
  source 1..25: note = Seed: QTVHSIPLTINKEEALQRPVASDFE
QTVHSIPLTINKEYALLRTVASDFE

SEQ ID NO: 48486 - protein, 25 aa, synthetic construct
  source 1..25: note = Seed: QTVHSIPLTINKEEALQRPVASDFE
QTVHSIPLTINKEYALLRTVATDFE

SEQ ID NO: 48487 - protein, 25 aa, synthetic construct
  source 1..25: note = Seed: QTVHSIPLTINKEEALQRPVASDFE
QTVHSIPLTINKEYALLRTVAVDFE

SEQ ID NO: 48488 - protein, 25 aa, synthetic construct
  source 1..25: note = Seed: QTVHSIPLTINKEEALQRPVASDFE
QTVHSIPLTINKEYALLRTVAYDFE

SEQ ID NO: 48489 - protein, 25 aa, synthetic construct
  source 1..25: note = Seed: QTVHSIPLTINKEEALQRPVASDFE
QTVHSIPLTINKEYALLRVVAADFE

SEQ ID NO: 48490 - protein, 25 aa, synthetic construct
  source 1..25: note = Seed: QTVHSIPLTINKEEALQRPVASDFE
QTVHSIPLTINKEYALLRVVADDFE

SEQ ID NO: 48491 - protein, 25 aa, synthetic construct
  source 1..25: note = Seed: QTVHSIPLTINKEEALQRPVASDFE
QTVHSIPLTINKEYALLRVVAEDFE

SEQ ID NO: 48492 - protein, 25 aa, synthetic construct
  source 1..25: note = Seed: QTVHSIPLTINKEEALQRPVASDFE
QTVHSIPLTINKEYALLRVVAGDFE

SEQ ID NO: 48493 - protein, 25 aa, synthetic construct
  source 1..25: note = Seed: QTVHSIPLTINKEEALQRPVASDFE
QTVHSIPLTINKEYALLRVVAHDFE

SEQ ID NO: 48494 - protein, 25 aa, synthetic construct
  source 1..25: note = Seed: QTVHSIPLTINKEEALQRPVASDFE
QTVHSIPLTINKEYALLRVVAIDFE

SEQ ID NO: 48495 - protein, 25 aa, synthetic construct
  source 1..25: note = Seed: QTVHSIPLTINKEEALQRPVASDFE
QTVHSIPLTINKEYALLRVVAKDFE

SEQ ID NO: 48496 - protein, 25 aa, synthetic construct
  source 1..25: note = Seed: QTVHSIPLTINKEEALQRPVASDFE
QTVHSIPLTINKEYALLRVVALDFE

SEQ ID NO: 48497 - protein, 25 aa, synthetic construct
  source 1..25: note = Seed: QTVHSIPLTINKEEALQRPVASDFE
QTVHSIPLTINKEYALLRVVAMDFE

SEQ ID NO: 48498 - protein, 25 aa, synthetic construct
  source 1..25: note = Seed: QTVHSIPLTINKEEALQRPVASDFE
QTVHSIPLTINKEYALLRVVANDFE

SEQ ID NO: 48499 - protein, 25 aa, synthetic construct
  source 1..25: note = Seed: QTVHSIPLTINKEEALQRPVASDFE
QTVHSIPLTINKEYALLRVVAPDFE

SEQ ID NO: 48500 - protein, 25 aa, synthetic construct
  source 1..25: note = Seed: QTVHSIPLTINKEEALQRPVASDFE
QTVHSIPLTINKEYALLRVVAQDFE

SEQ ID NO: 48501 - protein, 25 aa, synthetic construct
  source 1..25: note = Seed: QTVHSIPLTINKEEALQRPVASDFE
QTVHSIPLTINKEYALLRVVARDFE

SEQ ID NO: 48502 - protein, 25 aa, synthetic construct
  source 1..25: note = Seed: QTVHSIPLTINKEEALQRPVASDFE
QTVHSIPLTINKEYALLRVVASDFE

SEQ ID NO: 48503 - protein, 25 aa, synthetic construct
  source 1..25: note = Seed: QTVHSIPLTINKEEALQRPVASDFE
QTVHSIPLTINKEYALLRVVATDFE

SEQ ID NO: 48504 - protein, 25 aa, synthetic construct
  source 1..25: note = Seed: QTVHSIPLTINKEEALQRPVASDFE
QTVHSIPLTINKEYALLRVVAVDFE

SEQ ID NO: 48505 - protein, 25 aa, synthetic construct
  source 1..25: note = Seed: QTVHSIPLTINKEEALQRPVASDFE
QTVHSIPLTINKEYALMRAVAADFE

SEQ ID NO: 48506 - protein, 25 aa, synthetic construct
  source 1..25: note = Seed: QTVHSIPLTINKEEALQRPVASDFE
QTVHSIPLTINKEYALMRAVACDFE

SEQ ID NO: 48507 - protein, 25 aa, synthetic construct
  source 1..25: note = Seed: QTVHSIPLTINKEEALQRPVASDFE
QTVHSIPLTINKEYALMRAVADDFE

SEQ ID NO: 48508 - protein, 25 aa, synthetic construct
  source 1..25: note = Seed: QTVHSIPLTINKEEALQRPVASDFE
QTVHSIPLTINKEYALMRAVAEDFE

SEQ ID NO: 48509 - protein, 25 aa, synthetic construct
  source 1..25: note = Seed: QTVHSIPLTINKEEALQRPVASDFE
QTVHSIPLTINKEYALMRAVAFDFE

SEQ ID NO: 48510 - protein, 25 aa, synthetic construct
  source 1..25: note = Seed: QTVHSIPLTINKEEALQRPVASDFE
QTVHSIPLTINKEYALMRAVAGDFE

SEQ ID NO: 48511 - protein, 25 aa, synthetic construct
  source 1..25: note = Seed: QTVHSIPLTINKEEALQRPVASDFE
QTVHSIPLTINKEYALMRAVAHDFE

SEQ ID NO: 48512 - protein, 25 aa, synthetic construct
  source 1..25: note = Seed: QTVHSIPLTINKEEALQRPVASDFE
QTVHSIPLTINKEYALMRAVAIDFE

SEQ ID NO: 48513 - protein, 25 aa, synthetic construct
  source 1..25: note = Seed: QTVHSIPLTINKEEALQRPVASDFE
QTVHSIPLTINKEYALMRAVAKDFE

SEQ ID NO: 48514 - protein, 25 aa, synthetic construct
  source 1..25: note = Seed: QTVHSIPLTINKEEALQRPVASDFE
QTVHSIPLTINKEYALMRAVALDFE

SEQ ID NO: 48515 - protein, 25 aa, synthetic construct
  source 1..25: note = Seed: QTVHSIPLTINKEEALQRPVASDFE
QTVHSIPLTINKEYALMRAVAMDFE

SEQ ID NO: 48516 - protein, 25 aa, synthetic construct
  source 1..25: note = Seed: QTVHSIPLTINKEEALQRPVASDFE
QTVHSIPLTINKEYALMRAVANDFE

SEQ ID NO: 48517 - protein, 25 aa, synthetic construct
  source 1..25: note = Seed: QTVHSIPLTINKEEALQRPVASDFE
QTVHSIPLTINKEYALMRAVAPDFE

SEQ ID NO: 48518 - protein, 25 aa, synthetic construct
  source 1..25: note = Seed: QTVHSIPLTINKEEALQRPVASDFE
QTVHSIPLTINKEYALMRAVAQDFE

SEQ ID NO: 48519 - protein, 25 aa, synthetic construct
  source 1..25: note = Seed: QTVHSIPLTINKEEALQRPVASDFE
QTVHSIPLTINKEYALMRAVARDFE

SEQ ID NO: 48520 - protein, 25 aa, synthetic construct
  source 1..25: note = Seed: QTVHSIPLTINKEEALQRPVASDFE
QTVHSIPLTINKEYALMRAVASDFE

SEQ ID NO: 48521 - protein, 25 aa, synthetic construct
  source 1..25: note = Seed: QTVHSIPLTINKEEALQRPVASDFE
QTVHSIPLTINKEYALMRAVATDFE

SEQ ID NO: 48522 - protein, 25 aa, synthetic construct
  source 1..25: note = Seed: QTVHSIPLTINKEEALQRPVASDFE
QTVHSIPLTINKEYALMRAVAVDFE

SEQ ID NO: 48523 - protein, 25 aa, synthetic construct
  source 1..25: note = Seed: QTVHSIPLTINKEEALQRPVASDFE
QTVHSIPLTINKEYALMRAVAYDFE

SEQ ID NO: 48524 - protein, 25 aa, synthetic construct
  source 1..25: note = Seed: QTVHSIPLTINKEEALQRPVASDFE
QTVHSIPLTINKEYALMRCVAADFE

SEQ ID NO: 48525 - protein, 25 aa, synthetic construct
  source 1..25: note = Seed: QTVHSIPLTINKEEALQRPVASDFE
QTVHSIPLTINKEYALMRCVAHDFE

SEQ ID NO: 48526 - protein, 25 aa, synthetic construct
  source 1..25: note = Seed: QTVHSIPLTINKEEALQRPVASDFE
QTVHSIPLTINKEYALMRCVANDFE

SEQ ID NO: 48527 - protein, 25 aa, synthetic construct
  source 1..25: note = Seed: QTVHSIPLTINKEEALQRPVASDFE
QTVHSIPLTINKEYALMRCVASDFE

SEQ ID NO: 48528 - protein, 25 aa, synthetic construct
  source 1..25: note = Seed: QTVHSIPLTINKEEALQRPVASDFE
QTVHSIPLTINKEYALMRDVAADFE

SEQ ID NO: 48529 - protein, 25 aa, synthetic construct
  source 1..25: note = Seed: QTVHSIPLTINKEEALQRPVASDFE
QTVHSIPLTINKEYALMRDVAIDFE

SEQ ID NO: 48530 - protein, 25 aa, synthetic construct
  source 1..25: note = Seed: QTVHSIPLTINKEEALQRPVASDFE
QTVHSIPLTINKEYALMRDVALDFE

SEQ ID NO: 48531 - protein, 25 aa, synthetic construct
  source 1..25: note = Seed: QTVHSIPLTINKEEALQRPVASDFE
QTVHSIPLTINKEYALMRDVANDFE

SEQ ID NO: 48532 - protein, 25 aa, synthetic construct
  source 1..25: note = Seed: QTVHSIPLTINKEEALQRPVASDFE
QTVHSIPLTINKEYALMRDVASDFE

SEQ ID NO: 48533 - protein, 25 aa, synthetic construct
  source 1..25: note = Seed: QTVHSIPLTINKEEALQRPVASDFE
QTVHSIPLTINKEYALMRDVATDFE

SEQ ID NO: 48534 - protein, 25 aa, synthetic construct
  source 1..25: note = Seed: QTVHSIPLTINKEEALQRPVASDFE
QTVHSIPLTINKEYALMRDVAVDFE

SEQ ID NO: 48535 - protein, 25 aa, synthetic construct
  source 1..25: note = Seed: QTVHSIPLTINKEEALQRPVASDFE
QTVHSIPLTINKEYALMREVAADFE

SEQ ID NO: 48536 - protein, 25 aa, synthetic construct
  source 1..25: note = Seed: QTVHSIPLTINKEEALQRPVASDFE
QTVHSIPLTINKEYALMREVAGDFE

SEQ ID NO: 48537 - protein, 25 aa, synthetic construct
  source 1..25: note = Seed: QTVHSIPLTINKEEALQRPVASDFE
QTVHSIPLTINKEYALMREVAIDFE

SEQ ID NO: 48538 - protein, 25 aa, synthetic construct
  source 1..25: note = Seed: QTVHSIPLTINKEEALQRPVASDFE
QTVHSIPLTINKEYALMREVALDFE

SEQ ID NO: 48539 - protein, 25 aa, synthetic construct
  source 1..25: note = Seed: QTVHSIPLTINKEEALQRPVASDFE
QTVHSIPLTINKEYALMREVANDFE

SEQ ID NO: 48540 - protein, 25 aa, synthetic construct
  source 1..25: note = Seed: QTVHSIPLTINKEEALQRPVASDFE
QTVHSIPLTINKEYALMREVASDFE

SEQ ID NO: 48541 - protein, 25 aa, synthetic construct
  source 1..25: note = Seed: QTVHSIPLTINKEEALQRPVASDFE
QTVHSIPLTINKEYALMREVATDFE

SEQ ID NO: 48542 - protein, 25 aa, synthetic construct
  source 1..25: note = Seed: QTVHSIPLTINKEEALQRPVASDFE
QTVHSIPLTINKEYALMREVAVDFE

SEQ ID NO: 48543 - protein, 25 aa, synthetic construct
  source 1..25: note = Seed: QTVHSIPLTINKEEALQRPVASDFE
QTVHSIPLTINKEYALMRFVANDFE

SEQ ID NO: 48544 - protein, 25 aa, synthetic construct
  source 1..25: note = Seed: QTVHSIPLTINKEEALQRPVASDFE
QTVHSIPLTINKEYALMRGVAADFE

SEQ ID NO: 48545 - protein, 25 aa, synthetic construct
  source 1..25: note = Seed: QTVHSIPLTINKEEALQRPVASDFE
QTVHSIPLTINKEYALMRGVACDFE

SEQ ID NO: 48546 - protein, 25 aa, synthetic construct
  source 1..25: note = Seed: QTVHSIPLTINKEEALQRPVASDFE
QTVHSIPLTINKEYALMRGVADDFE

SEQ ID NO: 48547 - protein, 25 aa, synthetic construct
  source 1..25: note = Seed: QTVHSIPLTINKEEALQRPVASDFE
QTVHSIPLTINKEYALMRGVAEDFE

SEQ ID NO: 48548 - protein, 25 aa, synthetic construct
  source 1..25: note = Seed: QTVHSIPLTINKEEALQRPVASDFE
QTVHSIPLTINKEYALMRGVAFDFE

SEQ ID NO: 48549 - protein, 25 aa, synthetic construct
  source 1..25: note = Seed: QTVHSIPLTINKEEALQRPVASDFE
QTVHSIPLTINKEYALMRGVAGDFE

SEQ ID NO: 48550 - protein, 25 aa, synthetic construct
  source 1..25: note = Seed: QTVHSIPLTINKEEALQRPVASDFE
QTVHSIPLTINKEYALMRGVAHDFE

SEQ ID NO: 48551 - protein, 25 aa, synthetic construct
  source 1..25: note = Seed: QTVHSIPLTINKEEALQRPVASDFE
QTVHSIPLTINKEYALMRGVAIDFE

SEQ ID NO: 48552 - protein, 25 aa, synthetic construct
  source 1..25: note = Seed: QTVHSIPLTINKEEALQRPVASDFE
QTVHSIPLTINKEYALMRGVAKDFE

SEQ ID NO: 48553 - protein, 25 aa, synthetic construct
  source 1..25: note = Seed: QTVHSIPLTINKEEALQRPVASDFE
QTVHSIPLTINKEYALMRGVALDFE

SEQ ID NO: 48554 - protein, 25 aa, synthetic construct
  source 1..25: note = Seed: QTVHSIPLTINKEEALQRPVASDFE
QTVHSIPLTINKEYALMRGVAMDFE

SEQ ID NO: 48555 - protein, 25 aa, synthetic construct
  source 1..25: note = Seed: QTVHSIPLTINKEEALQRPVASDFE
QTVHSIPLTINKEYALMRGVANDFE

SEQ ID NO: 48556 - protein, 25 aa, synthetic construct
  source 1..25: note = Seed: QTVHSIPLTINKEEALQRPVASDFE
QTVHSIPLTINKEYALMRGVAPDFE

SEQ ID NO: 48557 - protein, 25 aa, synthetic construct
  source 1..25: note = Seed: QTVHSIPLTINKEEALQRPVASDFE
QTVHSIPLTINKEYALMRGVAQDFE

SEQ ID NO: 48558 - protein, 25 aa, synthetic construct
  source 1..25: note = Seed: QTVHSIPLTINKEEALQRPVASDFE
QTVHSIPLTINKEYALMRGVARDFE

SEQ ID NO: 48559 - protein, 25 aa, synthetic construct
  source 1..25: note = Seed: QTVHSIPLTINKEEALQRPVASDFE
QTVHSIPLTINKEYALMRGVASDFE

SEQ ID NO: 48560 - protein, 25 aa, synthetic construct
  source 1..25: note = Seed: QTVHSIPLTINKEEALQRPVASDFE
QTVHSIPLTINKEYALMRGVATDFE

SEQ ID NO: 48561 - protein, 25 aa, synthetic construct
  source 1..25: note = Seed: QTVHSIPLTINKEEALQRPVASDFE
QTVHSIPLTINKEYALMRGVAVDFE

SEQ ID NO: 48562 - protein, 25 aa, synthetic construct
  source 1..25: note = Seed: QTVHSIPLTINKEEALQRPVASDFE
QTVHSIPLTINKEYALMRGVAYDFE

SEQ ID NO: 48563 - protein, 25 aa, synthetic construct
  source 1..25: note = Seed: QTVHSIPLTINKEEALQRPVASDFE
QTVHSIPLTINKEYALMRHVAADFE

SEQ ID NO: 48564 - protein, 25 aa, synthetic construct
  source 1..25: note = Seed: QTVHSIPLTINKEEALQRPVASDFE
QTVHSIPLTINKEYALMRHVAGDFE

SEQ ID NO: 48565 - protein, 25 aa, synthetic construct
  source 1..25: note = Seed: QTVHSIPLTINKEEALQRPVASDFE
QTVHSIPLTINKEYALMRHVAHDFE

SEQ ID NO: 48566 - protein, 25 aa, synthetic construct
  source 1..25: note = Seed: QTVHSIPLTINKEEALQRPVASDFE
QTVHSIPLTINKEYALMRHVAIDFE

SEQ ID NO: 48567 - protein, 25 aa, synthetic construct
  source 1..25: note = Seed: QTVHSIPLTINKEEALQRPVASDFE
QTVHSIPLTINKEYALMRHVALDFE

SEQ ID NO: 48568 - protein, 25 aa, synthetic construct
  source 1..25: note = Seed: QTVHSIPLTINKEEALQRPVASDFE
QTVHSIPLTINKEYALMRHVAMDFE

SEQ ID NO: 48569 - protein, 25 aa, synthetic construct
  source 1..25: note = Seed: QTVHSIPLTINKEEALQRPVASDFE
QTVHSIPLTINKEYALMRHVANDFE

SEQ ID NO: 48570 - protein, 25 aa, synthetic construct
  source 1..25: note = Seed: QTVHSIPLTINKEEALQRPVASDFE
QTVHSIPLTINKEYALMRHVAQDFE

SEQ ID NO: 48571 - protein, 25 aa, synthetic construct
  source 1..25: note = Seed: QTVHSIPLTINKEEALQRPVASDFE
QTVHSIPLTINKEYALMRHVASDFE

SEQ ID NO: 48572 - protein, 25 aa, synthetic construct
  source 1..25: note = Seed: QTVHSIPLTINKEEALQRPVASDFE
QTVHSIPLTINKEYALMRHVATDFE

SEQ ID NO: 48573 - protein, 25 aa, synthetic construct
  source 1..25: note = Seed: QTVHSIPLTINKEEALQRPVASDFE
QTVHSIPLTINKEYALMRHVAVDFE

SEQ ID NO: 48574 - protein, 25 aa, synthetic construct
  source 1..25: note = Seed: QTVHSIPLTINKEEALQRPVASDFE
QTVHSIPLTINKEYALMRIVAADFE

SEQ ID NO: 48575 - protein, 25 aa, synthetic construct
  source 1..25: note = Seed: QTVHSIPLTINKEEALQRPVASDFE
QTVHSIPLTINKEYALMRIVADDFE

SEQ ID NO: 48576 - protein, 25 aa, synthetic construct
  source 1..25: note = Seed: QTVHSIPLTINKEEALQRPVASDFE
QTVHSIPLTINKEYALMRIVAEDFE

SEQ ID NO: 48577 - protein, 25 aa, synthetic construct
  source 1..25: note = Seed: QTVHSIPLTINKEEALQRPVASDFE
QTVHSIPLTINKEYALMRIVAGDFE

SEQ ID NO: 48578 - protein, 25 aa, synthetic construct
  source 1..25: note = Seed: QTVHSIPLTINKEEALQRPVASDFE
QTVHSIPLTINKEYALMRIVAHDFE

SEQ ID NO: 48579 - protein, 25 aa, synthetic construct
  source 1..25: note = Seed: QTVHSIPLTINKEEALQRPVASDFE
QTVHSIPLTINKEYALMRIVAIDFE

SEQ ID NO: 48580 - protein, 25 aa, synthetic construct
  source 1..25: note = Seed: QTVHSIPLTINKEEALQRPVASDFE
QTVHSIPLTINKEYALMRIVAKDFE

SEQ ID NO: 48581 - protein, 25 aa, synthetic construct
  source 1..25: note = Seed: QTVHSIPLTINKEEALQRPVASDFE
QTVHSIPLTINKEYALMRIVALDFE

SEQ ID NO: 48582 - protein, 25 aa, synthetic construct
  source 1..25: note = Seed: QTVHSIPLTINKEEALQRPVASDFE
QTVHSIPLTINKEYALMRIVAMDFE

SEQ ID NO: 48583 - protein, 25 aa, synthetic construct
  source 1..25: note = Seed: QTVHSIPLTINKEEALQRPVASDFE
QTVHSIPLTINKEYALMRIVANDFE

SEQ ID NO: 48584 - protein, 25 aa, synthetic construct
  source 1..25: note = Seed: QTVHSIPLTINKEEALQRPVASDFE
QTVHSIPLTINKEYALMRIVAPDFE

SEQ ID NO: 48585 - protein, 25 aa, synthetic construct
  source 1..25: note = Seed: QTVHSIPLTINKEEALQRPVASDFE
QTVHSIPLTINKEYALMRIVAQDFE

SEQ ID NO: 48586 - protein, 25 aa, synthetic construct
  source 1..25: note = Seed: QTVHSIPLTINKEEALQRPVASDFE
QTVHSIPLTINKEYALMRIVARDFE

SEQ ID NO: 48587 - protein, 25 aa, synthetic construct
  source 1..25: note = Seed: QTVHSIPLTINKEEALQRPVASDFE
QTVHSIPLTINKEYALMRIVASDFE

SEQ ID NO: 48588 - protein, 25 aa, synthetic construct
  source 1..25: note = Seed: QTVHSIPLTINKEEALQRPVASDFE
QTVHSIPLTINKEYALMRIVATDFE

SEQ ID NO: 48589 - protein, 25 aa, synthetic construct
  source 1..25: note = Seed: QTVHSIPLTINKEEALQRPVASDFE
QTVHSIPLTINKEYALMRIVAVDFE

SEQ ID NO: 48590 - protein, 25 aa, synthetic construct
  source 1..25: note = Seed: QTVHSIPLTINKEEALQRPVASDFE
QTVHSIPLTINKEYALMRKVAADFE

SEQ ID NO: 48591 - protein, 25 aa, synthetic construct
  source 1..25: note = Seed: QTVHSIPLTINKEEALQRPVASDFE
QTVHSIPLTINKEYALMRKVASDFE

SEQ ID NO: 48592 - protein, 25 aa, synthetic construct
  source 1..25: note = Seed: QTVHSIPLTINKEEALQRPVASDFE
QTVHSIPLTINKEYALMRLVAADFE

SEQ ID NO: 48593 - protein, 25 aa, synthetic construct
  source 1..25: note = Seed: QTVHSIPLTINKEEALQRPVASDFE
QTVHSIPLTINKEYALMRLVADDFE

SEQ ID NO: 48594 - protein, 25 aa, synthetic construct
  source 1..25: note = Seed: QTVHSIPLTINKEEALQRPVASDFE
QTVHSIPLTINKEYALMRLVAGDFE

SEQ ID NO: 48595 - protein, 25 aa, synthetic construct
  source 1..25: note = Seed: QTVHSIPLTINKEEALQRPVASDFE
QTVHSIPLTINKEYALMRLVAHDFE

SEQ ID NO: 48596 - protein, 25 aa, synthetic construct
  source 1..25: note = Seed: QTVHSIPLTINKEEALQRPVASDFE
QTVHSIPLTINKEYALMRLVAKDFE

SEQ ID NO: 48597 - protein, 25 aa, synthetic construct
  source 1..25: note = Seed: QTVHSIPLTINKEEALQRPVASDFE
QTVHSIPLTINKEYALMRLVANDFE

SEQ ID NO: 48598 - protein, 25 aa, synthetic construct
  source 1..25: note = Seed: QTVHSIPLTINKEEALQRPVASDFE
QTVHSIPLTINKEYALMRLVASDFE

SEQ ID NO: 48599 - protein, 25 aa, synthetic construct
  source 1..25: note = Seed: QTVHSIPLTINKEEALQRPVASDFE
QTVHSIPLTINKEYALMRLVATDFE

SEQ ID NO: 48600 - protein, 25 aa, synthetic construct
  source 1..25: note = Seed: QTVHSIPLTINKEEALQRPVASDFE
QTVHSIPLTINKEYALMRMVAADFE

SEQ ID NO: 48601 - protein, 25 aa, synthetic construct
  source 1..25: note = Seed: QTVHSIPLTINKEEALQRPVASDFE
QTVHSIPLTINKEYALMRMVADDFE

SEQ ID NO: 48602 - protein, 25 aa, synthetic construct
  source 1..25: note = Seed: QTVHSIPLTINKEEALQRPVASDFE
QTVHSIPLTINKEYALMRMVAGDFE

SEQ ID NO: 48603 - protein, 25 aa, synthetic construct
  source 1..25: note = Seed: QTVHSIPLTINKEEALQRPVASDFE
QTVHSIPLTINKEYALMRMVAHDFE

SEQ ID NO: 48604 - protein, 25 aa, synthetic construct
  source 1..25: note = Seed: QTVHSIPLTINKEEALQRPVASDFE
QTVHSIPLTINKEYALMRMVAMDFE

SEQ ID NO: 48605 - protein, 25 aa, synthetic construct
  source 1..25: note = Seed: QTVHSIPLTINKEEALQRPVASDFE
QTVHSIPLTINKEYALMRMVANDFE

SEQ ID NO: 48606 - protein, 25 aa, synthetic construct
  source 1..25: note = Seed: QTVHSIPLTINKEEALQRPVASDFE
QTVHSIPLTINKEYALMRMVAQDFE

SEQ ID NO: 48607 - protein, 25 aa, synthetic construct
  source 1..25: note = Seed: QTVHSIPLTINKEEALQRPVASDFE
QTVHSIPLTINKEYALMRMVASDFE

SEQ ID NO: 48608 - protein, 25 aa, synthetic construct
  source 1..25: note = Seed: QTVHSIPLTINKEEALQRPVASDFE
QTVHSIPLTINKEYALMRMVATDFE

SEQ ID NO: 48609 - protein, 25 aa, synthetic construct
  source 1..25: note = Seed: QTVHSIPLTINKEEALQRPVASDFE
QTVHSIPLTINKEYALMRMVAVDFE

SEQ ID NO: 48610 - protein, 25 aa, synthetic construct
  source 1..25: note = Seed: QTVHSIPLTINKEEALQRPVASDFE
QTVHSIPLTINKEYALMRNVAADFE

SEQ ID NO: 48611 - protein, 25 aa, synthetic construct
  source 1..25: note = Seed: QTVHSIPLTINKEEALQRPVASDFE
QTVHSIPLTINKEYALMRNVACDFE

SEQ ID NO: 48612 - protein, 25 aa, synthetic construct
  source 1..25: note = Seed: QTVHSIPLTINKEEALQRPVASDFE
QTVHSIPLTINKEYALMRNVADDFE

SEQ ID NO: 48613 - protein, 25 aa, synthetic construct
  source 1..25: note = Seed: QTVHSIPLTINKEEALQRPVASDFE
QTVHSIPLTINKEYALMRNVAEDFE

SEQ ID NO: 48614 - protein, 25 aa, synthetic construct
  source 1..25: note = Seed: QTVHSIPLTINKEEALQRPVASDFE
QTVHSIPLTINKEYALMRNVAFDFE

SEQ ID NO: 48615 - protein, 25 aa, synthetic construct
  source 1..25: note = Seed: QTVHSIPLTINKEEALQRPVASDFE
QTVHSIPLTINKEYALMRNVAGDFE

SEQ ID NO: 48616 - protein, 25 aa, synthetic construct
  source 1..25: note = Seed: QTVHSIPLTINKEEALQRPVASDFE
QTVHSIPLTINKEYALMRNVAHDFE

SEQ ID NO: 48617 - protein, 25 aa, synthetic construct
  source 1..25: note = Seed: QTVHSIPLTINKEEALQRPVASDFE
QTVHSIPLTINKEYALMRNVAIDFE

SEQ ID NO: 48618 - protein, 25 aa, synthetic construct
  source 1..25: note = Seed: QTVHSIPLTINKEEALQRPVASDFE
QTVHSIPLTINKEYALMRNVAKDFE

SEQ ID NO: 48619 - protein, 25 aa, synthetic construct
  source 1..25: note = Seed: QTVHSIPLTINKEEALQRPVASDFE
QTVHSIPLTINKEYALMRNVALDFE

SEQ ID NO: 48620 - protein, 25 aa, synthetic construct
  source 1..25: note = Seed: QTVHSIPLTINKEEALQRPVASDFE
QTVHSIPLTINKEYALMRNVAMDFE

SEQ ID NO: 48621 - protein, 25 aa, synthetic construct
  source 1..25: note = Seed: QTVHSIPLTINKEEALQRPVASDFE
QTVHSIPLTINKEYALMRNVANDFE

SEQ ID NO: 48622 - protein, 25 aa, synthetic construct
  source 1..25: note = Seed: QTVHSIPLTINKEEALQRPVASDFE
QTVHSIPLTINKEYALMRNVAPDFE

SEQ ID NO: 48623 - protein, 25 aa, synthetic construct
  source 1..25: note = Seed: QTVHSIPLTINKEEALQRPVASDFE
QTVHSIPLTINKEYALMRNVAQDFE

SEQ ID NO: 48624 - protein, 25 aa, synthetic construct
  source 1..25: note = Seed: QTVHSIPLTINKEEALQRPVASDFE
QTVHSIPLTINKEYALMRNVARDFE

SEQ ID NO: 48625 - protein, 25 aa, synthetic construct
  source 1..25: note = Seed: QTVHSIPLTINKEEALQRPVASDFE
QTVHSIPLTINKEYALMRNVASDFE

SEQ ID NO: 48626 - protein, 25 aa, synthetic construct
  source 1..25: note = Seed: QTVHSIPLTINKEEALQRPVASDFE
QTVHSIPLTINKEYALMRNVATDFE

SEQ ID NO: 48627 - protein, 25 aa, synthetic construct
  source 1..25: note = Seed: QTVHSIPLTINKEEALQRPVASDFE
QTVHSIPLTINKEYALMRNVAVDFE

SEQ ID NO: 48628 - protein, 25 aa, synthetic construct
  source 1..25: note = Seed: QTVHSIPLTINKEEALQRPVASDFE
QTVHSIPLTINKEYALMRNVAYDFE

SEQ ID NO: 48629 - protein, 25 aa, synthetic construct
  source 1..25: note = Seed: QTVHSIPLTINKEEALQRPVASDFE
QTVHSIPLTINKEYALMRPVAADFE

SEQ ID NO: 48630 - protein, 25 aa, synthetic construct
  source 1..25: note = Seed: QTVHSIPLTINKEEALQRPVASDFE
QTVHSIPLTINKEYALMRPVACDFE

SEQ ID NO: 48631 - protein, 25 aa, synthetic construct
  source 1..25: note = Seed: QTVHSIPLTINKEEALQRPVASDFE
QTVHSIPLTINKEYALMRPVADDFE

SEQ ID NO: 48632 - protein, 25 aa, synthetic construct
  source 1..25: note = Seed: QTVHSIPLTINKEEALQRPVASDFE
QTVHSIPLTINKEYALMRPVAEDFE

SEQ ID NO: 48633 - protein, 25 aa, synthetic construct
  source 1..25: note = Seed: QTVHSIPLTINKEEALQRPVASDFE
QTVHSIPLTINKEYALMRPVAFDFE

SEQ ID NO: 48634 - protein, 25 aa, synthetic construct
  source 1..25: note = Seed: QTVHSIPLTINKEEALQRPVASDFE
QTVHSIPLTINKEYALMRPVAGDFE

SEQ ID NO: 48635 - protein, 25 aa, synthetic construct
  source 1..25: note = Seed: QTVHSIPLTINKEEALQRPVASDFE
QTVHSIPLTINKEYALMRPVAHDFE

SEQ ID NO: 48636 - protein, 25 aa, synthetic construct
  source 1..25: note = Seed: QTVHSIPLTINKEEALQRPVASDFE
QTVHSIPLTINKEYALMRPVAIDFE

SEQ ID NO: 48637 - protein, 25 aa, synthetic construct
  source 1..25: note = Seed: QTVHSIPLTINKEEALQRPVASDFE
QTVHSIPLTINKEYALMRPVAKDFE

SEQ ID NO: 48638 - protein, 25 aa, synthetic construct
  source 1..25: note = Seed: QTVHSIPLTINKEEALQRPVASDFE
QTVHSIPLTINKEYALMRPVALDFE

SEQ ID NO: 48639 - protein, 25 aa, synthetic construct
  source 1..25: note = Seed: QTVHSIPLTINKEEALQRPVASDFE
QTVHSIPLTINKEYALMRPVAMDFE

SEQ ID NO: 48640 - protein, 25 aa, synthetic construct
  source 1..25: note = Seed: QTVHSIPLTINKEEALQRPVASDFE
QTVHSIPLTINKEYALMRPVANDFE

SEQ ID NO: 48641 - protein, 25 aa, synthetic construct
  source 1..25: note = Seed: QTVHSIPLTINKEEALQRPVASDFE
QTVHSIPLTINKEYALMRPVAPDFE

SEQ ID NO: 48642 - protein, 25 aa, synthetic construct
  source 1..25: note = Seed: QTVHSIPLTINKEEALQRPVASDFE
QTVHSIPLTINKEYALMRPVAQDFE

SEQ ID NO: 48643 - protein, 25 aa, synthetic construct
  source 1..25: note = Seed: QTVHSIPLTINKEEALQRPVASDFE
QTVHSIPLTINKEYALMRPVARDFE

SEQ ID NO: 48644 - protein, 25 aa, synthetic construct
  source 1..25: note = Seed: QTVHSIPLTINKEEALQRPVASDFE
QTVHSIPLTINKEYALMRPVASDFE

SEQ ID NO: 48645 - protein, 25 aa, synthetic construct
  source 1..25: note = Seed: QTVHSIPLTINKEEALQRPVASDFE
QTVHSIPLTINKEYALMRPVATDFE

SEQ ID NO: 48646 - protein, 25 aa, synthetic construct
  source 1..25: note = Seed: QTVHSIPLTINKEEALQRPVASDFE
QTVHSIPLTINKEYALMRPVAVDFE

SEQ ID NO: 48647 - protein, 25 aa, synthetic construct
  source 1..25: note = Seed: QTVHSIPLTINKEEALQRPVASDFE
QTVHSIPLTINKEYALMRPVAWDFE

SEQ ID NO: 48648 - protein, 25 aa, synthetic construct
  source 1..25: note = Seed: QTVHSIPLTINKEEALQRPVASDFE
QTVHSIPLTINKEYALMRPVAYDFE

SEQ ID NO: 48649 - protein, 25 aa, synthetic construct
  source 1..25: note = Seed: QTVHSIPLTINKEEALQRPVASDFE
QTVHSIPLTINKEYALMRQVAADFE

SEQ ID NO: 48650 - protein, 25 aa, synthetic construct
  source 1..25: note = Seed: QTVHSIPLTINKEEALQRPVASDFE
QTVHSIPLTINKEYALMRQVAGDFE

SEQ ID NO: 48651 - protein, 25 aa, synthetic construct
  source 1..25: note = Seed: QTVHSIPLTINKEEALQRPVASDFE
QTVHSIPLTINKEYALMRQVAIDFE

SEQ ID NO: 48652 - protein, 25 aa, synthetic construct
  source 1..25: note = Seed: QTVHSIPLTINKEEALQRPVASDFE
QTVHSIPLTINKEYALMRQVAMDFE

SEQ ID NO: 48653 - protein, 25 aa, synthetic construct
  source 1..25: note = Seed: QTVHSIPLTINKEEALQRPVASDFE
QTVHSIPLTINKEYALMRQVANDFE

SEQ ID NO: 48654 - protein, 25 aa, synthetic construct
  source 1..25: note = Seed: QTVHSIPLTINKEEALQRPVASDFE
QTVHSIPLTINKEYALMRQVASDFE

SEQ ID NO: 48655 - protein, 25 aa, synthetic construct
  source 1..25: note = Seed: QTVHSIPLTINKEEALQRPVASDFE
QTVHSIPLTINKEYALMRQVATDFE

SEQ ID NO: 48656 - protein, 25 aa, synthetic construct
  source 1..25: note = Seed: QTVHSIPLTINKEEALQRPVASDFE
QTVHSIPLTINKEYALMRQVAVDFE

SEQ ID NO: 48657 - protein, 25 aa, synthetic construct
  source 1..25: note = Seed: QTVHSIPLTINKEEALQRPVASDFE
QTVHSIPLTINKEYALMRRVAADFE

SEQ ID NO: 48658 - protein, 25 aa, synthetic construct
  source 1..25: note = Seed: QTVHSIPLTINKEEALQRPVASDFE
QTVHSIPLTINKEYALMRSVAADFE

SEQ ID NO: 48659 - protein, 25 aa, synthetic construct
  source 1..25: note = Seed: QTVHSIPLTINKEEALQRPVASDFE
QTVHSIPLTINKEYALMRSVACDFE

SEQ ID NO: 48660 - protein, 25 aa, synthetic construct
  source 1..25: note = Seed: QTVHSIPLTINKEEALQRPVASDFE
QTVHSIPLTINKEYALMRSVADDFE

SEQ ID NO: 48661 - protein, 25 aa, synthetic construct
  source 1..25: note = Seed: QTVHSIPLTINKEEALQRPVASDFE
QTVHSIPLTINKEYALMRSVAEDFE

SEQ ID NO: 48662 - protein, 25 aa, synthetic construct
  source 1..25: note = Seed: QTVHSIPLTINKEEALQRPVASDFE
QTVHSIPLTINKEYALMRSVAFDFE

SEQ ID NO: 48663 - protein, 25 aa, synthetic construct
  source 1..25: note = Seed: QTVHSIPLTINKEEALQRPVASDFE
QTVHSIPLTINKEYALMRSVAGDFE

SEQ ID NO: 48664 - protein, 25 aa, synthetic construct
  source 1..25: note = Seed: QTVHSIPLTINKEEALQRPVASDFE
QTVHSIPLTINKEYALMRSVAHDFE

SEQ ID NO: 48665 - protein, 25 aa, synthetic construct
  source 1..25: note = Seed: QTVHSIPLTINKEEALQRPVASDFE
QTVHSIPLTINKEYALMRSVAIDFE

SEQ ID NO: 48666 - protein, 25 aa, synthetic construct
  source 1..25: note = Seed: QTVHSIPLTINKEEALQRPVASDFE
QTVHSIPLTINKEYALMRSVAKDFE

SEQ ID NO: 48667 - protein, 25 aa, synthetic construct
  source 1..25: note = Seed: QTVHSIPLTINKEEALQRPVASDFE
QTVHSIPLTINKEYALMRSVALDFE

SEQ ID NO: 48668 - protein, 25 aa, synthetic construct
  source 1..25: note = Seed: QTVHSIPLTINKEEALQRPVASDFE
QTVHSIPLTINKEYALMRSVAMDFE

SEQ ID NO: 48669 - protein, 25 aa, synthetic construct
  source 1..25: note = Seed: QTVHSIPLTINKEEALQRPVASDFE
QTVHSIPLTINKEYALMRSVANDFE

SEQ ID NO: 48670 - protein, 25 aa, synthetic construct
  source 1..25: note = Seed: QTVHSIPLTINKEEALQRPVASDFE
QTVHSIPLTINKEYALMRSVAPDFE

SEQ ID NO: 48671 - protein, 25 aa, synthetic construct
  source 1..25: note = Seed: QTVHSIPLTINKEEALQRPVASDFE
QTVHSIPLTINKEYALMRSVAQDFE

SEQ ID NO: 48672 - protein, 25 aa, synthetic construct
  source 1..25: note = Seed: QTVHSIPLTINKEEALQRPVASDFE
QTVHSIPLTINKEYALMRSVARDFE

SEQ ID NO: 48673 - protein, 25 aa, synthetic construct
  source 1..25: note = Seed: QTVHSIPLTINKEEALQRPVASDFE
QTVHSIPLTINKEYALMRSVASDFE

SEQ ID NO: 48674 - protein, 25 aa, synthetic construct
  source 1..25: note = Seed: QTVHSIPLTINKEEALQRPVASDFE
QTVHSIPLTINKEYALMRSVATDFE

SEQ ID NO: 48675 - protein, 25 aa, synthetic construct
  source 1..25: note = Seed: QTVHSIPLTINKEEALQRPVASDFE
QTVHSIPLTINKEYALMRSVAVDFE

SEQ ID NO: 48676 - protein, 25 aa, synthetic construct
  source 1..25: note = Seed: QTVHSIPLTINKEEALQRPVASDFE
QTVHSIPLTINKEYALMRSVAYDFE

SEQ ID NO: 48677 - protein, 25 aa, synthetic construct
  source 1..25: note = Seed: QTVHSIPLTINKEEALQRPVASDFE
QTVHSIPLTINKEYALMRTVAADFE

SEQ ID NO: 48678 - protein, 25 aa, synthetic construct
  source 1..25: note = Seed: QTVHSIPLTINKEEALQRPVASDFE
QTVHSIPLTINKEYALMRTVACDFE

SEQ ID NO: 48679 - protein, 25 aa, synthetic construct
  source 1..25: note = Seed: QTVHSIPLTINKEEALQRPVASDFE
QTVHSIPLTINKEYALMRTVADDFE

SEQ ID NO: 48680 - protein, 25 aa, synthetic construct
  source 1..25: note = Seed: QTVHSIPLTINKEEALQRPVASDFE
QTVHSIPLTINKEYALMRTVAEDFE

SEQ ID NO: 48681 - protein, 25 aa, synthetic construct
  source 1..25: note = Seed: QTVHSIPLTINKEEALQRPVASDFE
QTVHSIPLTINKEYALMRTVAFDFE

SEQ ID NO: 48682 - protein, 25 aa, synthetic construct
  source 1..25: note = Seed: QTVHSIPLTINKEEALQRPVASDFE
QTVHSIPLTINKEYALMRTVAGDFE

SEQ ID NO: 48683 - protein, 25 aa, synthetic construct
  source 1..25: note = Seed: QTVHSIPLTINKEEALQRPVASDFE
QTVHSIPLTINKEYALMRTVAHDFE

SEQ ID NO: 48684 - protein, 25 aa, synthetic construct
  source 1..25: note = Seed: QTVHSIPLTINKEEALQRPVASDFE
QTVHSIPLTINKEYALMRTVAIDFE

SEQ ID NO: 48685 - protein, 25 aa, synthetic construct
  source 1..25: note = Seed: QTVHSIPLTINKEEALQRPVASDFE
QTVHSIPLTINKEYALMRTVAKDFE

SEQ ID NO: 48686 - protein, 25 aa, synthetic construct
  source 1..25: note = Seed: QTVHSIPLTINKEEALQRPVASDFE
QTVHSIPLTINKEYALMRTVALDFE

SEQ ID NO: 48687 - protein, 25 aa, synthetic construct
  source 1..25: note = Seed: QTVHSIPLTINKEEALQRPVASDFE
QTVHSIPLTINKEYALMRTVAMDFE

SEQ ID NO: 48688 - protein, 25 aa, synthetic construct
  source 1..25: note = Seed: QTVHSIPLTINKEEALQRPVASDFE
QTVHSIPLTINKEYALMRTVANDFE

SEQ ID NO: 48689 - protein, 25 aa, synthetic construct
  source 1..25: note = Seed: QTVHSIPLTINKEEALQRPVASDFE
QTVHSIPLTINKEYALMRTVAPDFE

SEQ ID NO: 48690 - protein, 25 aa, synthetic construct
  source 1..25: note = Seed: QTVHSIPLTINKEEALQRPVASDFE
QTVHSIPLTINKEYALMRTVAQDFE

SEQ ID NO: 48691 - protein, 25 aa, synthetic construct
  source 1..25: note = Seed: QTVHSIPLTINKEEALQRPVASDFE
QTVHSIPLTINKEYALMRTVARDFE

SEQ ID NO: 48692 - protein, 25 aa, synthetic construct
  source 1..25: note = Seed: QTVHSIPLTINKEEALQRPVASDFE
QTVHSIPLTINKEYALMRTVASDFE

SEQ ID NO: 48693 - protein, 25 aa, synthetic construct
  source 1..25: note = Seed: QTVHSIPLTINKEEALQRPVASDFE
QTVHSIPLTINKEYALMRTVATDFE

SEQ ID NO: 48694 - protein, 25 aa, synthetic construct
  source 1..25: note = Seed: QTVHSIPLTINKEEALQRPVASDFE
QTVHSIPLTINKEYALMRTVAVDFE

SEQ ID NO: 48695 - protein, 25 aa, synthetic construct
  source 1..25: note = Seed: QTVHSIPLTINKEEALQRPVASDFE
QTVHSIPLTINKEYALMRTVAYDFE

SEQ ID NO: 48696 - protein, 25 aa, synthetic construct
  source 1..25: note = Seed: QTVHSIPLTINKEEALQRPVASDFE
QTVHSIPLTINKEYALMRVVAADFE

SEQ ID NO: 48697 - protein, 25 aa, synthetic construct
  source 1..25: note = Seed: QTVHSIPLTINKEEALQRPVASDFE
QTVHSIPLTINKEYALMRVVADDFE

SEQ ID NO: 48698 - protein, 25 aa, synthetic construct
  source 1..25: note = Seed: QTVHSIPLTINKEEALQRPVASDFE
QTVHSIPLTINKEYALMRVVAEDFE

SEQ ID NO: 48699 - protein, 25 aa, synthetic construct
  source 1..25: note = Seed: QTVHSIPLTINKEEALQRPVASDFE
QTVHSIPLTINKEYALMRVVAGDFE

SEQ ID NO: 48700 - protein, 25 aa, synthetic construct
  source 1..25: note = Seed: QTVHSIPLTINKEEALQRPVASDFE
QTVHSIPLTINKEYALMRVVAHDFE

SEQ ID NO: 48701 - protein, 25 aa, synthetic construct
  source 1..25: note = Seed: QTVHSIPLTINKEEALQRPVASDFE
QTVHSIPLTINKEYALMRVVAIDFE

SEQ ID NO: 48702 - protein, 25 aa, synthetic construct
  source 1..25: note = Seed: QTVHSIPLTINKEEALQRPVASDFE
QTVHSIPLTINKEYALMRVVAKDFE

SEQ ID NO: 48703 - protein, 25 aa, synthetic construct
  source 1..25: note = Seed: QTVHSIPLTINKEEALQRPVASDFE
QTVHSIPLTINKEYALMRVVALDFE

SEQ ID NO: 48704 - protein, 25 aa, synthetic construct
  source 1..25: note = Seed: QTVHSIPLTINKEEALQRPVASDFE
QTVHSIPLTINKEYALMRVVAMDFE

SEQ ID NO: 48705 - protein, 25 aa, synthetic construct
  source 1..25: note = Seed: QTVHSIPLTINKEEALQRPVASDFE
QTVHSIPLTINKEYALMRVVANDFE

SEQ ID NO: 48706 - protein, 25 aa, synthetic construct
  source 1..25: note = Seed: QTVHSIPLTINKEEALQRPVASDFE
QTVHSIPLTINKEYALMRVVAPDFE

SEQ ID NO: 48707 - protein, 25 aa, synthetic construct
  source 1..25: note = Seed: QTVHSIPLTINKEEALQRPVASDFE
QTVHSIPLTINKEYALMRVVAQDFE

SEQ ID NO: 48708 - protein, 25 aa, synthetic construct
  source 1..25: note = Seed: QTVHSIPLTINKEEALQRPVASDFE
QTVHSIPLTINKEYALMRVVARDFE

SEQ ID NO: 48709 - protein, 25 aa, synthetic construct
  source 1..25: note = Seed: QTVHSIPLTINKEEALQRPVASDFE
QTVHSIPLTINKEYALMRVVASDFE

SEQ ID NO: 48710 - protein, 25 aa, synthetic construct
  source 1..25: note = Seed: QTVHSIPLTINKEEALQRPVASDFE
QTVHSIPLTINKEYALMRVVATDFE

SEQ ID NO: 48711 - protein, 25 aa, synthetic construct
  source 1..25: note = Seed: QTVHSIPLTINKEEALQRPVASDFE
QTVHSIPLTINKEYALMRVVAVDFE

SEQ ID NO: 48712 - protein, 25 aa, synthetic construct
  source 1..25: note = Seed: QTVHSIPLTINKEEALQRPVASDFE
QTVHSIPLTINKEYALMRVVAYDFE

SEQ ID NO: 48713 - protein, 25 aa, synthetic construct
  source 1..25: note = Seed: QTVHSIPLTINKEEALQRPVASDFE
QTVHSIPLTINKEYALMRWVANDFE

SEQ ID NO: 48714 - protein, 25 aa, synthetic construct
  source 1..25: note = Seed: QTVHSIPLTINKEEALQRPVASDFE
QTVHSIPLTINKEYALMRYVAADFE

SEQ ID NO: 48715 - protein, 25 aa, synthetic construct
  source 1..25: note = Seed: QTVHSIPLTINKEEALQRPVASDFE
QTVHSIPLTINKEYALMRYVANDFE

SEQ ID NO: 48716 - protein, 25 aa, synthetic construct
  source 1..25: note = Seed: QTVHSIPLTINKEEALQRPVASDFE
QTVHSIPLTINKEYALMRYVASDFE

SEQ ID NO: 48717 - protein, 25 aa, synthetic construct
  source 1..25: note = Seed: QTVHSIPLTINKEEALQRPVASDFE
QTVHSIPLTINKEYALNRAVAADFE

SEQ ID NO: 48718 - protein, 25 aa, synthetic construct
  source 1..25: note = Seed: QTVHSIPLTINKEEALQRPVASDFE
QTVHSIPLTINKEYALNRAVAHDFE

SEQ ID NO: 48719 - protein, 25 aa, synthetic construct
  source 1..25: note = Seed: QTVHSIPLTINKEEALQRPVASDFE
QTVHSIPLTINKEYALNRAVAIDFE

SEQ ID NO: 48720 - protein, 25 aa, synthetic construct
  source 1..25: note = Seed: QTVHSIPLTINKEEALQRPVASDFE
QTVHSIPLTINKEYALNRAVALDFE

SEQ ID NO: 48721 - protein, 25 aa, synthetic construct
  source 1..25: note = Seed: QTVHSIPLTINKEEALQRPVASDFE
QTVHSIPLTINKEYALNRAVAMDFE

SEQ ID NO: 48722 - protein, 25 aa, synthetic construct
  source 1..25: note = Seed: QTVHSIPLTINKEEALQRPVASDFE
QTVHSIPLTINKEYALNRAVANDFE

SEQ ID NO: 48723 - protein, 25 aa, synthetic construct
  source 1..25: note = Seed: QTVHSIPLTINKEEALQRPVASDFE
QTVHSIPLTINKEYALNRAVAQDFE

SEQ ID NO: 48724 - protein, 25 aa, synthetic construct
  source 1..25: note = Seed: QTVHSIPLTINKEEALQRPVASDFE
QTVHSIPLTINKEYALNRAVASDFE

SEQ ID NO: 48725 - protein, 25 aa, synthetic construct
  source 1..25: note = Seed: QTVHSIPLTINKEEALQRPVASDFE
QTVHSIPLTINKEYALNRAVATDFE

SEQ ID NO: 48726 - protein, 25 aa, synthetic construct
  source 1..25: note = Seed: QTVHSIPLTINKEEALQRPVASDFE
QTVHSIPLTINKEYALNRAVAVDFE

SEQ ID NO: 48727 - protein, 25 aa, synthetic construct
  source 1..25: note = Seed: QTVHSIPLTINKEEALQRPVASDFE
QTVHSIPLTINKEYALNRIVAADFE

SEQ ID NO: 48728 - protein, 25 aa, synthetic construct
  source 1..25: note = Seed: QTVHSIPLTINKEEALQRPVASDFE
QTVHSIPLTINKEYALNRIVANDFE

SEQ ID NO: 48729 - protein, 25 aa, synthetic construct
  source 1..25: note = Seed: QTVHSIPLTINKEEALQRPVASDFE
QTVHSIPLTINKEYALNRIVASDFE

SEQ ID NO: 48730 - protein, 25 aa, synthetic construct
  source 1..25: note = Seed: QTVHSIPLTINKEEALQRPVASDFE
QTVHSIPLTINKEYALNRPVAADFE

SEQ ID NO: 48731 - protein, 25 aa, synthetic construct
  source 1..25: note = Seed: QTVHSIPLTINKEEALQRPVASDFE
QTVHSIPLTINKEYALNRPVAIDFE

SEQ ID NO: 48732 - protein, 25 aa, synthetic construct
  source 1..25: note = Seed: QTVHSIPLTINKEEALQRPVASDFE
QTVHSIPLTINKEYALNRPVALDFE

SEQ ID NO: 48733 - protein, 25 aa, synthetic construct
  source 1..25: note = Seed: QTVHSIPLTINKEEALQRPVASDFE
QTVHSIPLTINKEYALNRPVAMDFE

SEQ ID NO: 48734 - protein, 25 aa, synthetic construct
  source 1..25: note = Seed: QTVHSIPLTINKEEALQRPVASDFE
QTVHSIPLTINKEYALNRPVANDFE

SEQ ID NO: 48735 - protein, 25 aa, synthetic construct
  source 1..25: note = Seed: QTVHSIPLTINKEEALQRPVASDFE
QTVHSIPLTINKEYALNRPVASDFE

SEQ ID NO: 48736 - protein, 25 aa, synthetic construct
  source 1..25: note = Seed: QTVHSIPLTINKEEALQRPVASDFE
QTVHSIPLTINKEYALNRPVAVDFE

SEQ ID NO: 48737 - protein, 25 aa, synthetic construct
  source 1..25: note = Seed: QTVHSIPLTINKEEALQRPVASDFE
QTVHSIPLTINKEYALNRSVAADFE

SEQ ID NO: 48738 - protein, 25 aa, synthetic construct
  source 1..25: note = Seed: QTVHSIPLTINKEEALQRPVASDFE
QTVHSIPLTINKEYALNRSVANDFE

SEQ ID NO: 48739 - protein, 25 aa, synthetic construct
  source 1..25: note = Seed: QTVHSIPLTINKEEALQRPVASDFE
QTVHSIPLTINKEYALNRSVASDFE

SEQ ID NO: 48740 - protein, 25 aa, synthetic construct
  source 1..25: note = Seed: QTVHSIPLTINKEEALQRPVASDFE
QTVHSIPLTINKEYALNRTVAADFE

SEQ ID NO: 48741 - protein, 25 aa, synthetic construct
  source 1..25: note = Seed: QTVHSIPLTINKEEALQRPVASDFE
QTVHSIPLTINKEYALNRTVAMDFE

SEQ ID NO: 48742 - protein, 25 aa, synthetic construct
  source 1..25: note = Seed: QTVHSIPLTINKEEALQRPVASDFE
QTVHSIPLTINKEYALNRTVANDFE

SEQ ID NO: 48743 - protein, 25 aa, synthetic construct
  source 1..25: note = Seed: QTVHSIPLTINKEEALQRPVASDFE
QTVHSIPLTINKEYALNRTVASDFE

SEQ ID NO: 48744 - protein, 25 aa, synthetic construct
  source 1..25: note = Seed: QTVHSIPLTINKEEALQRPVASDFE
QTVHSIPLTINKEYALNRVVAADFE

SEQ ID NO: 48745 - protein, 25 aa, synthetic construct
  source 1..25: note = Seed: QTVHSIPLTINKEEALQRPVASDFE
QTVHSIPLTINKEYALNRVVAMDFE

SEQ ID NO: 48746 - protein, 25 aa, synthetic construct
  source 1..25: note = Seed: QTVHSIPLTINKEEALQRPVASDFE
QTVHSIPLTINKEYALNRVVANDFE

SEQ ID NO: 48747 - protein, 25 aa, synthetic construct
  source 1..25: note = Seed: QTVHSIPLTINKEEALQRPVASDFE
QTVHSIPLTINKEYALNRVVASDFE

SEQ ID NO: 48748 - protein, 25 aa, synthetic construct
  source 1..25: note = Seed: QTVHSIPLTINKEEALQRPVASDFE
QTVHSIPLTINKEYALNRVVAVDFE

SEQ ID NO: 48749 - protein, 25 aa, synthetic construct
  source 1..25: note = Seed: QTVHSIPLTINKEEALQRPVASDFE
QTVHSIPLTINKEYALQRAVAADFE

SEQ ID NO: 48750 - protein, 25 aa, synthetic construct
  source 1..25: note = Seed: QTVHSIPLTINKEEALQRPVASDFE
QTVHSIPLTINKEYALQRAVACDFE

SEQ ID NO: 48751 - protein, 25 aa, synthetic construct
  source 1..25: note = Seed: QTVHSIPLTINKEEALQRPVASDFE
QTVHSIPLTINKEYALQRAVADDFE

SEQ ID NO: 48752 - protein, 25 aa, synthetic construct
  source 1..25: note = Seed: QTVHSIPLTINKEEALQRPVASDFE
QTVHSIPLTINKEYALQRAVAEDFE

SEQ ID NO: 48753 - protein, 25 aa, synthetic construct
  source 1..25: note = Seed: QTVHSIPLTINKEEALQRPVASDFE
QTVHSIPLTINKEYALQRAVAFDFE

SEQ ID NO: 48754 - protein, 25 aa, synthetic construct
  source 1..25: note = Seed: QTVHSIPLTINKEEALQRPVASDFE
QTVHSIPLTINKEYALQRAVAGDFE

SEQ ID NO: 48755 - protein, 25 aa, synthetic construct
  source 1..25: note = Seed: QTVHSIPLTINKEEALQRPVASDFE
QTVHSIPLTINKEYALQRAVAHDFE

SEQ ID NO: 48756 - protein, 25 aa, synthetic construct
  source 1..25: note = Seed: QTVHSIPLTINKEEALQRPVASDFE
QTVHSIPLTINKEYALQRAVAIDFE

SEQ ID NO: 48757 - protein, 25 aa, synthetic construct
  source 1..25: note = Seed: QTVHSIPLTINKEEALQRPVASDFE
QTVHSIPLTINKEYALQRAVALDFE

SEQ ID NO: 48758 - protein, 25 aa, synthetic construct
  source 1..25: note = Seed: QTVHSIPLTINKEEALQRPVASDFE
QTVHSIPLTINKEYALQRAVAMDFE

SEQ ID NO: 48759 - protein, 25 aa, synthetic construct
  source 1..25: note = Seed: QTVHSIPLTINKEEALQRPVASDFE
QTVHSIPLTINKEYALQRAVANDFE

SEQ ID NO: 48760 - protein, 25 aa, synthetic construct
  source 1..25: note = Seed: QTVHSIPLTINKEEALQRPVASDFE
QTVHSIPLTINKEYALQRAVAPDFE

SEQ ID NO: 48761 - protein, 25 aa, synthetic construct
  source 1..25: note = Seed: QTVHSIPLTINKEEALQRPVASDFE
QTVHSIPLTINKEYALQRAVAQDFE

SEQ ID NO: 48762 - protein, 25 aa, synthetic construct
  source 1..25: note = Seed: QTVHSIPLTINKEEALQRPVASDFE
QTVHSIPLTINKEYALQRAVASDFE

SEQ ID NO: 48763 - protein, 25 aa, synthetic construct
  source 1..25: note = Seed: QTVHSIPLTINKEEALQRPVASDFE
QTVHSIPLTINKEYALQRAVATDFE

SEQ ID NO: 48764 - protein, 25 aa, synthetic construct
  source 1..25: note = Seed: QTVHSIPLTINKEEALQRPVASDFE
QTVHSIPLTINKEYALQRAVAVDFE

SEQ ID NO: 48765 - protein, 25 aa, synthetic construct
  source 1..25: note = Seed: QTVHSIPLTINKEEALQRPVASDFE
QTVHSIPLTINKEYALQRAVAYDFE

SEQ ID NO: 48766 - protein, 25 aa, synthetic construct
  source 1..25: note = Seed: QTVHSIPLTINKEEALQRPVASDFE
QTVHSIPLTINKEYALQRGVAADFE

SEQ ID NO: 48767 - protein, 25 aa, synthetic construct
  source 1..25: note = Seed: QTVHSIPLTINKEEALQRPVASDFE
QTVHSIPLTINKEYALQRGVAGDFE

SEQ ID NO: 48768 - protein, 25 aa, synthetic construct
  source 1..25: note = Seed: QTVHSIPLTINKEEALQRPVASDFE
QTVHSIPLTINKEYALQRGVAHDFE

SEQ ID NO: 48769 - protein, 25 aa, synthetic construct
  source 1..25: note = Seed: QTVHSIPLTINKEEALQRPVASDFE
QTVHSIPLTINKEYALQRGVAIDFE

SEQ ID NO: 48770 - protein, 25 aa, synthetic construct
  source 1..25: note = Seed: QTVHSIPLTINKEEALQRPVASDFE
QTVHSIPLTINKEYALQRGVALDFE

SEQ ID NO: 48771 - protein, 25 aa, synthetic construct
  source 1..25: note = Seed: QTVHSIPLTINKEEALQRPVASDFE
QTVHSIPLTINKEYALQRGVAMDFE

SEQ ID NO: 48772 - protein, 25 aa, synthetic construct
  source 1..25: note = Seed: QTVHSIPLTINKEEALQRPVASDFE
QTVHSIPLTINKEYALQRGVANDFE

SEQ ID NO: 48773 - protein, 25 aa, synthetic construct
  source 1..25: note = Seed: QTVHSIPLTINKEEALQRPVASDFE
QTVHSIPLTINKEYALQRGVAQDFE

SEQ ID NO: 48774 - protein, 25 aa, synthetic construct
  source 1..25: note = Seed: QTVHSIPLTINKEEALQRPVASDFE
QTVHSIPLTINKEYALQRGVASDFE

SEQ ID NO: 48775 - protein, 25 aa, synthetic construct
  source 1..25: note = Seed: QTVHSIPLTINKEEALQRPVASDFE
QTVHSIPLTINKEYALQRGVATDFE

SEQ ID NO: 48776 - protein, 25 aa, synthetic construct
  source 1..25: note = Seed: QTVHSIPLTINKEEALQRPVASDFE
QTVHSIPLTINKEYALQRGVAVDFE

SEQ ID NO: 48777 - protein, 25 aa, synthetic construct
  source 1..25: note = Seed: QTVHSIPLTINKEEALQRPVASDFE
QTVHSIPLTINKEYALQRIVAADFE

SEQ ID NO: 48778 - protein, 25 aa, synthetic construct
  source 1..25: note = Seed: QTVHSIPLTINKEEALQRPVASDFE
QTVHSIPLTINKEYALQRIVAGDFE

SEQ ID NO: 48779 - protein, 25 aa, synthetic construct
  source 1..25: note = Seed: QTVHSIPLTINKEEALQRPVASDFE
QTVHSIPLTINKEYALQRIVAHDFE

SEQ ID NO: 48780 - protein, 25 aa, synthetic construct
  source 1..25: note = Seed: QTVHSIPLTINKEEALQRPVASDFE
QTVHSIPLTINKEYALQRIVAIDFE

SEQ ID NO: 48781 - protein, 25 aa, synthetic construct
  source 1..25: note = Seed: QTVHSIPLTINKEEALQRPVASDFE
QTVHSIPLTINKEYALQRIVALDFE

SEQ ID NO: 48782 - protein, 25 aa, synthetic construct
  source 1..25: note = Seed: QTVHSIPLTINKEEALQRPVASDFE
QTVHSIPLTINKEYALQRIVAMDFE

SEQ ID NO: 48783 - protein, 25 aa, synthetic construct
  source 1..25: note = Seed: QTVHSIPLTINKEEALQRPVASDFE
QTVHSIPLTINKEYALQRIVANDFE

SEQ ID NO: 48784 - protein, 25 aa, synthetic construct
  source 1..25: note = Seed: QTVHSIPLTINKEEALQRPVASDFE
QTVHSIPLTINKEYALQRIVAQDFE

SEQ ID NO: 48785 - protein, 25 aa, synthetic construct
  source 1..25: note = Seed: QTVHSIPLTINKEEALQRPVASDFE
QTVHSIPLTINKEYALQRIVASDFE

SEQ ID NO: 48786 - protein, 25 aa, synthetic construct
  source 1..25: note = Seed: QTVHSIPLTINKEEALQRPVASDFE
QTVHSIPLTINKEYALQRIVATDFE

SEQ ID NO: 48787 - protein, 25 aa, synthetic construct
  source 1..25: note = Seed: QTVHSIPLTINKEEALQRPVASDFE
QTVHSIPLTINKEYALQRIVAVDFE

SEQ ID NO: 48788 - protein, 25 aa, synthetic construct
  source 1..25: note = Seed: QTVHSIPLTINKEEALQRPVASDFE
QTVHSIPLTINKEYALQRLVAADFE

SEQ ID NO: 48789 - protein, 25 aa, synthetic construct
  source 1..25: note = Seed: QTVHSIPLTINKEEALQRPVASDFE
QTVHSIPLTINKEYALQRLVANDFE

SEQ ID NO: 48790 - protein, 25 aa, synthetic construct
  source 1..25: note = Seed: QTVHSIPLTINKEEALQRPVASDFE
QTVHSIPLTINKEYALQRLVASDFE

SEQ ID NO: 48791 - protein, 25 aa, synthetic construct
  source 1..25: note = Seed: QTVHSIPLTINKEEALQRPVASDFE
QTVHSIPLTINKEYALQRLVATDFE

SEQ ID NO: 48792 - protein, 25 aa, synthetic construct
  source 1..25: note = Seed: QTVHSIPLTINKEEALQRPVASDFE
QTVHSIPLTINKEYALQRMVAADFE

SEQ ID NO: 48793 - protein, 25 aa, synthetic construct
  source 1..25: note = Seed: QTVHSIPLTINKEEALQRPVASDFE
QTVHSIPLTINKEYALQRMVANDFE

SEQ ID NO: 48794 - protein, 25 aa, synthetic construct
  source 1..25: note = Seed: QTVHSIPLTINKEEALQRPVASDFE
QTVHSIPLTINKEYALQRMVASDFE

SEQ ID NO: 48795 - protein, 25 aa, synthetic construct
  source 1..25: note = Seed: QTVHSIPLTINKEEALQRPVASDFE
QTVHSIPLTINKEYALQRNVAADFE

SEQ ID NO: 48796 - protein, 25 aa, synthetic construct
  source 1..25: note = Seed: QTVHSIPLTINKEEALQRPVASDFE
QTVHSIPLTINKEYALQRNVAGDFE

SEQ ID NO: 48797 - protein, 25 aa, synthetic construct
  source 1..25: note = Seed: QTVHSIPLTINKEEALQRPVASDFE
QTVHSIPLTINKEYALQRNVAHDFE

SEQ ID NO: 48798 - protein, 25 aa, synthetic construct
  source 1..25: note = Seed: QTVHSIPLTINKEEALQRPVASDFE
QTVHSIPLTINKEYALQRNVAIDFE

SEQ ID NO: 48799 - protein, 25 aa, synthetic construct
  source 1..25: note = Seed: QTVHSIPLTINKEEALQRPVASDFE
QTVHSIPLTINKEYALQRNVALDFE

SEQ ID NO: 48800 - protein, 25 aa, synthetic construct
  source 1..25: note = Seed: QTVHSIPLTINKEEALQRPVASDFE
QTVHSIPLTINKEYALQRNVAMDFE

SEQ ID NO: 48801 - protein, 25 aa, synthetic construct
  source 1..25: note = Seed: QTVHSIPLTINKEEALQRPVASDFE
QTVHSIPLTINKEYALQRNVANDFE

SEQ ID NO: 48802 - protein, 25 aa, synthetic construct
  source 1..25: note = Seed: QTVHSIPLTINKEEALQRPVASDFE
QTVHSIPLTINKEYALQRNVAQDFE

SEQ ID NO: 48803 - protein, 25 aa, synthetic construct
  source 1..25: note = Seed: QTVHSIPLTINKEEALQRPVASDFE
QTVHSIPLTINKEYALQRNVASDFE

SEQ ID NO: 48804 - protein, 25 aa, synthetic construct
  source 1..25: note = Seed: QTVHSIPLTINKEEALQRPVASDFE
QTVHSIPLTINKEYALQRNVATDFE

SEQ ID NO: 48805 - protein, 25 aa, synthetic construct
  source 1..25: note = Seed: QTVHSIPLTINKEEALQRPVASDFE
QTVHSIPLTINKEYALQRNVAVDFE

SEQ ID NO: 48806 - protein, 25 aa, synthetic construct
  source 1..25: note = Seed: QTVHSIPLTINKEEALQRPVASDFE
QTVHSIPLTINKEYALQRPVAADFE

SEQ ID NO: 48807 - protein, 25 aa, synthetic construct
  source 1..25: note = Seed: QTVHSIPLTINKEEALQRPVASDFE
QTVHSIPLTINKEYALQRPVADDFE

SEQ ID NO: 48808 - protein, 25 aa, synthetic construct
  source 1..25: note = Seed: QTVHSIPLTINKEEALQRPVASDFE
QTVHSIPLTINKEYALQRPVAEDFE

SEQ ID NO: 48809 - protein, 25 aa, synthetic construct
  source 1..25: note = Seed: QTVHSIPLTINKEEALQRPVASDFE
QTVHSIPLTINKEYALQRPVAGDFE

SEQ ID NO: 48810 - protein, 25 aa, synthetic construct
  source 1..25: note = Seed: QTVHSIPLTINKEEALQRPVASDFE
QTVHSIPLTINKEYALQRPVAHDFE

SEQ ID NO: 48811 - protein, 25 aa, synthetic construct
  source 1..25: note = Seed: QTVHSIPLTINKEEALQRPVASDFE
QTVHSIPLTINKEYALQRPVAIDFE

SEQ ID NO: 48812 - protein, 25 aa, synthetic construct
  source 1..25: note = Seed: QTVHSIPLTINKEEALQRPVASDFE
QTVHSIPLTINKEYALQRPVALDFE

SEQ ID NO: 48813 - protein, 25 aa, synthetic construct
  source 1..25: note = Seed: QTVHSIPLTINKEEALQRPVASDFE
QTVHSIPLTINKEYALQRPVAMDFE

SEQ ID NO: 48814 - protein, 25 aa, synthetic construct
  source 1..25: note = Seed: QTVHSIPLTINKEEALQRPVASDFE
QTVHSIPLTINKEYALQRPVANDFE

SEQ ID NO: 48815 - protein, 25 aa, synthetic construct
  source 1..25: note = Seed: QTVHSIPLTINKEEALQRPVASDFE
QTVHSIPLTINKEYALQRPVAPDFE

SEQ ID NO: 48816 - protein, 25 aa, synthetic construct
  source 1..25: note = Seed: QTVHSIPLTINKEEALQRPVASDFE
QTVHSIPLTINKEYALQRPVAQDFE

SEQ ID NO: 48817 - protein, 25 aa, synthetic construct
  source 1..25: note = Seed: QTVHSIPLTINKEEALQRPVASDFE
QTVHSIPLTINKEYALQRPVASDFE

SEQ ID NO: 48818 - protein, 25 aa, synthetic construct
  source 1..25: note = Seed: QTVHSIPLTINKEEALQRPVASDFE
QTVHSIPLTINKEYALQRPVATDFE

SEQ ID NO: 48819 - protein, 25 aa, synthetic construct
  source 1..25: note = Seed: QTVHSIPLTINKEEALQRPVASDFE
QTVHSIPLTINKEYALQRPVAVDFE

SEQ ID NO: 48820 - protein, 25 aa, synthetic construct
  source 1..25: note = Seed: QTVHSIPLTINKEEALQRPVASDFE
QTVHSIPLTINKEYALQRSVAADFE

SEQ ID NO: 48821 - protein, 25 aa, synthetic construct
  source 1..25: note = Seed: QTVHSIPLTINKEEALQRPVASDFE
QTVHSIPLTINKEYALQRSVACDFE

SEQ ID NO: 48822 - protein, 25 aa, synthetic construct
  source 1..25: note = Seed: QTVHSIPLTINKEEALQRPVASDFE
QTVHSIPLTINKEYALQRSVADDFE

SEQ ID NO: 48823 - protein, 25 aa, synthetic construct
  source 1..25: note = Seed: QTVHSIPLTINKEEALQRPVASDFE
QTVHSIPLTINKEYALQRSVAEDFE

SEQ ID NO: 48824 - protein, 25 aa, synthetic construct
  source 1..25: note = Seed: QTVHSIPLTINKEEALQRPVASDFE
QTVHSIPLTINKEYALQRSVAGDFE

SEQ ID NO: 48825 - protein, 25 aa, synthetic construct
  source 1..25: note = Seed: QTVHSIPLTINKEEALQRPVASDFE
QTVHSIPLTINKEYALQRSVAHDFE

SEQ ID NO: 48826 - protein, 25 aa, synthetic construct
  source 1..25: note = Seed: QTVHSIPLTINKEEALQRPVASDFE
QTVHSIPLTINKEYALQRSVAIDFE

SEQ ID NO: 48827 - protein, 25 aa, synthetic construct
  source 1..25: note = Seed: QTVHSIPLTINKEEALQRPVASDFE
QTVHSIPLTINKEYALQRSVALDFE

SEQ ID NO: 48828 - protein, 25 aa, synthetic construct
  source 1..25: note = Seed: QTVHSIPLTINKEEALQRPVASDFE
QTVHSIPLTINKEYALQRSVAMDFE

SEQ ID NO: 48829 - protein, 25 aa, synthetic construct
  source 1..25: note = Seed: QTVHSIPLTINKEEALQRPVASDFE
QTVHSIPLTINKEYALQRSVANDFE

SEQ ID NO: 48830 - protein, 25 aa, synthetic construct
  source 1..25: note = Seed: QTVHSIPLTINKEEALQRPVASDFE
QTVHSIPLTINKEYALQRSVAPDFE

SEQ ID NO: 48831 - protein, 25 aa, synthetic construct
  source 1..25: note = Seed: QTVHSIPLTINKEEALQRPVASDFE
QTVHSIPLTINKEYALQRSVAQDFE

SEQ ID NO: 48832 - protein, 25 aa, synthetic construct
  source 1..25: note = Seed: QTVHSIPLTINKEEALQRPVASDFE
QTVHSIPLTINKEYALQRSVASDFE

SEQ ID NO: 48833 - protein, 25 aa, synthetic construct
  source 1..25: note = Seed: QTVHSIPLTINKEEALQRPVASDFE
QTVHSIPLTINKEYALQRSVATDFE

SEQ ID NO: 48834 - protein, 25 aa, synthetic construct
  source 1..25: note = Seed: QTVHSIPLTINKEEALQRPVASDFE
QTVHSIPLTINKEYALQRSVAVDFE

SEQ ID NO: 48835 - protein, 25 aa, synthetic construct
  source 1..25: note = Seed: QTVHSIPLTINKEEALQRPVASDFE
QTVHSIPLTINKEYALQRTVAADFE

SEQ ID NO: 48836 - protein, 25 aa, synthetic construct
  source 1..25: note = Seed: QTVHSIPLTINKEEALQRPVASDFE
QTVHSIPLTINKEYALQRTVACDFE

SEQ ID NO: 48837 - protein, 25 aa, synthetic construct
  source 1..25: note = Seed: QTVHSIPLTINKEEALQRPVASDFE
QTVHSIPLTINKEYALQRTVAEDFE

SEQ ID NO: 48838 - protein, 25 aa, synthetic construct
  source 1..25: note = Seed: QTVHSIPLTINKEEALQRPVASDFE
QTVHSIPLTINKEYALQRTVAGDFE

SEQ ID NO: 48839 - protein, 25 aa, synthetic construct
  source 1..25: note = Seed: QTVHSIPLTINKEEALQRPVASDFE
QTVHSIPLTINKEYALQRTVAHDFE

SEQ ID NO: 48840 - protein, 25 aa, synthetic construct
  source 1..25: note = Seed: QTVHSIPLTINKEEALQRPVASDFE
QTVHSIPLTINKEYALQRTVAIDFE

SEQ ID NO: 48841 - protein, 25 aa, synthetic construct
  source 1..25: note = Seed: QTVHSIPLTINKEEALQRPVASDFE
QTVHSIPLTINKEYALQRTVALDFE

SEQ ID NO: 48842 - protein, 25 aa, synthetic construct
  source 1..25: note = Seed: QTVHSIPLTINKEEALQRPVASDFE
QTVHSIPLTINKEYALQRTVAMDFE

SEQ ID NO: 48843 - protein, 25 aa, synthetic construct
  source 1..25: note = Seed: QTVHSIPLTINKEEALQRPVASDFE
QTVHSIPLTINKEYALQRTVANDFE

SEQ ID NO: 48844 - protein, 25 aa, synthetic construct
  source 1..25: note = Seed: QTVHSIPLTINKEEALQRPVASDFE
QTVHSIPLTINKEYALQRTVAPDFE

SEQ ID NO: 48845 - protein, 25 aa, synthetic construct
  source 1..25: note = Seed: QTVHSIPLTINKEEALQRPVASDFE
QTVHSIPLTINKEYALQRTVAQDFE

SEQ ID NO: 48846 - protein, 25 aa, synthetic construct
  source 1..25: note = Seed: QTVHSIPLTINKEEALQRPVASDFE
QTVHSIPLTINKEYALQRTVASDFE

SEQ ID NO: 48847 - protein, 25 aa, synthetic construct
  source 1..25: note = Seed: QTVHSIPLTINKEEALQRPVASDFE
QTVHSIPLTINKEYALQRTVATDFE

SEQ ID NO: 48848 - protein, 25 aa, synthetic construct
  source 1..25: note = Seed: QTVHSIPLTINKEEALQRPVASDFE
QTVHSIPLTINKEYALQRTVAVDFE

SEQ ID NO: 48849 - protein, 25 aa, synthetic construct
  source 1..25: note = Seed: QTVHSIPLTINKEEALQRPVASDFE
QTVHSIPLTINKEYALQRVVAADFE

SEQ ID NO: 48850 - protein, 25 aa, synthetic construct
  source 1..25: note = Seed: QTVHSIPLTINKEEALQRPVASDFE
QTVHSIPLTINKEYALQRVVADDFE

SEQ ID NO: 48851 - protein, 25 aa, synthetic construct
  source 1..25: note = Seed: QTVHSIPLTINKEEALQRPVASDFE
QTVHSIPLTINKEYALQRVVAEDFE

SEQ ID NO: 48852 - protein, 25 aa, synthetic construct
  source 1..25: note = Seed: QTVHSIPLTINKEEALQRPVASDFE
QTVHSIPLTINKEYALQRVVAGDFE

SEQ ID NO: 48853 - protein, 25 aa, synthetic construct
  source 1..25: note = Seed: QTVHSIPLTINKEEALQRPVASDFE
QTVHSIPLTINKEYALQRVVAHDFE

SEQ ID NO: 48854 - protein, 25 aa, synthetic construct
  source 1..25: note = Seed: QTVHSIPLTINKEEALQRPVASDFE
QTVHSIPLTINKEYALQRVVAIDFE

SEQ ID NO: 48855 - protein, 25 aa, synthetic construct
  source 1..25: note = Seed: QTVHSIPLTINKEEALQRPVASDFE
QTVHSIPLTINKEYALQRVVALDFE

SEQ ID NO: 48856 - protein, 25 aa, synthetic construct
  source 1..25: note = Seed: QTVHSIPLTINKEEALQRPVASDFE
QTVHSIPLTINKEYALQRVVAMDFE

SEQ ID NO: 48857 - protein, 25 aa, synthetic construct
  source 1..25: note = Seed: QTVHSIPLTINKEEALQRPVASDFE
QTVHSIPLTINKEYALQRVVANDFE

SEQ ID NO: 48858 - protein, 25 aa, synthetic construct
  source 1..25: note = Seed: QTVHSIPLTINKEEALQRPVASDFE
QTVHSIPLTINKEYALQRVVAPDFE

SEQ ID NO: 48859 - protein, 25 aa, synthetic construct
  source 1..25: note = Seed: QTVHSIPLTINKEEALQRPVASDFE
QTVHSIPLTINKEYALQRVVAQDFE

SEQ ID NO: 48860 - protein, 25 aa, synthetic construct
  source 1..25: note = Seed: QTVHSIPLTINKEEALQRPVASDFE
QTVHSIPLTINKEYALQRVVASDFE

SEQ ID NO: 48861 - protein, 25 aa, synthetic construct
  source 1..25: note = Seed: QTVHSIPLTINKEEALQRPVASDFE
QTVHSIPLTINKEYALQRVVATDFE

SEQ ID NO: 48862 - protein, 25 aa, synthetic construct
  source 1..25: note = Seed: QTVHSIPLTINKEEALQRPVASDFE
QTVHSIPLTINKEYALQRVVAVDFE

SEQ ID NO: 48863 - protein, 25 aa, synthetic construct
  source 1..25: note = Seed: QTVHSIPLTINKEEALQRPVASDFE
QTVHSIPLTINKEYALSRAVAADFE

SEQ ID NO: 48864 - protein, 25 aa, synthetic construct
  source 1..25: note = Seed: QTVHSIPLTINKEEALQRPVASDFE
QTVHSIPLTINKEYALSRAVADDFE

SEQ ID NO: 48865 - protein, 25 aa, synthetic construct
  source 1..25: note = Seed: QTVHSIPLTINKEEALQRPVASDFE
QTVHSIPLTINKEYALSRAVAEDFE

SEQ ID NO: 48866 - protein, 25 aa, synthetic construct
  source 1..25: note = Seed: QTVHSIPLTINKEEALQRPVASDFE
QTVHSIPLTINKEYALSRAVAFDFE

SEQ ID NO: 48867 - protein, 25 aa, synthetic construct
  source 1..25: note = Seed: QTVHSIPLTINKEEALQRPVASDFE
QTVHSIPLTINKEYALSRAVAGDFE

SEQ ID NO: 48868 - protein, 25 aa, synthetic construct
  source 1..25: note = Seed: QTVHSIPLTINKEEALQRPVASDFE
QTVHSIPLTINKEYALSRAVAHDFE

SEQ ID NO: 48869 - protein, 25 aa, synthetic construct
  source 1..25: note = Seed: QTVHSIPLTINKEEALQRPVASDFE
QTVHSIPLTINKEYALSRAVAIDFE

SEQ ID NO: 48870 - protein, 25 aa, synthetic construct
  source 1..25: note = Seed: QTVHSIPLTINKEEALQRPVASDFE
QTVHSIPLTINKEYALSRAVALDFE

SEQ ID NO: 48871 - protein, 25 aa, synthetic construct
  source 1..25: note = Seed: QTVHSIPLTINKEEALQRPVASDFE
QTVHSIPLTINKEYALSRAVAMDFE

SEQ ID NO: 48872 - protein, 25 aa, synthetic construct
  source 1..25: note = Seed: QTVHSIPLTINKEEALQRPVASDFE
QTVHSIPLTINKEYALSRAVANDFE

SEQ ID NO: 48873 - protein, 25 aa, synthetic construct
  source 1..25: note = Seed: QTVHSIPLTINKEEALQRPVASDFE
QTVHSIPLTINKEYALSRAVAPDFE

SEQ ID NO: 48874 - protein, 25 aa, synthetic construct
  source 1..25: note = Seed: QTVHSIPLTINKEEALQRPVASDFE
QTVHSIPLTINKEYALSRAVAQDFE

SEQ ID NO: 48875 - protein, 25 aa, synthetic construct
  source 1..25: note = Seed: QTVHSIPLTINKEEALQRPVASDFE
QTVHSIPLTINKEYALSRAVASDFE

SEQ ID NO: 48876 - protein, 25 aa, synthetic construct
  source 1..25: note = Seed: QTVHSIPLTINKEEALQRPVASDFE
QTVHSIPLTINKEYALSRAVATDFE

SEQ ID NO: 48877 - protein, 25 aa, synthetic construct
  source 1..25: note = Seed: QTVHSIPLTINKEEALQRPVASDFE
QTVHSIPLTINKEYALSRAVAVDFE

SEQ ID NO: 48878 - protein, 25 aa, synthetic construct
  source 1..25: note = Seed: QTVHSIPLTINKEEALQRPVASDFE
QTVHSIPLTINKEYALSRAVAYDFE

SEQ ID NO: 48879 - protein, 25 aa, synthetic construct
  source 1..25: note = Seed: QTVHSIPLTINKEEALQRPVASDFE
QTVHSIPLTINKEYALSRGVAADFE

SEQ ID NO: 48880 - protein, 25 aa, synthetic construct
  source 1..25: note = Seed: QTVHSIPLTINKEEALQRPVASDFE
QTVHSIPLTINKEYALSRGVAGDFE

SEQ ID NO: 48881 - protein, 25 aa, synthetic construct
  source 1..25: note = Seed: QTVHSIPLTINKEEALQRPVASDFE
QTVHSIPLTINKEYALSRGVAIDFE

SEQ ID NO: 48882 - protein, 25 aa, synthetic construct
  source 1..25: note = Seed: QTVHSIPLTINKEEALQRPVASDFE
QTVHSIPLTINKEYALSRGVALDFE

SEQ ID NO: 48883 - protein, 25 aa, synthetic construct
  source 1..25: note = Seed: QTVHSIPLTINKEEALQRPVASDFE
QTVHSIPLTINKEYALSRGVAMDFE

SEQ ID NO: 48884 - protein, 25 aa, synthetic construct
  source 1..25: note = Seed: QTVHSIPLTINKEEALQRPVASDFE
QTVHSIPLTINKEYALSRGVANDFE

SEQ ID NO: 48885 - protein, 25 aa, synthetic construct
  source 1..25: note = Seed: QTVHSIPLTINKEEALQRPVASDFE
QTVHSIPLTINKEYALSRGVAQDFE

SEQ ID NO: 48886 - protein, 25 aa, synthetic construct
  source 1..25: note = Seed: QTVHSIPLTINKEEALQRPVASDFE
QTVHSIPLTINKEYALSRGVASDFE

SEQ ID NO: 48887 - protein, 25 aa, synthetic construct
  source 1..25: note = Seed: QTVHSIPLTINKEEALQRPVASDFE
QTVHSIPLTINKEYALSRGVATDFE

SEQ ID NO: 48888 - protein, 25 aa, synthetic construct
  source 1..25: note = Seed: QTVHSIPLTINKEEALQRPVASDFE
QTVHSIPLTINKEYALSRGVAVDFE

SEQ ID NO: 48889 - protein, 25 aa, synthetic construct
  source 1..25: note = Seed: QTVHSIPLTINKEEALQRPVASDFE
QTVHSIPLTINKEYALSRIVAADFE

SEQ ID NO: 48890 - protein, 25 aa, synthetic construct
  source 1..25: note = Seed: QTVHSIPLTINKEEALQRPVASDFE
QTVHSIPLTINKEYALSRIVAGDFE

SEQ ID NO: 48891 - protein, 25 aa, synthetic construct
  source 1..25: note = Seed: QTVHSIPLTINKEEALQRPVASDFE
QTVHSIPLTINKEYALSRIVAHDFE

SEQ ID NO: 48892 - protein, 25 aa, synthetic construct
  source 1..25: note = Seed: QTVHSIPLTINKEEALQRPVASDFE
QTVHSIPLTINKEYALSRIVAIDFE

SEQ ID NO: 48893 - protein, 25 aa, synthetic construct
  source 1..25: note = Seed: QTVHSIPLTINKEEALQRPVASDFE
QTVHSIPLTINKEYALSRIVALDFE

SEQ ID NO: 48894 - protein, 25 aa, synthetic construct
  source 1..25: note = Seed: QTVHSIPLTINKEEALQRPVASDFE
QTVHSIPLTINKEYALSRIVAMDFE

SEQ ID NO: 48895 - protein, 25 aa, synthetic construct
  source 1..25: note = Seed: QTVHSIPLTINKEEALQRPVASDFE
QTVHSIPLTINKEYALSRIVANDFE

SEQ ID NO: 48896 - protein, 25 aa, synthetic construct
  source 1..25: note = Seed: QTVHSIPLTINKEEALQRPVASDFE
QTVHSIPLTINKEYALSRIVASDFE

SEQ ID NO: 48897 - protein, 25 aa, synthetic construct
  source 1..25: note = Seed: QTVHSIPLTINKEEALQRPVASDFE
QTVHSIPLTINKEYALSRIVATDFE

SEQ ID NO: 48898 - protein, 25 aa, synthetic construct
  source 1..25: note = Seed: QTVHSIPLTINKEEALQRPVASDFE
QTVHSIPLTINKEYALSRIVAVDFE

SEQ ID NO: 48899 - protein, 25 aa, synthetic construct
  source 1..25: note = Seed: QTVHSIPLTINKEEALQRPVASDFE
QTVHSIPLTINKEYALSRLVAADFE

SEQ ID NO: 48900 - protein, 25 aa, synthetic construct
  source 1..25: note = Seed: QTVHSIPLTINKEEALQRPVASDFE
QTVHSIPLTINKEYALSRLVANDFE

SEQ ID NO: 48901 - protein, 25 aa, synthetic construct
  source 1..25: note = Seed: QTVHSIPLTINKEEALQRPVASDFE
QTVHSIPLTINKEYALSRLVASDFE

SEQ ID NO: 48902 - protein, 25 aa, synthetic construct
  source 1..25: note = Seed: QTVHSIPLTINKEEALQRPVASDFE
QTVHSIPLTINKEYALSRMVAADFE

SEQ ID NO: 48903 - protein, 25 aa, synthetic construct
  source 1..25: note = Seed: QTVHSIPLTINKEEALQRPVASDFE
QTVHSIPLTINKEYALSRMVANDFE

SEQ ID NO: 48904 - protein, 25 aa, synthetic construct
  source 1..25: note = Seed: QTVHSIPLTINKEEALQRPVASDFE
QTVHSIPLTINKEYALSRNVAADFE

SEQ ID NO: 48905 - protein, 25 aa, synthetic construct
  source 1..25: note = Seed: QTVHSIPLTINKEEALQRPVASDFE
QTVHSIPLTINKEYALSRNVAGDFE

SEQ ID NO: 48906 - protein, 25 aa, synthetic construct
  source 1..25: note = Seed: QTVHSIPLTINKEEALQRPVASDFE
QTVHSIPLTINKEYALSRNVAIDFE

SEQ ID NO: 48907 - protein, 25 aa, synthetic construct
  source 1..25: note = Seed: QTVHSIPLTINKEEALQRPVASDFE
QTVHSIPLTINKEYALSRNVALDFE

SEQ ID NO: 48908 - protein, 25 aa, synthetic construct
  source 1..25: note = Seed: QTVHSIPLTINKEEALQRPVASDFE
QTVHSIPLTINKEYALSRNVAMDFE

SEQ ID NO: 48909 - protein, 25 aa, synthetic construct
  source 1..25: note = Seed: QTVHSIPLTINKEEALQRPVASDFE
QTVHSIPLTINKEYALSRNVANDFE

SEQ ID NO: 48910 - protein, 25 aa, synthetic construct
  source 1..25: note = Seed: QTVHSIPLTINKEEALQRPVASDFE
QTVHSIPLTINKEYALSRNVASDFE

SEQ ID NO: 48911 - protein, 25 aa, synthetic construct
  source 1..25: note = Seed: QTVHSIPLTINKEEALQRPVASDFE
QTVHSIPLTINKEYALSRNVATDFE

SEQ ID NO: 48912 - protein, 25 aa, synthetic construct
  source 1..25: note = Seed: QTVHSIPLTINKEEALQRPVASDFE
QTVHSIPLTINKEYALSRNVAVDFE

SEQ ID NO: 48913 - protein, 25 aa, synthetic construct
  source 1..25: note = Seed: QTVHSIPLTINKEEALQRPVASDFE
QTVHSIPLTINKEYALSRPVAADFE

SEQ ID NO: 48914 - protein, 25 aa, synthetic construct
  source 1..25: note = Seed: QTVHSIPLTINKEEALQRPVASDFE
QTVHSIPLTINKEYALSRPVAGDFE

SEQ ID NO: 48915 - protein, 25 aa, synthetic construct
  source 1..25: note = Seed: QTVHSIPLTINKEEALQRPVASDFE
QTVHSIPLTINKEYALSRPVAHDFE

SEQ ID NO: 48916 - protein, 25 aa, synthetic construct
  source 1..25: note = Seed: QTVHSIPLTINKEEALQRPVASDFE
QTVHSIPLTINKEYALSRPVAIDFE

SEQ ID NO: 48917 - protein, 25 aa, synthetic construct
  source 1..25: note = Seed: QTVHSIPLTINKEEALQRPVASDFE
QTVHSIPLTINKEYALSRPVALDFE

SEQ ID NO: 48918 - protein, 25 aa, synthetic construct
  source 1..25: note = Seed: QTVHSIPLTINKEEALQRPVASDFE
QTVHSIPLTINKEYALSRPVAMDFE

SEQ ID NO: 48919 - protein, 25 aa, synthetic construct
  source 1..25: note = Seed: QTVHSIPLTINKEEALQRPVASDFE
QTVHSIPLTINKEYALSRPVANDFE

SEQ ID NO: 48920 - protein, 25 aa, synthetic construct
  source 1..25: note = Seed: QTVHSIPLTINKEEALQRPVASDFE
QTVHSIPLTINKEYALSRPVAQDFE

SEQ ID NO: 48921 - protein, 25 aa, synthetic construct
  source 1..25: note = Seed: QTVHSIPLTINKEEALQRPVASDFE
QTVHSIPLTINKEYALSRPVASDFE

SEQ ID NO: 48922 - protein, 25 aa, synthetic construct
  source 1..25: note = Seed: QTVHSIPLTINKEEALQRPVASDFE
QTVHSIPLTINKEYALSRPVATDFE

SEQ ID NO: 48923 - protein, 25 aa, synthetic construct
  source 1..25: note = Seed: QTVHSIPLTINKEEALQRPVASDFE
QTVHSIPLTINKEYALSRPVAVDFE

SEQ ID NO: 48924 - protein, 25 aa, synthetic construct
  source 1..25: note = Seed: QTVHSIPLTINKEEALQRPVASDFE
QTVHSIPLTINKEYALSRSVAADFE

SEQ ID NO: 48925 - protein, 25 aa, synthetic construct
  source 1..25: note = Seed: QTVHSIPLTINKEEALQRPVASDFE
QTVHSIPLTINKEYALSRSVAGDFE

SEQ ID NO: 48926 - protein, 25 aa, synthetic construct
  source 1..25: note = Seed: QTVHSIPLTINKEEALQRPVASDFE
QTVHSIPLTINKEYALSRSVAHDFE

SEQ ID NO: 48927 - protein, 25 aa, synthetic construct
  source 1..25: note = Seed: QTVHSIPLTINKEEALQRPVASDFE
QTVHSIPLTINKEYALSRSVAIDFE

SEQ ID NO: 48928 - protein, 25 aa, synthetic construct
  source 1..25: note = Seed: QTVHSIPLTINKEEALQRPVASDFE
QTVHSIPLTINKEYALSRSVALDFE

SEQ ID NO: 48929 - protein, 25 aa, synthetic construct
  source 1..25: note = Seed: QTVHSIPLTINKEEALQRPVASDFE
QTVHSIPLTINKEYALSRSVAMDFE

SEQ ID NO: 48930 - protein, 25 aa, synthetic construct
  source 1..25: note = Seed: QTVHSIPLTINKEEALQRPVASDFE
QTVHSIPLTINKEYALSRSVANDFE

SEQ ID NO: 48931 - protein, 25 aa, synthetic construct
  source 1..25: note = Seed: QTVHSIPLTINKEEALQRPVASDFE
QTVHSIPLTINKEYALSRSVAQDFE

SEQ ID NO: 48932 - protein, 25 aa, synthetic construct
  source 1..25: note = Seed: QTVHSIPLTINKEEALQRPVASDFE
QTVHSIPLTINKEYALSRSVASDFE

SEQ ID NO: 48933 - protein, 25 aa, synthetic construct
  source 1..25: note = Seed: QTVHSIPLTINKEEALQRPVASDFE
QTVHSIPLTINKEYALSRSVATDFE

SEQ ID NO: 48934 - protein, 25 aa, synthetic construct
  source 1..25: note = Seed: QTVHSIPLTINKEEALQRPVASDFE
QTVHSIPLTINKEYALSRSVAVDFE

SEQ ID NO: 48935 - protein, 25 aa, synthetic construct
  source 1..25: note = Seed: QTVHSIPLTINKEEALQRPVASDFE
QTVHSIPLTINKEYALSRTVAADFE

SEQ ID NO: 48936 - protein, 25 aa, synthetic construct
  source 1..25: note = Seed: QTVHSIPLTINKEEALQRPVASDFE
QTVHSIPLTINKEYALSRTVAGDFE

SEQ ID NO: 48937 - protein, 25 aa, synthetic construct
  source 1..25: note = Seed: QTVHSIPLTINKEEALQRPVASDFE
QTVHSIPLTINKEYALSRTVAHDFE

SEQ ID NO: 48938 - protein, 25 aa, synthetic construct
  source 1..25: note = Seed: QTVHSIPLTINKEEALQRPVASDFE
QTVHSIPLTINKEYALSRTVAIDFE

SEQ ID NO: 48939 - protein, 25 aa, synthetic construct
  source 1..25: note = Seed: QTVHSIPLTINKEEALQRPVASDFE
QTVHSIPLTINKEYALSRTVALDFE

SEQ ID NO: 48940 - protein, 25 aa, synthetic construct
  source 1..25: note = Seed: QTVHSIPLTINKEEALQRPVASDFE
QTVHSIPLTINKEYALSRTVAMDFE

SEQ ID NO: 48941 - protein, 25 aa, synthetic construct
  source 1..25: note = Seed: QTVHSIPLTINKEEALQRPVASDFE
QTVHSIPLTINKEYALSRTVANDFE

SEQ ID NO: 48942 - protein, 25 aa, synthetic construct
  source 1..25: note = Seed: QTVHSIPLTINKEEALQRPVASDFE
QTVHSIPLTINKEYALSRTVAQDFE

SEQ ID NO: 48943 - protein, 25 aa, synthetic construct
  source 1..25: note = Seed: QTVHSIPLTINKEEALQRPVASDFE
QTVHSIPLTINKEYALSRTVASDFE

SEQ ID NO: 48944 - protein, 25 aa, synthetic construct
  source 1..25: note = Seed: QTVHSIPLTINKEEALQRPVASDFE
QTVHSIPLTINKEYALSRTVATDFE

SEQ ID NO: 48945 - protein, 25 aa, synthetic construct
  source 1..25: note = Seed: QTVHSIPLTINKEEALQRPVASDFE
QTVHSIPLTINKEYALSRTVAVDFE

SEQ ID NO: 48946 - protein, 25 aa, synthetic construct
  source 1..25: note = Seed: QTVHSIPLTINKEEALQRPVASDFE
QTVHSIPLTINKEYALSRVVAADFE

SEQ ID NO: 48947 - protein, 25 aa, synthetic construct
  source 1..25: note = Seed: QTVHSIPLTINKEEALQRPVASDFE
QTVHSIPLTINKEYALSRVVAGDFE

SEQ ID NO: 48948 - protein, 25 aa, synthetic construct
  source 1..25: note = Seed: QTVHSIPLTINKEEALQRPVASDFE
QTVHSIPLTINKEYALSRVVAHDFE

SEQ ID NO: 48949 - protein, 25 aa, synthetic construct
  source 1..25: note = Seed: QTVHSIPLTINKEEALQRPVASDFE
QTVHSIPLTINKEYALSRVVAIDFE

SEQ ID NO: 48950 - protein, 25 aa, synthetic construct
  source 1..25: note = Seed: QTVHSIPLTINKEEALQRPVASDFE
QTVHSIPLTINKEYALSRVVALDFE

SEQ ID NO: 48951 - protein, 25 aa, synthetic construct
  source 1..25: note = Seed: QTVHSIPLTINKEEALQRPVASDFE
QTVHSIPLTINKEYALSRVVAMDFE

SEQ ID NO: 48952 - protein, 25 aa, synthetic construct
  source 1..25: note = Seed: QTVHSIPLTINKEEALQRPVASDFE
QTVHSIPLTINKEYALSRVVANDFE

SEQ ID NO: 48953 - protein, 25 aa, synthetic construct
  source 1..25: note = Seed: QTVHSIPLTINKEEALQRPVASDFE
QTVHSIPLTINKEYALSRVVAQDFE

SEQ ID NO: 48954 - protein, 25 aa, synthetic construct
  source 1..25: note = Seed: QTVHSIPLTINKEEALQRPVASDFE
QTVHSIPLTINKEYALSRVVASDFE

SEQ ID NO: 48955 - protein, 25 aa, synthetic construct
  source 1..25: note = Seed: QTVHSIPLTINKEEALQRPVASDFE
QTVHSIPLTINKEYALSRVVATDFE

SEQ ID NO: 48956 - protein, 25 aa, synthetic construct
  source 1..25: note = Seed: QTVHSIPLTINKEEALQRPVASDFE
QTVHSIPLTINKEYALSRVVAVDFE

SEQ ID NO: 48957 - protein, 25 aa, synthetic construct
  source 1..25: note = Seed: QTVHSIPLTINKEEALQRPVASDFE
QTVHSIPLTINKEYALTRAVAADFE

SEQ ID NO: 48958 - protein, 25 aa, synthetic construct
  source 1..25: note = Seed: QTVHSIPLTINKEEALQRPVASDFE
QTVHSIPLTINKEYALTRAVAFDFE

SEQ ID NO: 48959 - protein, 25 aa, synthetic construct
  source 1..25: note = Seed: QTVHSIPLTINKEEALQRPVASDFE
QTVHSIPLTINKEYALTRAVAGDFE

SEQ ID NO: 48960 - protein, 25 aa, synthetic construct
  source 1..25: note = Seed: QTVHSIPLTINKEEALQRPVASDFE
QTVHSIPLTINKEYALTRAVAHDFE

SEQ ID NO: 48961 - protein, 25 aa, synthetic construct
  source 1..25: note = Seed: QTVHSIPLTINKEEALQRPVASDFE
QTVHSIPLTINKEYALTRAVAIDFE

SEQ ID NO: 48962 - protein, 25 aa, synthetic construct
  source 1..25: note = Seed: QTVHSIPLTINKEEALQRPVASDFE
QTVHSIPLTINKEYALTRAVALDFE

SEQ ID NO: 48963 - protein, 25 aa, synthetic construct
  source 1..25: note = Seed: QTVHSIPLTINKEEALQRPVASDFE
QTVHSIPLTINKEYALTRAVAMDFE

SEQ ID NO: 48964 - protein, 25 aa, synthetic construct
  source 1..25: note = Seed: QTVHSIPLTINKEEALQRPVASDFE
QTVHSIPLTINKEYALTRAVANDFE

SEQ ID NO: 48965 - protein, 25 aa, synthetic construct
  source 1..25: note = Seed: QTVHSIPLTINKEEALQRPVASDFE
QTVHSIPLTINKEYALTRAVAPDFE

SEQ ID NO: 48966 - protein, 25 aa, synthetic construct
  source 1..25: note = Seed: QTVHSIPLTINKEEALQRPVASDFE
QTVHSIPLTINKEYALTRAVAQDFE

SEQ ID NO: 48967 - protein, 25 aa, synthetic construct
  source 1..25: note = Seed: QTVHSIPLTINKEEALQRPVASDFE
QTVHSIPLTINKEYALTRAVASDFE

SEQ ID NO: 48968 - protein, 25 aa, synthetic construct
  source 1..25: note = Seed: QTVHSIPLTINKEEALQRPVASDFE
QTVHSIPLTINKEYALTRAVATDFE

SEQ ID NO: 48969 - protein, 25 aa, synthetic construct
  source 1..25: note = Seed: QTVHSIPLTINKEEALQRPVASDFE
QTVHSIPLTINKEYALTRAVAVDFE

SEQ ID NO: 48970 - protein, 25 aa, synthetic construct
  source 1..25: note = Seed: QTVHSIPLTINKEEALQRPVASDFE
QTVHSIPLTINKEYALTRAVAYDFE

SEQ ID NO: 48971 - protein, 25 aa, synthetic construct
  source 1..25: note = Seed: QTVHSIPLTINKEEALQRPVASDFE
QTVHSIPLTINKEYALTRGVAADFE

SEQ ID NO: 48972 - protein, 25 aa, synthetic construct
  source 1..25: note = Seed: QTVHSIPLTINKEEALQRPVASDFE
QTVHSIPLTINKEYALTRGVAGDFE

SEQ ID NO: 48973 - protein, 25 aa, synthetic construct
  source 1..25: note = Seed: QTVHSIPLTINKEEALQRPVASDFE
QTVHSIPLTINKEYALTRGVAIDFE

SEQ ID NO: 48974 - protein, 25 aa, synthetic construct
  source 1..25: note = Seed: QTVHSIPLTINKEEALQRPVASDFE
QTVHSIPLTINKEYALTRGVALDFE

SEQ ID NO: 48975 - protein, 25 aa, synthetic construct
  source 1..25: note = Seed: QTVHSIPLTINKEEALQRPVASDFE
QTVHSIPLTINKEYALTRGVAMDFE

SEQ ID NO: 48976 - protein, 25 aa, synthetic construct
  source 1..25: note = Seed: QTVHSIPLTINKEEALQRPVASDFE
QTVHSIPLTINKEYALTRGVANDFE

SEQ ID NO: 48977 - protein, 25 aa, synthetic construct
  source 1..25: note = Seed: QTVHSIPLTINKEEALQRPVASDFE
QTVHSIPLTINKEYALTRGVASDFE

SEQ ID NO: 48978 - protein, 25 aa, synthetic construct
  source 1..25: note = Seed: QTVHSIPLTINKEEALQRPVASDFE
QTVHSIPLTINKEYALTRGVATDFE

SEQ ID NO: 48979 - protein, 25 aa, synthetic construct
  source 1..25: note = Seed: QTVHSIPLTINKEEALQRPVASDFE
QTVHSIPLTINKEYALTRGVAVDFE

SEQ ID NO: 48980 - protein, 25 aa, synthetic construct
  source 1..25: note = Seed: QTVHSIPLTINKEEALQRPVASDFE
QTVHSIPLTINKEYALTRIVAADFE

SEQ ID NO: 48981 - protein, 25 aa, synthetic construct
  source 1..25: note = Seed: QTVHSIPLTINKEEALQRPVASDFE
QTVHSIPLTINKEYALTRIVANDFE

SEQ ID NO: 48982 - protein, 25 aa, synthetic construct
  source 1..25: note = Seed: QTVHSIPLTINKEEALQRPVASDFE
QTVHSIPLTINKEYALTRIVASDFE

SEQ ID NO: 48983 - protein, 25 aa, synthetic construct
  source 1..25: note = Seed: QTVHSIPLTINKEEALQRPVASDFE
QTVHSIPLTINKEYALTRIVATDFE

SEQ ID NO: 48984 - protein, 25 aa, synthetic construct
  source 1..25: note = Seed: QTVHSIPLTINKEEALQRPVASDFE
QTVHSIPLTINKEYALTRNVAADFE

SEQ ID NO: 48985 - protein, 25 aa, synthetic construct
  source 1..25: note = Seed: QTVHSIPLTINKEEALQRPVASDFE
QTVHSIPLTINKEYALTRNVAIDFE

SEQ ID NO: 48986 - protein, 25 aa, synthetic construct
  source 1..25: note = Seed: QTVHSIPLTINKEEALQRPVASDFE
QTVHSIPLTINKEYALTRNVALDFE

SEQ ID NO: 48987 - protein, 25 aa, synthetic construct
  source 1..25: note = Seed: QTVHSIPLTINKEEALQRPVASDFE
QTVHSIPLTINKEYALTRNVAMDFE

SEQ ID NO: 48988 - protein, 25 aa, synthetic construct
  source 1..25: note = Seed: QTVHSIPLTINKEEALQRPVASDFE
QTVHSIPLTINKEYALTRNVANDFE

SEQ ID NO: 48989 - protein, 25 aa, synthetic construct
  source 1..25: note = Seed: QTVHSIPLTINKEEALQRPVASDFE
QTVHSIPLTINKEYALTRNVASDFE

SEQ ID NO: 48990 - protein, 25 aa, synthetic construct
  source 1..25: note = Seed: QTVHSIPLTINKEEALQRPVASDFE
QTVHSIPLTINKEYALTRNVATDFE

SEQ ID NO: 48991 - protein, 25 aa, synthetic construct
  source 1..25: note = Seed: QTVHSIPLTINKEEALQRPVASDFE
QTVHSIPLTINKEYALTRNVAVDFE

SEQ ID NO: 48992 - protein, 25 aa, synthetic construct
  source 1..25: note = Seed: QTVHSIPLTINKEEALQRPVASDFE
QTVHSIPLTINKEYALTRPVAADFE

SEQ ID NO: 48993 - protein, 25 aa, synthetic construct
  source 1..25: note = Seed: QTVHSIPLTINKEEALQRPVASDFE
QTVHSIPLTINKEYALTRPVAGDFE

SEQ ID NO: 48994 - protein, 25 aa, synthetic construct
  source 1..25: note = Seed: QTVHSIPLTINKEEALQRPVASDFE
QTVHSIPLTINKEYALTRPVAHDFE

SEQ ID NO: 48995 - protein, 25 aa, synthetic construct
  source 1..25: note = Seed: QTVHSIPLTINKEEALQRPVASDFE
QTVHSIPLTINKEYALTRPVAIDFE

SEQ ID NO: 48996 - protein, 25 aa, synthetic construct
  source 1..25: note = Seed: QTVHSIPLTINKEEALQRPVASDFE
QTVHSIPLTINKEYALTRPVALDFE

SEQ ID NO: 48997 - protein, 25 aa, synthetic construct
  source 1..25: note = Seed: QTVHSIPLTINKEEALQRPVASDFE
QTVHSIPLTINKEYALTRPVAMDFE

SEQ ID NO: 48998 - protein, 25 aa, synthetic construct
  source 1..25: note = Seed: QTVHSIPLTINKEEALQRPVASDFE
QTVHSIPLTINKEYALTRPVANDFE

SEQ ID NO: 48999 - protein, 25 aa, synthetic construct
  source 1..25: note = Seed: QTVHSIPLTINKEEALQRPVASDFE
QTVHSIPLTINKEYALTRPVAQDFE

SEQ ID NO: 49000 - protein, 25 aa, synthetic construct
  source 1..25: note = Seed: QTVHSIPLTINKEEALQRPVASDFE
QTVHSIPLTINKEYALTRPVASDFE

SEQ ID NO: 49001 - protein, 25 aa, synthetic construct
  source 1..25: note = Seed: QTVHSIPLTINKEEALQRPVASDFE
QTVHSIPLTINKEYALTRPVATDFE

SEQ ID NO: 49002 - protein, 25 aa, synthetic construct
  source 1..25: note = Seed: QTVHSIPLTINKEEALQRPVASDFE
QTVHSIPLTINKEYALTRPVAVDFE

SEQ ID NO: 49003 - protein, 25 aa, synthetic construct
  source 1..25: note = Seed: QTVHSIPLTINKEEALQRPVASDFE
QTVHSIPLTINKEYALTRSVAADFE

SEQ ID NO: 49004 - protein, 25 aa, synthetic construct
  source 1..25: note = Seed: QTVHSIPLTINKEEALQRPVASDFE
QTVHSIPLTINKEYALTRSVAGDFE

SEQ ID NO: 49005 - protein, 25 aa, synthetic construct
  source 1..25: note = Seed: QTVHSIPLTINKEEALQRPVASDFE
QTVHSIPLTINKEYALTRSVAHDFE

SEQ ID NO: 49006 - protein, 25 aa, synthetic construct
  source 1..25: note = Seed: QTVHSIPLTINKEEALQRPVASDFE
QTVHSIPLTINKEYALTRSVAIDFE

SEQ ID NO: 49007 - protein, 25 aa, synthetic construct
  source 1..25: note = Seed: QTVHSIPLTINKEEALQRPVASDFE
QTVHSIPLTINKEYALTRSVALDFE

SEQ ID NO: 49008 - protein, 25 aa, synthetic construct
  source 1..25: note = Seed: QTVHSIPLTINKEEALQRPVASDFE
QTVHSIPLTINKEYALTRSVAMDFE

SEQ ID NO: 49009 - protein, 25 aa, synthetic construct
  source 1..25: note = Seed: QTVHSIPLTINKEEALQRPVASDFE
QTVHSIPLTINKEYALTRSVANDFE

SEQ ID NO: 49010 - protein, 25 aa, synthetic construct
  source 1..25: note = Seed: QTVHSIPLTINKEEALQRPVASDFE
QTVHSIPLTINKEYALTRSVAQDFE

SEQ ID NO: 49011 - protein, 25 aa, synthetic construct
  source 1..25: note = Seed: QTVHSIPLTINKEEALQRPVASDFE
QTVHSIPLTINKEYALTRSVASDFE

SEQ ID NO: 49012 - protein, 25 aa, synthetic construct
  source 1..25: note = Seed: QTVHSIPLTINKEEALQRPVASDFE
QTVHSIPLTINKEYALTRSVATDFE

SEQ ID NO: 49013 - protein, 25 aa, synthetic construct
  source 1..25: note = Seed: QTVHSIPLTINKEEALQRPVASDFE
QTVHSIPLTINKEYALTRSVAVDFE

SEQ ID NO: 49014 - protein, 25 aa, synthetic construct
  source 1..25: note = Seed: QTVHSIPLTINKEEALQRPVASDFE
QTVHSIPLTINKEYALTRTVAADFE

SEQ ID NO: 49015 - protein, 25 aa, synthetic construct
  source 1..25: note = Seed: QTVHSIPLTINKEEALQRPVASDFE
QTVHSIPLTINKEYALTRTVAGDFE

SEQ ID NO: 49016 - protein, 25 aa, synthetic construct
  source 1..25: note = Seed: QTVHSIPLTINKEEALQRPVASDFE
QTVHSIPLTINKEYALTRTVAHDFE

SEQ ID NO: 49017 - protein, 25 aa, synthetic construct
  source 1..25: note = Seed: QTVHSIPLTINKEEALQRPVASDFE
QTVHSIPLTINKEYALTRTVAIDFE

SEQ ID NO: 49018 - protein, 25 aa, synthetic construct
  source 1..25: note = Seed: QTVHSIPLTINKEEALQRPVASDFE
QTVHSIPLTINKEYALTRTVALDFE

SEQ ID NO: 49019 - protein, 25 aa, synthetic construct
  source 1..25: note = Seed: QTVHSIPLTINKEEALQRPVASDFE
QTVHSIPLTINKEYALTRTVAMDFE

SEQ ID NO: 49020 - protein, 25 aa, synthetic construct
  source 1..25: note = Seed: QTVHSIPLTINKEEALQRPVASDFE
QTVHSIPLTINKEYALTRTVANDFE

SEQ ID NO: 49021 - protein, 25 aa, synthetic construct
  source 1..25: note = Seed: QTVHSIPLTINKEEALQRPVASDFE
QTVHSIPLTINKEYALTRTVASDFE

SEQ ID NO: 49022 - protein, 25 aa, synthetic construct
  source 1..25: note = Seed: QTVHSIPLTINKEEALQRPVASDFE
QTVHSIPLTINKEYALTRTVATDFE

SEQ ID NO: 49023 - protein, 25 aa, synthetic construct
  source 1..25: note = Seed: QTVHSIPLTINKEEALQRPVASDFE
QTVHSIPLTINKEYALTRTVAVDFE

SEQ ID NO: 49024 - protein, 25 aa, synthetic construct
  source 1..25: note = Seed: QTVHSIPLTINKEEALQRPVASDFE
QTVHSIPLTINKEYALTRVVAADFE

SEQ ID NO: 49025 - protein, 25 aa, synthetic construct
  source 1..25: note = Seed: QTVHSIPLTINKEEALQRPVASDFE
QTVHSIPLTINKEYALTRVVAGDFE

SEQ ID NO: 49026 - protein, 25 aa, synthetic construct
  source 1..25: note = Seed: QTVHSIPLTINKEEALQRPVASDFE
QTVHSIPLTINKEYALTRVVAHDFE

SEQ ID NO: 49027 - protein, 25 aa, synthetic construct
  source 1..25: note = Seed: QTVHSIPLTINKEEALQRPVASDFE
QTVHSIPLTINKEYALTRVVAIDFE

SEQ ID NO: 49028 - protein, 25 aa, synthetic construct
  source 1..25: note = Seed: QTVHSIPLTINKEEALQRPVASDFE
QTVHSIPLTINKEYALTRVVALDFE

SEQ ID NO: 49029 - protein, 25 aa, synthetic construct
  source 1..25: note = Seed: QTVHSIPLTINKEEALQRPVASDFE
QTVHSIPLTINKEYALTRVVAMDFE

SEQ ID NO: 49030 - protein, 25 aa, synthetic construct
  source 1..25: note = Seed: QTVHSIPLTINKEEALQRPVASDFE
QTVHSIPLTINKEYALTRVVANDFE

SEQ ID NO: 49031 - protein, 25 aa, synthetic construct
  source 1..25: note = Seed: QTVHSIPLTINKEEALQRPVASDFE
QTVHSIPLTINKEYALTRVVASDFE

SEQ ID NO: 49032 - protein, 25 aa, synthetic construct
  source 1..25: note = Seed: QTVHSIPLTINKEEALQRPVASDFE
QTVHSIPLTINKEYALTRVVATDFE

SEQ ID NO: 49033 - protein, 25 aa, synthetic construct
  source 1..25: note = Seed: QTVHSIPLTINKEEALQRPVASDFE
QTVHSIPLTINKEYALTRVVAVDFE

SEQ ID NO: 49034 - protein, 25 aa, synthetic construct
  source 1..25: note = Seed: QTVHSIPLTINKEEALQRPVASDFE
QTVHSIPLTINKEYALVRAVAADFE

SEQ ID NO: 49035 - protein, 25 aa, synthetic construct
  source 1..25: note = Seed: QTVHSIPLTINKEEALQRPVASDFE
QTVHSIPLTINKEYALVRAVACDFE

SEQ ID NO: 49036 - protein, 25 aa, synthetic construct
  source 1..25: note = Seed: QTVHSIPLTINKEEALQRPVASDFE
QTVHSIPLTINKEYALVRAVADDFE

SEQ ID NO: 49037 - protein, 25 aa, synthetic construct
  source 1..25: note = Seed: QTVHSIPLTINKEEALQRPVASDFE
QTVHSIPLTINKEYALVRAVAEDFE

SEQ ID NO: 49038 - protein, 25 aa, synthetic construct
  source 1..25: note = Seed: QTVHSIPLTINKEEALQRPVASDFE
QTVHSIPLTINKEYALVRAVAGDFE

SEQ ID NO: 49039 - protein, 25 aa, synthetic construct
  source 1..25: note = Seed: QTVHSIPLTINKEEALQRPVASDFE
QTVHSIPLTINKEYALVRAVAHDFE

SEQ ID NO: 49040 - protein, 25 aa, synthetic construct
  source 1..25: note = Seed: QTVHSIPLTINKEEALQRPVASDFE
QTVHSIPLTINKEYALVRAVAIDFE

SEQ ID NO: 49041 - protein, 25 aa, synthetic construct
  source 1..25: note = Seed: QTVHSIPLTINKEEALQRPVASDFE
QTVHSIPLTINKEYALVRAVAKDFE

SEQ ID NO: 49042 - protein, 25 aa, synthetic construct
  source 1..25: note = Seed: QTVHSIPLTINKEEALQRPVASDFE
QTVHSIPLTINKEYALVRAVALDFE

SEQ ID NO: 49043 - protein, 25 aa, synthetic construct
  source 1..25: note = Seed: QTVHSIPLTINKEEALQRPVASDFE
QTVHSIPLTINKEYALVRAVAMDFE

SEQ ID NO: 49044 - protein, 25 aa, synthetic construct
  source 1..25: note = Seed: QTVHSIPLTINKEEALQRPVASDFE
QTVHSIPLTINKEYALVRAVANDFE

SEQ ID NO: 49045 - protein, 25 aa, synthetic construct
  source 1..25: note = Seed: QTVHSIPLTINKEEALQRPVASDFE
QTVHSIPLTINKEYALVRAVAPDFE

SEQ ID NO: 49046 - protein, 25 aa, synthetic construct
  source 1..25: note = Seed: QTVHSIPLTINKEEALQRPVASDFE
QTVHSIPLTINKEYALVRAVAQDFE

SEQ ID NO: 49047 - protein, 25 aa, synthetic construct
  source 1..25: note = Seed: QTVHSIPLTINKEEALQRPVASDFE
QTVHSIPLTINKEYALVRAVARDFE

SEQ ID NO: 49048 - protein, 25 aa, synthetic construct
  source 1..25: note = Seed: QTVHSIPLTINKEEALQRPVASDFE
QTVHSIPLTINKEYALVRAVASDFE

SEQ ID NO: 49049 - protein, 25 aa, synthetic construct
  source 1..25: note = Seed: QTVHSIPLTINKEEALQRPVASDFE
QTVHSIPLTINKEYALVRAVATDFE

SEQ ID NO: 49050 - protein, 25 aa, synthetic construct
  source 1..25: note = Seed: QTVHSIPLTINKEEALQRPVASDFE
QTVHSIPLTINKEYALVRAVAVDFE

SEQ ID NO: 49051 - protein, 25 aa, synthetic construct
  source 1..25: note = Seed: QTVHSIPLTINKEEALQRPVASDFE
QTVHSIPLTINKEYALVRAVAYDFE

SEQ ID NO: 49052 - protein, 25 aa, synthetic construct
  source 1..25: note = Seed: QTVHSIPLTINKEEALQRPVASDFE
QTVHSIPLTINKEYALVRGVAADFE

SEQ ID NO: 49053 - protein, 25 aa, synthetic construct
  source 1..25: note = Seed: QTVHSIPLTINKEEALQRPVASDFE
QTVHSIPLTINKEYALVRGVADDFE

SEQ ID NO: 49054 - protein, 25 aa, synthetic construct
  source 1..25: note = Seed: QTVHSIPLTINKEEALQRPVASDFE
QTVHSIPLTINKEYALVRGVAGDFE

SEQ ID NO: 49055 - protein, 25 aa, synthetic construct
  source 1..25: note = Seed: QTVHSIPLTINKEEALQRPVASDFE
QTVHSIPLTINKEYALVRGVAHDFE

SEQ ID NO: 49056 - protein, 25 aa, synthetic construct
  source 1..25: note = Seed: QTVHSIPLTINKEEALQRPVASDFE
QTVHSIPLTINKEYALVRGVAIDFE

SEQ ID NO: 49057 - protein, 25 aa, synthetic construct
  source 1..25: note = Seed: QTVHSIPLTINKEEALQRPVASDFE
QTVHSIPLTINKEYALVRGVALDFE

SEQ ID NO: 49058 - protein, 25 aa, synthetic construct
  source 1..25: note = Seed: QTVHSIPLTINKEEALQRPVASDFE
QTVHSIPLTINKEYALVRGVAMDFE

SEQ ID NO: 49059 - protein, 25 aa, synthetic construct
  source 1..25: note = Seed: QTVHSIPLTINKEEALQRPVASDFE
QTVHSIPLTINKEYALVRGVANDFE

SEQ ID NO: 49060 - protein, 25 aa, synthetic construct
  source 1..25: note = Seed: QTVHSIPLTINKEEALQRPVASDFE
QTVHSIPLTINKEYALVRGVAPDFE

SEQ ID NO: 49061 - protein, 25 aa, synthetic construct
  source 1..25: note = Seed: QTVHSIPLTINKEEALQRPVASDFE
QTVHSIPLTINKEYALVRGVAQDFE

SEQ ID NO: 49062 - protein, 25 aa, synthetic construct
  source 1..25: note = Seed: QTVHSIPLTINKEEALQRPVASDFE
QTVHSIPLTINKEYALVRGVASDFE

SEQ ID NO: 49063 - protein, 25 aa, synthetic construct
  source 1..25: note = Seed: QTVHSIPLTINKEEALQRPVASDFE
QTVHSIPLTINKEYALVRGVATDFE

SEQ ID NO: 49064 - protein, 25 aa, synthetic construct
  source 1..25: note = Seed: QTVHSIPLTINKEEALQRPVASDFE
QTVHSIPLTINKEYALVRGVAVDFE

SEQ ID NO: 49065 - protein, 25 aa, synthetic construct
  source 1..25: note = Seed: QTVHSIPLTINKEEALQRPVASDFE
QTVHSIPLTINKEYALVRHVAADFE

SEQ ID NO: 49066 - protein, 25 aa, synthetic construct
  source 1..25: note = Seed: QTVHSIPLTINKEEALQRPVASDFE
QTVHSIPLTINKEYALVRHVANDFE

SEQ ID NO: 49067 - protein, 25 aa, synthetic construct
  source 1..25: note = Seed: QTVHSIPLTINKEEALQRPVASDFE
QTVHSIPLTINKEYALVRHVASDFE

SEQ ID NO: 49068 - protein, 25 aa, synthetic construct
  source 1..25: note = Seed: QTVHSIPLTINKEEALQRPVASDFE
QTVHSIPLTINKEYALVRIVAADFE

SEQ ID NO: 49069 - protein, 25 aa, synthetic construct
  source 1..25: note = Seed: QTVHSIPLTINKEEALQRPVASDFE
QTVHSIPLTINKEYALVRIVAGDFE

SEQ ID NO: 49070 - protein, 25 aa, synthetic construct
  source 1..25: note = Seed: QTVHSIPLTINKEEALQRPVASDFE
QTVHSIPLTINKEYALVRIVAHDFE

SEQ ID NO: 49071 - protein, 25 aa, synthetic construct
  source 1..25: note = Seed: QTVHSIPLTINKEEALQRPVASDFE
QTVHSIPLTINKEYALVRIVANDFE

SEQ ID NO: 49072 - protein, 25 aa, synthetic construct
  source 1..25: note = Seed: QTVHSIPLTINKEEALQRPVASDFE
QTVHSIPLTINKEYALVRIVASDFE

SEQ ID NO: 49073 - protein, 25 aa, synthetic construct
  source 1..25: note = Seed: QTVHSIPLTINKEEALQRPVASDFE
QTVHSIPLTINKEYALVRIVATDFE

SEQ ID NO: 49074 - protein, 25 aa, synthetic construct
  source 1..25: note = Seed: QTVHSIPLTINKEEALQRPVASDFE
QTVHSIPLTINKEYALVRLVANDFE

SEQ ID NO: 49075 - protein, 25 aa, synthetic construct
  source 1..25: note = Seed: QTVHSIPLTINKEEALQRPVASDFE
QTVHSIPLTINKEYALVRMVAADFE

SEQ ID NO: 49076 - protein, 25 aa, synthetic construct
  source 1..25: note = Seed: QTVHSIPLTINKEEALQRPVASDFE
QTVHSIPLTINKEYALVRMVANDFE

SEQ ID NO: 49077 - protein, 25 aa, synthetic construct
  source 1..25: note = Seed: QTVHSIPLTINKEEALQRPVASDFE
QTVHSIPLTINKEYALVRMVASDFE

SEQ ID NO: 49078 - protein, 25 aa, synthetic construct
  source 1..25: note = Seed: QTVHSIPLTINKEEALQRPVASDFE
QTVHSIPLTINKEYALVRNVAADFE

SEQ ID NO: 49079 - protein, 25 aa, synthetic construct
  source 1..25: note = Seed: QTVHSIPLTINKEEALQRPVASDFE
QTVHSIPLTINKEYALVRNVAGDFE

SEQ ID NO: 49080 - protein, 25 aa, synthetic construct
  source 1..25: note = Seed: QTVHSIPLTINKEEALQRPVASDFE
QTVHSIPLTINKEYALVRNVAHDFE

SEQ ID NO: 49081 - protein, 25 aa, synthetic construct
  source 1..25: note = Seed: QTVHSIPLTINKEEALQRPVASDFE
QTVHSIPLTINKEYALVRNVAIDFE

SEQ ID NO: 49082 - protein, 25 aa, synthetic construct
  source 1..25: note = Seed: QTVHSIPLTINKEEALQRPVASDFE
QTVHSIPLTINKEYALVRNVALDFE

SEQ ID NO: 49083 - protein, 25 aa, synthetic construct
  source 1..25: note = Seed: QTVHSIPLTINKEEALQRPVASDFE
QTVHSIPLTINKEYALVRNVAMDFE

SEQ ID NO: 49084 - protein, 25 aa, synthetic construct
  source 1..25: note = Seed: QTVHSIPLTINKEEALQRPVASDFE
QTVHSIPLTINKEYALVRNVANDFE

SEQ ID NO: 49085 - protein, 25 aa, synthetic construct
  source 1..25: note = Seed: QTVHSIPLTINKEEALQRPVASDFE
QTVHSIPLTINKEYALVRNVAPDFE

SEQ ID NO: 49086 - protein, 25 aa, synthetic construct
  source 1..25: note = Seed: QTVHSIPLTINKEEALQRPVASDFE
QTVHSIPLTINKEYALVRNVAQDFE

SEQ ID NO: 49087 - protein, 25 aa, synthetic construct
  source 1..25: note = Seed: QTVHSIPLTINKEEALQRPVASDFE
QTVHSIPLTINKEYALVRNVASDFE

SEQ ID NO: 49088 - protein, 25 aa, synthetic construct
  source 1..25: note = Seed: QTVHSIPLTINKEEALQRPVASDFE
QTVHSIPLTINKEYALVRNVATDFE

SEQ ID NO: 49089 - protein, 25 aa, synthetic construct
  source 1..25: note = Seed: QTVHSIPLTINKEEALQRPVASDFE
QTVHSIPLTINKEYALVRNVAVDFE

SEQ ID NO: 49090 - protein, 25 aa, synthetic construct
  source 1..25: note = Seed: QTVHSIPLTINKEEALQRPVASDFE
QTVHSIPLTINKEYALVRPVAADFE

SEQ ID NO: 49091 - protein, 25 aa, synthetic construct
  source 1..25: note = Seed: QTVHSIPLTINKEEALQRPVASDFE
QTVHSIPLTINKEYALVRPVACDFE

SEQ ID NO: 49092 - protein, 25 aa, synthetic construct
  source 1..25: note = Seed: QTVHSIPLTINKEEALQRPVASDFE
QTVHSIPLTINKEYALVRPVADDFE

SEQ ID NO: 49093 - protein, 25 aa, synthetic construct
  source 1..25: note = Seed: QTVHSIPLTINKEEALQRPVASDFE
QTVHSIPLTINKEYALVRPVAEDFE

SEQ ID NO: 49094 - protein, 25 aa, synthetic construct
  source 1..25: note = Seed: QTVHSIPLTINKEEALQRPVASDFE
QTVHSIPLTINKEYALVRPVAFDFE

SEQ ID NO: 49095 - protein, 25 aa, synthetic construct
  source 1..25: note = Seed: QTVHSIPLTINKEEALQRPVASDFE
QTVHSIPLTINKEYALVRPVAGDFE

SEQ ID NO: 49096 - protein, 25 aa, synthetic construct
  source 1..25: note = Seed: QTVHSIPLTINKEEALQRPVASDFE
QTVHSIPLTINKEYALVRPVAHDFE

SEQ ID NO: 49097 - protein, 25 aa, synthetic construct
  source 1..25: note = Seed: QTVHSIPLTINKEEALQRPVASDFE
QTVHSIPLTINKEYALVRPVAIDFE

SEQ ID NO: 49098 - protein, 25 aa, synthetic construct
  source 1..25: note = Seed: QTVHSIPLTINKEEALQRPVASDFE
QTVHSIPLTINKEYALVRPVALDFE

SEQ ID NO: 49099 - protein, 25 aa, synthetic construct
  source 1..25: note = Seed: QTVHSIPLTINKEEALQRPVASDFE
QTVHSIPLTINKEYALVRPVAMDFE

SEQ ID NO: 49100 - protein, 25 aa, synthetic construct
  source 1..25: note = Seed: QTVHSIPLTINKEEALQRPVASDFE
QTVHSIPLTINKEYALVRPVANDFE

SEQ ID NO: 49101 - protein, 25 aa, synthetic construct
  source 1..25: note = Seed: QTVHSIPLTINKEEALQRPVASDFE
QTVHSIPLTINKEYALVRPVAPDFE

SEQ ID NO: 49102 - protein, 25 aa, synthetic construct
  source 1..25: note = Seed: QTVHSIPLTINKEEALQRPVASDFE
QTVHSIPLTINKEYALVRPVAQDFE

SEQ ID NO: 49103 - protein, 25 aa, synthetic construct
  source 1..25: note = Seed: QTVHSIPLTINKEEALQRPVASDFE
QTVHSIPLTINKEYALVRPVASDFE

SEQ ID NO: 49104 - protein, 25 aa, synthetic construct
  source 1..25: note = Seed: QTVHSIPLTINKEEALQRPVASDFE
QTVHSIPLTINKEYALVRPVATDFE

SEQ ID NO: 49105 - protein, 25 aa, synthetic construct
  source 1..25: note = Seed: QTVHSIPLTINKEEALQRPVASDFE
QTVHSIPLTINKEYALVRPVAVDFE

SEQ ID NO: 49106 - protein, 25 aa, synthetic construct
  source 1..25: note = Seed: QTVHSIPLTINKEEALQRPVASDFE
QTVHSIPLTINKEYALVRPVAYDFE

SEQ ID NO: 49107 - protein, 25 aa, synthetic construct
  source 1..25: note = Seed: QTVHSIPLTINKEEALQRPVASDFE
QTVHSIPLTINKEYALVRQVAADFE

SEQ ID NO: 49108 - protein, 25 aa, synthetic construct
  source 1..25: note = Seed: QTVHSIPLTINKEEALQRPVASDFE
QTVHSIPLTINKEYALVRSVAADFE

SEQ ID NO: 49109 - protein, 25 aa, synthetic construct
  source 1..25: note = Seed: QTVHSIPLTINKEEALQRPVASDFE
QTVHSIPLTINKEYALVRSVADDFE

SEQ ID NO: 49110 - protein, 25 aa, synthetic construct
  source 1..25: note = Seed: QTVHSIPLTINKEEALQRPVASDFE
QTVHSIPLTINKEYALVRSVAEDFE

SEQ ID NO: 49111 - protein, 25 aa, synthetic construct
  source 1..25: note = Seed: QTVHSIPLTINKEEALQRPVASDFE
QTVHSIPLTINKEYALVRSVAGDFE

SEQ ID NO: 49112 - protein, 25 aa, synthetic construct
  source 1..25: note = Seed: QTVHSIPLTINKEEALQRPVASDFE
QTVHSIPLTINKEYALVRSVAHDFE

SEQ ID NO: 49113 - protein, 25 aa, synthetic construct
  source 1..25: note = Seed: QTVHSIPLTINKEEALQRPVASDFE
QTVHSIPLTINKEYALVRSVAIDFE

SEQ ID NO: 49114 - protein, 25 aa, synthetic construct
  source 1..25: note = Seed: QTVHSIPLTINKEEALQRPVASDFE
QTVHSIPLTINKEYALVRSVALDFE

SEQ ID NO: 49115 - protein, 25 aa, synthetic construct
  source 1..25: note = Seed: QTVHSIPLTINKEEALQRPVASDFE
QTVHSIPLTINKEYALVRSVAMDFE

SEQ ID NO: 49116 - protein, 25 aa, synthetic construct
  source 1..25: note = Seed: QTVHSIPLTINKEEALQRPVASDFE
QTVHSIPLTINKEYALVRSVANDFE

SEQ ID NO: 49117 - protein, 25 aa, synthetic construct
  source 1..25: note = Seed: QTVHSIPLTINKEEALQRPVASDFE
QTVHSIPLTINKEYALVRSVAPDFE

SEQ ID NO: 49118 - protein, 25 aa, synthetic construct
  source 1..25: note = Seed: QTVHSIPLTINKEEALQRPVASDFE
QTVHSIPLTINKEYALVRSVAQDFE

SEQ ID NO: 49119 - protein, 25 aa, synthetic construct
  source 1..25: note = Seed: QTVHSIPLTINKEEALQRPVASDFE
QTVHSIPLTINKEYALVRSVASDFE

SEQ ID NO: 49120 - protein, 25 aa, synthetic construct
  source 1..25: note = Seed: QTVHSIPLTINKEEALQRPVASDFE
QTVHSIPLTINKEYALVRSVATDFE

SEQ ID NO: 49121 - protein, 25 aa, synthetic construct
  source 1..25: note = Seed: QTVHSIPLTINKEEALQRPVASDFE
QTVHSIPLTINKEYALVRSVAVDFE

SEQ ID NO: 49122 - protein, 25 aa, synthetic construct
  source 1..25: note = Seed: QTVHSIPLTINKEEALQRPVASDFE
QTVHSIPLTINKEYALVRSVAYDFE

SEQ ID NO: 49123 - protein, 25 aa, synthetic construct
  source 1..25: note = Seed: QTVHSIPLTINKEEALQRPVASDFE
QTVHSIPLTINKEYALVRTVAADFE

SEQ ID NO: 49124 - protein, 25 aa, synthetic construct
  source 1..25: note = Seed: QTVHSIPLTINKEEALQRPVASDFE
QTVHSIPLTINKEYALVRTVADDFE

SEQ ID NO: 49125 - protein, 25 aa, synthetic construct
  source 1..25: note = Seed: QTVHSIPLTINKEEALQRPVASDFE
QTVHSIPLTINKEYALVRTVAEDFE

SEQ ID NO: 49126 - protein, 25 aa, synthetic construct
  source 1..25: note = Seed: QTVHSIPLTINKEEALQRPVASDFE
QTVHSIPLTINKEYALVRTVAGDFE

SEQ ID NO: 49127 - protein, 25 aa, synthetic construct
  source 1..25: note = Seed: QTVHSIPLTINKEEALQRPVASDFE
QTVHSIPLTINKEYALVRTVAHDFE

SEQ ID NO: 49128 - protein, 25 aa, synthetic construct
  source 1..25: note = Seed: QTVHSIPLTINKEEALQRPVASDFE
QTVHSIPLTINKEYALVRTVAIDFE

SEQ ID NO: 49129 - protein, 25 aa, synthetic construct
  source 1..25: note = Seed: QTVHSIPLTINKEEALQRPVASDFE
QTVHSIPLTINKEYALVRTVAKDFE

SEQ ID NO: 49130 - protein, 25 aa, synthetic construct
  source 1..25: note = Seed: QTVHSIPLTINKEEALQRPVASDFE
QTVHSIPLTINKEYALVRTVALDFE

SEQ ID NO: 49131 - protein, 25 aa, synthetic construct
  source 1..25: note = Seed: QTVHSIPLTINKEEALQRPVASDFE
QTVHSIPLTINKEYALVRTVAMDFE

SEQ ID NO: 49132 - protein, 25 aa, synthetic construct
  source 1..25: note = Seed: QTVHSIPLTINKEEALQRPVASDFE
QTVHSIPLTINKEYALVRTVANDFE

SEQ ID NO: 49133 - protein, 25 aa, synthetic construct
  source 1..25: note = Seed: QTVHSIPLTINKEEALQRPVASDFE
QTVHSIPLTINKEYALVRTVAPDFE

SEQ ID NO: 49134 - protein, 25 aa, synthetic construct
  source 1..25: note = Seed: QTVHSIPLTINKEEALQRPVASDFE
QTVHSIPLTINKEYALVRTVAQDFE

SEQ ID NO: 49135 - protein, 25 aa, synthetic construct
  source 1..25: note = Seed: QTVHSIPLTINKEEALQRPVASDFE
QTVHSIPLTINKEYALVRTVASDFE

SEQ ID NO: 49136 - protein, 25 aa, synthetic construct
  source 1..25: note = Seed: QTVHSIPLTINKEEALQRPVASDFE
QTVHSIPLTINKEYALVRTVATDFE

SEQ ID NO: 49137 - protein, 25 aa, synthetic construct
  source 1..25: note = Seed: QTVHSIPLTINKEEALQRPVASDFE
QTVHSIPLTINKEYALVRTVAVDFE

SEQ ID NO: 49138 - protein, 25 aa, synthetic construct
  source 1..25: note = Seed: QTVHSIPLTINKEEALQRPVASDFE
QTVHSIPLTINKEYALVRTVAYDFE

SEQ ID NO: 49139 - protein, 25 aa, synthetic construct
  source 1..25: note = Seed: QTVHSIPLTINKEEALQRPVASDFE
QTVHSIPLTINKEYALVRVVAADFE

SEQ ID NO: 49140 - protein, 25 aa, synthetic construct
  source 1..25: note = Seed: QTVHSIPLTINKEEALQRPVASDFE
QTVHSIPLTINKEYALVRVVADDFE

SEQ ID NO: 49141 - protein, 25 aa, synthetic construct
  source 1..25: note = Seed: QTVHSIPLTINKEEALQRPVASDFE
QTVHSIPLTINKEYALVRVVAGDFE

SEQ ID NO: 49142 - protein, 25 aa, synthetic construct
  source 1..25: note = Seed: QTVHSIPLTINKEEALQRPVASDFE
QTVHSIPLTINKEYALVRVVAHDFE

SEQ ID NO: 49143 - protein, 25 aa, synthetic construct
  source 1..25: note = Seed: QTVHSIPLTINKEEALQRPVASDFE
QTVHSIPLTINKEYALVRVVAMDFE

SEQ ID NO: 49144 - protein, 25 aa, synthetic construct
  source 1..25: note = Seed: QTVHSIPLTINKEEALQRPVASDFE
QTVHSIPLTINKEYALVRVVANDFE

SEQ ID NO: 49145 - protein, 25 aa, synthetic construct
  source 1..25: note = Seed: QTVHSIPLTINKEEALQRPVASDFE
QTVHSIPLTINKEYALVRVVAPDFE

SEQ ID NO: 49146 - protein, 25 aa, synthetic construct
  source 1..25: note = Seed: QTVHSIPLTINKEEALQRPVASDFE
QTVHSIPLTINKEYALVRVVAQDFE

SEQ ID NO: 49147 - protein, 25 aa, synthetic construct
  source 1..25: note = Seed: QTVHSIPLTINKEEALQRPVASDFE
QTVHSIPLTINKEYALVRVVASDFE

SEQ ID NO: 49148 - protein, 25 aa, synthetic construct
  source 1..25: note = Seed: QTVHSIPLTINKEEALQRPVASDFE
QTVHSIPLTINKEYALVRVVATDFE

SEQ ID NO: 49149 - protein, 25 aa, synthetic construct
  source 1..25: note = Seed: QTVHSIPLTINKEEALQRPVASDFE
QTVHSIPLTINKEYALVRVVAVDFE

SEQ ID NO: 49150 - protein, 25 aa, synthetic construct
  source 1..25: note = Seed: QTVHSIPLTINKEEALQRPVASDFE
QTVHSIPLTINKEYALWRAVAADFE

SEQ ID NO: 49151 - protein, 25 aa, synthetic construct
  source 1..25: note = Seed: QTVHSIPLTINKEEALQRPVASDFE
QTVHSIPLTINKEYALWRAVAGDFE

SEQ ID NO: 49152 - protein, 25 aa, synthetic construct
  source 1..25: note = Seed: QTVHSIPLTINKEEALQRPVASDFE
QTVHSIPLTINKEYALWRAVAHDFE

SEQ ID NO: 49153 - protein, 25 aa, synthetic construct
  source 1..25: note = Seed: QTVHSIPLTINKEEALQRPVASDFE
QTVHSIPLTINKEYALWRAVAIDFE

SEQ ID NO: 49154 - protein, 25 aa, synthetic construct
  source 1..25: note = Seed: QTVHSIPLTINKEEALQRPVASDFE
QTVHSIPLTINKEYALWRAVAMDFE

SEQ ID NO: 49155 - protein, 25 aa, synthetic construct
  source 1..25: note = Seed: QTVHSIPLTINKEEALQRPVASDFE
QTVHSIPLTINKEYALWRAVANDFE

SEQ ID NO: 49156 - protein, 25 aa, synthetic construct
  source 1..25: note = Seed: QTVHSIPLTINKEEALQRPVASDFE
QTVHSIPLTINKEYALWRAVASDFE

SEQ ID NO: 49157 - protein, 25 aa, synthetic construct
  source 1..25: note = Seed: QTVHSIPLTINKEEALQRPVASDFE
QTVHSIPLTINKEYALWRAVATDFE

SEQ ID NO: 49158 - protein, 25 aa, synthetic construct
  source 1..25: note = Seed: QTVHSIPLTINKEEALQRPVASDFE
QTVHSIPLTINKEYALWRAVAVDFE

SEQ ID NO: 49159 - protein, 25 aa, synthetic construct
  source 1..25: note = Seed: QTVHSIPLTINKEEALQRPVASDFE
QTVHSIPLTINKEYALWRNVAADFE

SEQ ID NO: 49160 - protein, 25 aa, synthetic construct
  source 1..25: note = Seed: QTVHSIPLTINKEEALQRPVASDFE
QTVHSIPLTINKEYALWRPVAADFE

SEQ ID NO: 49161 - protein, 25 aa, synthetic construct
  source 1..25: note = Seed: QTVHSIPLTINKEEALQRPVASDFE
QTVHSIPLTINKEYALWRPVANDFE

SEQ ID NO: 49162 - protein, 25 aa, synthetic construct
  source 1..25: note = Seed: QTVHSIPLTINKEEALQRPVASDFE
QTVHSIPLTINKEYALWRPVASDFE

SEQ ID NO: 49163 - protein, 25 aa, synthetic construct
  source 1..25: note = Seed: QTVHSIPLTINKEEALQRPVASDFE
QTVHSIPLTINKEYALWRPVAVDFE

SEQ ID NO: 49164 - protein, 25 aa, synthetic construct
  source 1..25: note = Seed: QTVHSIPLTINKEEALQRPVASDFE
QTVHSIPLTINKEYALWRSVAADFE

SEQ ID NO: 49165 - protein, 25 aa, synthetic construct
  source 1..25: note = Seed: QTVHSIPLTINKEEALQRPVASDFE
QTVHSIPLTINKEYALWRSVANDFE

SEQ ID NO: 49166 - protein, 25 aa, synthetic construct
  source 1..25: note = Seed: QTVHSIPLTINKEEALQRPVASDFE
QTVHSIPLTINKEYALWRSVASDFE

SEQ ID NO: 49167 - protein, 25 aa, synthetic construct
  source 1..25: note = Seed: QTVHSIPLTINKEEALQRPVASDFE
QTVHSIPLTINKEYALWRTVAADFE

SEQ ID NO: 49168 - protein, 25 aa, synthetic construct
  source 1..25: note = Seed: QTVHSIPLTINKEEALQRPVASDFE
QTVHSIPLTINKEYALWRTVANDFE

SEQ ID NO: 49169 - protein, 25 aa, synthetic construct
  source 1..25: note = Seed: QTVHSIPLTINKEEALQRPVASDFE
QTVHSIPLTINKEYALWRTVASDFE

SEQ ID NO: 49170 - protein, 25 aa, synthetic construct
  source 1..25: note = Seed: QTVHSIPLTINKEEALQRPVASDFE
QTVHSIPLTINKEYALWRVVAADFE

SEQ ID NO: 49171 - protein, 25 aa, synthetic construct
  source 1..25: note = Seed: QTVHSIPLTINKEEALQRPVASDFE
QTVHSIPLTINKEYALWRVVANDFE

SEQ ID NO: 49172 - protein, 25 aa, synthetic construct
  source 1..25: note = Seed: QTVHSIPLTINKEEALQRPVASDFE
QTVHSIPLTINKEYALWRVVASDFE

SEQ ID NO: 49173 - protein, 25 aa, synthetic construct
  source 1..25: note = Seed: QTVHSIPLTINKEEALQRPVASDFE
QTVHSIPLTINKEYALYRAVAADFE

SEQ ID NO: 49174 - protein, 25 aa, synthetic construct
  source 1..25: note = Seed: QTVHSIPLTINKEEALQRPVASDFE
QTVHSIPLTINKEYALYRAVANDFE

SEQ ID NO: 49175 - protein, 25 aa, synthetic construct
  source 1..25: note = Seed: QTVHSIPLTINKEEALQRPVASDFE
QTVHSIPLTINKEYALYRAVASDFE

SEQ ID NO: 49176 - protein, 25 aa, synthetic construct
  source 1..25: note = Seed: QTVHSIPLTINKEEALQRPVASDFE
QTVHSIPLTINKEYALYRPVAADFE

SEQ ID NO: 49177 - protein, 25 aa, synthetic construct
  source 1..25: note = Seed: QTVHSIPLTINKEEALQRPVASDFE
QTVHSIPLTFNKAEFLQIPVASDFE

SEQ ID NO: 49178 - protein, 25 aa, synthetic construct
  source 1..25: note = Seed: QTVHSIPLTINKEEALQRPVASDFE
QTVHSIPLTFNKAEFLQVPVASDFE

SEQ ID NO: 49179 - protein, 25 aa, synthetic construct
  source 1..25: note = Seed: QTVHSIPLTINKEEALQRPVASDFE
QTVHSIPLTFNKEEFLQIPVASDFE

SEQ ID NO: 49180 - protein, 25 aa, synthetic construct
  source 1..25: note = Seed: QTVHSIPLTINKEEALQRPVASDFE
QTVHSIPLTFNKEEFLQLPVASDFE

SEQ ID NO: 49181 - protein, 25 aa, synthetic construct
  source 1..25: note = Seed: QTVHSIPLTINKEEALQRPVASDFE
QTVHSIPLTFNKEEFLQVPVASDFE

SEQ ID NO: 49182 - protein, 25 aa, synthetic construct
  source 1..25: note = Seed: QTVHSIPLTINKEEALQRPVASDFE
QTVHSIPLTFNKSEFLQIPVASDFE

SEQ ID NO: 49183 - protein, 25 aa, synthetic construct
  source 1..25: note = Seed: QTVHSIPLTINKEEALQRPVASDFE
QTVHSIPLTFNKSEFLQLPVASDFE

SEQ ID NO: 49184 - protein, 25 aa, synthetic construct
  source 1..25: note = Seed: QTVHSIPLTINKEEALQRPVASDFE
QTVHSIPLTFNKSEFLQVPVASDFE

SEQ ID NO: 49185 - protein, 25 aa, synthetic construct
  source 1..25: note = Seed: QTVHSIPLTINKEEALQRPVASDFE
QTVHSIPLTFNKTEFLQFPVASDFE

SEQ ID NO: 49186 - protein, 25 aa, synthetic construct
  source 1..25: note = Seed: QTVHSIPLTINKEEALQRPVASDFE
QTVHSIPLTFNKTEFLQIPVASDFE

SEQ ID NO: 49187 - protein, 25 aa, synthetic construct
  source 1..25: note = Seed: QTVHSIPLTINKEEALQRPVASDFE
QTVHSIPLTFNKTEFLQLPVASDFE

SEQ ID NO: 49188 - protein, 25 aa, synthetic construct
  source 1..25: note = Seed: QTVHSIPLTINKEEALQRPVASDFE
QTVHSIPLTFNKTEFLQMPVASDFE

SEQ ID NO: 49189 - protein, 25 aa, synthetic construct
  source 1..25: note = Seed: QTVHSIPLTINKEEALQRPVASDFE
QTVHSIPLTFNKTEFLQVPVASDFE

SEQ ID NO: 49190 - protein, 25 aa, synthetic construct
  source 1..25: note = Seed: QTVHSIPLTINKEEALQRPVASDFE
QTVHSIPLTINKAEALQRPVASDFE

SEQ ID NO: 49191 - protein, 25 aa, synthetic construct
  source 1..25: note = Seed: QTVHSIPLTINKEEALQRPVASDFE
QTVHSIPLTINKAERLQFPVASDFE

SEQ ID NO: 49192 - protein, 25 aa, synthetic construct
  source 1..25: note = Seed: QTVHSIPLTINKEEALQRPVASDFE
QTVHSIPLTINKAERLQIPVASDFE

SEQ ID NO: 49193 - protein, 25 aa, synthetic construct
  source 1..25: note = Seed: QTVHSIPLTINKEEALQRPVASDFE
QTVHSIPLTINKAERLQLPVASDFE

SEQ ID NO: 49194 - protein, 25 aa, synthetic construct
  source 1..25: note = Seed: QTVHSIPLTINKEEALQRPVASDFE
QTVHSIPLTINKAERLQMPVASDFE

SEQ ID NO: 49195 - protein, 25 aa, synthetic construct
  source 1..25: note = Seed: QTVHSIPLTINKEEALQRPVASDFE
QTVHSIPLTINKAERLQRPVASDFE

SEQ ID NO: 49196 - protein, 25 aa, synthetic construct
  source 1..25: note = Seed: QTVHSIPLTINKEEALQRPVASDFE
QTVHSIPLTINKAERLQVPVASDFE

SEQ ID NO: 49197 - protein, 25 aa, synthetic construct
  source 1..25: note = Seed: QTVHSIPLTINKEEALQRPVASDFE
QTVHSIPLTINKAERLQYPVASDFE

SEQ ID NO: 49198 - protein, 25 aa, synthetic construct
  source 1..25: note = Seed: QTVHSIPLTINKEEALQRPVASDFE
QTVHSIPLTINKDEALQFPVASDFE

SEQ ID NO: 49199 - protein, 25 aa, synthetic construct
  source 1..25: note = Seed: QTVHSIPLTINKEEALQRPVASDFE
QTVHSIPLTINKDEALQMPVASDFE

SEQ ID NO: 49200 - protein, 25 aa, synthetic construct
  source 1..25: note = Seed: QTVHSIPLTINKEEALQRPVASDFE
QTVHSIPLTINKDEALQRPVASDFE

SEQ ID NO: 49201 - protein, 25 aa, synthetic construct
  source 1..25: note = Seed: QTVHSIPLTINKEEALQRPVASDFE
QTVHSIPLTINKDEALQYPVASDFE

SEQ ID NO: 49202 - protein, 25 aa, synthetic construct
  source 1..25: note = Seed: QTVHSIPLTINKEEALQRPVASDFE
QTVHSIPLTINKDEHLQYPVASDFE

SEQ ID NO: 49203 - protein, 25 aa, synthetic construct
  source 1..25: note = Seed: QTVHSIPLTINKEEALQRPVASDFE
QTVHSIPLTINKDEILQRPVASDFE

SEQ ID NO: 49204 - protein, 25 aa, synthetic construct
  source 1..25: note = Seed: QTVHSIPLTINKEEALQRPVASDFE
QTVHSIPLTINKDEILQYPVASDFE

SEQ ID NO: 49205 - protein, 25 aa, synthetic construct
  source 1..25: note = Seed: QTVHSIPLTINKEEALQRPVASDFE
QTVHSIPLTINKDEKLQAPVASDFE

SEQ ID NO: 49206 - protein, 25 aa, synthetic construct
  source 1..25: note = Seed: QTVHSIPLTINKEEALQRPVASDFE
QTVHSIPLTINKDEKLQFPVASDFE

SEQ ID NO: 49207 - protein, 25 aa, synthetic construct
  source 1..25: note = Seed: QTVHSIPLTINKEEALQRPVASDFE
QTVHSIPLTINKDEKLQIPVASDFE

SEQ ID NO: 49208 - protein, 25 aa, synthetic construct
  source 1..25: note = Seed: QTVHSIPLTINKEEALQRPVASDFE
QTVHSIPLTINKDEKLQLPVASDFE

SEQ ID NO: 49209 - protein, 25 aa, synthetic construct
  source 1..25: note = Seed: QTVHSIPLTINKEEALQRPVASDFE
QTVHSIPLTINKDEKLQMPVASDFE

SEQ ID NO: 49210 - protein, 25 aa, synthetic construct
  source 1..25: note = Seed: QTVHSIPLTINKEEALQRPVASDFE
QTVHSIPLTINKDEKLQRPVASDFE

SEQ ID NO: 49211 - protein, 25 aa, synthetic construct
  source 1..25: note = Seed: QTVHSIPLTINKEEALQRPVASDFE
QTVHSIPLTINKDEKLQSPVASDFE

SEQ ID NO: 49212 - protein, 25 aa, synthetic construct
  source 1..25: note = Seed: QTVHSIPLTINKEEALQRPVASDFE
QTVHSIPLTINKDEKLQVPVASDFE

SEQ ID NO: 49213 - protein, 25 aa, synthetic construct
  source 1..25: note = Seed: QTVHSIPLTINKEEALQRPVASDFE
QTVHSIPLTINKDEKLQYPVASDFE

SEQ ID NO: 49214 - protein, 25 aa, synthetic construct
  source 1..25: note = Seed: QTVHSIPLTINKEEALQRPVASDFE
QTVHSIPLTINKDENLQFPVASDFE

SEQ ID NO: 49215 - protein, 25 aa, synthetic construct
  source 1..25: note = Seed: QTVHSIPLTINKEEALQRPVASDFE
QTVHSIPLTINKDENLQRPVASDFE

SEQ ID NO: 49216 - protein, 25 aa, synthetic construct
  source 1..25: note = Seed: QTVHSIPLTINKEEALQRPVASDFE
QTVHSIPLTINKDENLQYPVASDFE

SEQ ID NO: 49217 - protein, 25 aa, synthetic construct
  source 1..25: note = Seed: QTVHSIPLTINKEEALQRPVASDFE
QTVHSIPLTINKDEPLQRPVASDFE

SEQ ID NO: 49218 - protein, 25 aa, synthetic construct
  source 1..25: note = Seed: QTVHSIPLTINKEEALQRPVASDFE
QTVHSIPLTINKDEPLQYPVASDFE

SEQ ID NO: 49219 - protein, 25 aa, synthetic construct
  source 1..25: note = Seed: QTVHSIPLTINKEEALQRPVASDFE
QTVHSIPLTINKDERLQAPVASDFE

SEQ ID NO: 49220 - protein, 25 aa, synthetic construct
  source 1..25: note = Seed: QTVHSIPLTINKEEALQRPVASDFE
QTVHSIPLTINKDERLQFPVASDFE

SEQ ID NO: 49221 - protein, 25 aa, synthetic construct
  source 1..25: note = Seed: QTVHSIPLTINKEEALQRPVASDFE
QTVHSIPLTINKDERLQIPVASDFE

SEQ ID NO: 49222 - protein, 25 aa, synthetic construct
  source 1..25: note = Seed: QTVHSIPLTINKEEALQRPVASDFE
QTVHSIPLTINKDERLQLPVASDFE

SEQ ID NO: 49223 - protein, 25 aa, synthetic construct
  source 1..25: note = Seed: QTVHSIPLTINKEEALQRPVASDFE
QTVHSIPLTINKDERLQMPVASDFE

SEQ ID NO: 49224 - protein, 25 aa, synthetic construct
  source 1..25: note = Seed: QTVHSIPLTINKEEALQRPVASDFE
QTVHSIPLTINKDERLQRPVASDFE

SEQ ID NO: 49225 - protein, 25 aa, synthetic construct
  source 1..25: note = Seed: QTVHSIPLTINKEEALQRPVASDFE
QTVHSIPLTINKDERLQSPVASDFE

SEQ ID NO: 49226 - protein, 25 aa, synthetic construct
  source 1..25: note = Seed: QTVHSIPLTINKEEALQRPVASDFE
QTVHSIPLTINKDERLQVPVASDFE

SEQ ID NO: 49227 - protein, 25 aa, synthetic construct
  source 1..25: note = Seed: QTVHSIPLTINKEEALQRPVASDFE
QTVHSIPLTINKDERLQYPVASDFE

SEQ ID NO: 49228 - protein, 25 aa, synthetic construct
  source 1..25: note = Seed: QTVHSIPLTINKEEALQRPVASDFE
QTVHSIPLTINKDESLQFPVASDFE

SEQ ID NO: 49229 - protein, 25 aa, synthetic construct
  source 1..25: note = Seed: QTVHSIPLTINKEEALQRPVASDFE
QTVHSIPLTINKDESLQRPVASDFE

SEQ ID NO: 49230 - protein, 25 aa, synthetic construct
  source 1..25: note = Seed: QTVHSIPLTINKEEALQRPVASDFE
QTVHSIPLTINKDESLQYPVASDFE

SEQ ID NO: 49231 - protein, 25 aa, synthetic construct
  source 1..25: note = Seed: QTVHSIPLTINKEEALQRPVASDFE
QTVHSIPLTINKDETLQFPVASDFE

SEQ ID NO: 49232 - protein, 25 aa, synthetic construct
  source 1..25: note = Seed: QTVHSIPLTINKEEALQRPVASDFE
QTVHSIPLTINKDETLQRPVASDFE

SEQ ID NO: 49233 - protein, 25 aa, synthetic construct
  source 1..25: note = Seed: QTVHSIPLTINKEEALQRPVASDFE
QTVHSIPLTINKDETLQYPVASDFE

SEQ ID NO: 49234 - protein, 25 aa, synthetic construct
  source 1..25: note = Seed: QTVHSIPLTINKEEALQRPVASDFE
QTVHSIPLTINKDEVLQRPVASDFE

SEQ ID NO: 49235 - protein, 25 aa, synthetic construct
  source 1..25: note = Seed: QTVHSIPLTINKEEALQRPVASDFE
QTVHSIPLTINKDEVLQYPVASDFE

SEQ ID NO: 49236 - protein, 25 aa, synthetic construct
  source 1..25: note = Seed: QTVHSIPLTINKEEALQRPVASDFE
QTVHSIPLTINKFEALQRPVASDFE

SEQ ID NO: 49237 - protein, 25 aa, synthetic construct
  source 1..25: note = Seed: QTVHSIPLTINKEEALQRPVASDFE
QTVHSIPLTINKFERLQRPVASDFE

SEQ ID NO: 49238 - protein, 25 aa, synthetic construct
  source 1..25: note = Seed: QTVHSIPLTINKEEALQRPVASDFE
QTVHSIPLTINKGEALQRPVASDFE

SEQ ID NO: 49239 - protein, 25 aa, synthetic construct
  source 1..25: note = Seed: QTVHSIPLTINKEEALQRPVASDFE
QTVHSIPLTINKHEALQRPVASDFE

SEQ ID NO: 49240 - protein, 25 aa, synthetic construct
  source 1..25: note = Seed: QTVHSIPLTINKEEALQRPVASDFE
QTVHSIPLTINKHERLQRPVASDFE

SEQ ID NO: 49241 - protein, 25 aa, synthetic construct
  source 1..25: note = Seed: QTVHSIPLTINKEEALQRPVASDFE
QTVHSIPLTINKIEALQRPVASDFE

SEQ ID NO: 49242 - protein, 25 aa, synthetic construct
  source 1..25: note = Seed: QTVHSIPLTINKEEALQRPVASDFE
QTVHSIPLTINKIEKLQRPVASDFE

SEQ ID NO: 49243 - protein, 25 aa, synthetic construct
  source 1..25: note = Seed: QTVHSIPLTINKEEALQRPVASDFE
QTVHSIPLTINKIERLQKPVASDFE

SEQ ID NO: 49244 - protein, 25 aa, synthetic construct
  source 1..25: note = Seed: QTVHSIPLTINKEEALQRPVASDFE
QTVHSIPLTINKIERLQRPVASDFE

SEQ ID NO: 49245 - protein, 25 aa, synthetic construct
  source 1..25: note = Seed: QTVHSIPLTINKEEALQRPVASDFE
QTVHSIPLTINKIERLQYPVASDFE

SEQ ID NO: 49246 - protein, 25 aa, synthetic construct
  source 1..25: note = Seed: QTVHSIPLTINKEEALQRPVASDFE
QTVHSIPLTINKLERLQRPVASDFE

SEQ ID NO: 49247 - protein, 25 aa, synthetic construct
  source 1..25: note = Seed: QTVHSIPLTINKEEALQRPVASDFE
QTVHSIPLTINKMERLQRPVASDFE

SEQ ID NO: 49248 - protein, 25 aa, synthetic construct
  source 1..25: note = Seed: QTVHSIPLTINKEEALQRPVASDFE
QTVHSIPLTINKNEALQRPVASDFE

SEQ ID NO: 49249 - protein, 25 aa, synthetic construct
  source 1..25: note = Seed: QTVHSIPLTINKEEALQRPVASDFE
QTVHSIPLTINKPEALQRPVASDFE

SEQ ID NO: 49250 - protein, 25 aa, synthetic construct
  source 1..25: note = Seed: QTVHSIPLTINKEEALQRPVASDFE
QTVHSIPLTINKSEALQRPVASDFE

SEQ ID NO: 49251 - protein, 25 aa, synthetic construct
  source 1..25: note = Seed: QTVHSIPLTINKEEALQRPVASDFE
QTVHSIPLTINKSERLQRPVASDFE

SEQ ID NO: 49252 - protein, 25 aa, synthetic construct
  source 1..25: note = Seed: QTVHSIPLTINKEEALQRPVASDFE
QTVHSIPLTINKSERLQYPVASDFE

SEQ ID NO: 49253 - protein, 25 aa, synthetic construct
  source 1..25: note = Seed: QTVHSIPLTINKEEALQRPVASDFE
QTVHSIPLTINKTEALQRPVASDFE

SEQ ID NO: 49254 - protein, 25 aa, synthetic construct
  source 1..25: note = Seed: QTVHSIPLTINKEEALQRPVASDFE
QTVHSIPLTINKVEALQRPVASDFE

SEQ ID NO: 49255 - protein, 25 aa, synthetic construct
  source 1..25: note = Seed: QTVHSIPLTINKEEALQRPVASDFE
QTVHSIPLTINKVERLQRPVASDFE

SEQ ID NO: 49256 - protein, 25 aa, synthetic construct
  source 1..25: note = Seed: QTVHSIPLTINKEEALQRPVASDFE
QTVHSIPLTLNKAERLQRPVASDFE

SEQ ID NO: 49257 - protein, 25 aa, synthetic construct
  source 1..25: note = Seed: QTVHSIPLTINKEEALQRPVASDFE
QTVHSIPLTLNKAERLQYPVASDFE

SEQ ID NO: 49258 - protein, 25 aa, synthetic construct
  source 1..25: note = Seed: QTVHSIPLTINKEEALQRPVASDFE
QTVHSIPLTLNKDEALQFPVASDFE

SEQ ID NO: 49259 - protein, 25 aa, synthetic construct
  source 1..25: note = Seed: QTVHSIPLTINKEEALQRPVASDFE
QTVHSIPLTLNKDEALQRPVASDFE

SEQ ID NO: 49260 - protein, 25 aa, synthetic construct
  source 1..25: note = Seed: QTVHSIPLTINKEEALQRPVASDFE
QTVHSIPLTLNKDEALQYPVASDFE

SEQ ID NO: 49261 - protein, 25 aa, synthetic construct
  source 1..25: note = Seed: QTVHSIPLTINKEEALQRPVASDFE
QTVHSIPLTLNKDEILQRPVASDFE

SEQ ID NO: 49262 - protein, 25 aa, synthetic construct
  source 1..25: note = Seed: QTVHSIPLTINKEEALQRPVASDFE
QTVHSIPLTLNKDEKLQFPVASDFE

SEQ ID NO: 49263 - protein, 25 aa, synthetic construct
  source 1..25: note = Seed: QTVHSIPLTINKEEALQRPVASDFE
QTVHSIPLTLNKDEKLQLPVASDFE

SEQ ID NO: 49264 - protein, 25 aa, synthetic construct
  source 1..25: note = Seed: QTVHSIPLTINKEEALQRPVASDFE
QTVHSIPLTLNKDEKLQMPVASDFE

SEQ ID NO: 49265 - protein, 25 aa, synthetic construct
  source 1..25: note = Seed: QTVHSIPLTINKEEALQRPVASDFE
QTVHSIPLTLNKDEKLQRPVASDFE

SEQ ID NO: 49266 - protein, 25 aa, synthetic construct
  source 1..25: note = Seed: QTVHSIPLTINKEEALQRPVASDFE
QTVHSIPLTLNKDEKLQVPVASDFE

SEQ ID NO: 49267 - protein, 25 aa, synthetic construct
  source 1..25: note = Seed: QTVHSIPLTINKEEALQRPVASDFE
QTVHSIPLTLNKDEKLQYPVASDFE

SEQ ID NO: 49268 - protein, 25 aa, synthetic construct
  source 1..25: note = Seed: QTVHSIPLTINKEEALQRPVASDFE
QTVHSIPLTLNKDEPLQRPVASDFE

SEQ ID NO: 49269 - protein, 25 aa, synthetic construct
  source 1..25: note = Seed: QTVHSIPLTINKEEALQRPVASDFE
QTVHSIPLTLNKDEPLQYPVASDFE

SEQ ID NO: 49270 - protein, 25 aa, synthetic construct
  source 1..25: note = Seed: QTVHSIPLTINKEEALQRPVASDFE
QTVHSIPLTLNKDERLQFPVASDFE

SEQ ID NO: 49271 - protein, 25 aa, synthetic construct
  source 1..25: note = Seed: QTVHSIPLTINKEEALQRPVASDFE
QTVHSIPLTLNKDERLQLPVASDFE

SEQ ID NO: 49272 - protein, 25 aa, synthetic construct
  source 1..25: note = Seed: QTVHSIPLTINKEEALQRPVASDFE
QTVHSIPLTLNKDERLQMPVASDFE

SEQ ID NO: 49273 - protein, 25 aa, synthetic construct
  source 1..25: note = Seed: QTVHSIPLTINKEEALQRPVASDFE
QTVHSIPLTLNKDERLQRPVASDFE

SEQ ID NO: 49274 - protein, 25 aa, synthetic construct
  source 1..25: note = Seed: QTVHSIPLTINKEEALQRPVASDFE
QTVHSIPLTLNKDERLQYPVASDFE

SEQ ID NO: 49275 - protein, 25 aa, synthetic construct
  source 1..25: note = Seed: QTVHSIPLTINKEEALQRPVASDFE
QTVHSIPLTLNKDESLQRPVASDFE

SEQ ID NO: 49276 - protein, 25 aa, synthetic construct
  source 1..25: note = Seed: QTVHSIPLTINKEEALQRPVASDFE
QTVHSIPLTLNKDESLQYPVASDFE

SEQ ID NO: 49277 - protein, 25 aa, synthetic construct
  source 1..25: note = Seed: QTVHSIPLTINKEEALQRPVASDFE
QTVHSIPLTLNKDETLQRPVASDFE

SEQ ID NO: 49278 - protein, 25 aa, synthetic construct
  source 1..25: note = Seed: QTVHSIPLTINKEEALQRPVASDFE
QTVHSIPLTLNKDETLQYPVASDFE

SEQ ID NO: 49279 - protein, 25 aa, synthetic construct
  source 1..25: note = Seed: QTVHSIPLTINKEEALQRPVASDFE
QTVHSIPLTLNKDEVLQRPVASDFE

SEQ ID NO: 49280 - protein, 25 aa, synthetic construct
  source 1..25: note = Seed: QTVHSIPLTINKEEALQRPVASDFE
QTVHSIPLTLNKDEVLQYPVASDFE

SEQ ID NO: 49281 - protein, 25 aa, synthetic construct
  source 1..25: note = Seed: QTVHSIPLTINKEEALQRPVASDFE
QTVHSIPLTLNKIERLQRPVASDFE

SEQ ID NO: 49282 - protein, 25 aa, synthetic construct
  source 1..25: note = Seed: QTVHSIPLTINKEEALQRPVASDFE
QTVHSIPLTLNKVERLQRPVASDFE

SEQ ID NO: 49283 - protein, 25 aa, synthetic construct
  source 1..25: note = Seed: QTVHSIPLTINKEEALQRPVASDFE
QTVHSIPLTMNKDEKLQFPVASDFE

SEQ ID NO: 49284 - protein, 25 aa, synthetic construct
  source 1..25: note = Seed: QTVHSIPLTINKEEALQRPVASDFE
QTVHSIPLTMNKDEKLQYPVASDFE

SEQ ID NO: 49285 - protein, 25 aa, synthetic construct
  source 1..25: note = Seed: QTVHSIPLTINKEEALQRPVASDFE
QTVHSIPLTMNKDERLQFPVASDFE

SEQ ID NO: 49286 - protein, 25 aa, synthetic construct
  source 1..25: note = Seed: QTVHSIPLTINKEEALQRPVASDFE
QTVHSIPLTMNKDERLQYPVASDFE

SEQ ID NO: 49287 - protein, 25 aa, synthetic construct
  source 1..25: note = Seed: QTVHSIPLTINKEEALQRPVASDFE
QTVHSIPLTMNKDEVLQRPVASDFE

SEQ ID NO: 49288 - protein, 25 aa, synthetic construct
  source 1..25: note = Seed: QTVHSIPLTINKEEALQRPVASDFE
QTVHSIPLTMNKIERLQRPVASDFE

SEQ ID NO: 49289 - protein, 25 aa, synthetic construct
  source 1..25: note = Seed: QTVHSIPLTINKEEALQRPVASDFE
QTVHSIPLTVNKDEALQRPVASDFE

SEQ ID NO: 49290 - protein, 25 aa, synthetic construct
  source 1..25: note = Seed: QTVHSIPLTINKEEALQRPVASDFE
QTVHSIPLTVNKDEKLQFPVASDFE

SEQ ID NO: 49291 - protein, 25 aa, synthetic construct
  source 1..25: note = Seed: QTVHSIPLTINKEEALQRPVASDFE
QTVHSIPLTVNKDEKLQMPVASDFE

SEQ ID NO: 49292 - protein, 25 aa, synthetic construct
  source 1..25: note = Seed: QTVHSIPLTINKEEALQRPVASDFE
QTVHSIPLTVNKDEKLQYPVASDFE

SEQ ID NO: 49293 - protein, 25 aa, synthetic construct
  source 1..25: note = Seed: QTVHSIPLTINKEEALQRPVASDFE
QTVHSIPLTVNKDERLQFPVASDFE

SEQ ID NO: 49294 - protein, 25 aa, synthetic construct
  source 1..25: note = Seed: QTVHSIPLTINKEEALQRPVASDFE
QTVHSIPLTVNKDERLQMPVASDFE

SEQ ID NO: 49295 - protein, 25 aa, synthetic construct
  source 1..25: note = Seed: QTVHSIPLTINKEEALQRPVASDFE
QTVHSIPLTVNKDERLQYPVASDFE

SEQ ID NO: 49296 - protein, 25 aa, synthetic construct
  source 1..25: note = Seed: QTVHSIPLTINKEEALQRPVASDFE
QTVHSIPLTVNKDEVLQRPVASDFE

SEQ ID NO: 49297 - protein, 25 aa, synthetic construct
  source 1..25: note = Seed: QTVHSIPLTINKEEALQRPVASDFE
QTVHSIPLTYNKTEFLQIPVASDFE

SEQ ID NO: 49298 - protein, 25 aa, synthetic construct
  source 1..25: note = Seed: QTVHSIPLTINKEEALQRPVASDFE
QTVHSIPATIFKFEAIQRPVASDFE

SEQ ID NO: 49299 - protein, 25 aa, synthetic construct
  source 1..25: note = Seed: QTVHSIPLTINKEEALQRPVASDFE
QTVHSIPATIFKFEALQRPVASDFE

SEQ ID NO: 49300 - protein, 25 aa, synthetic construct
  source 1..25: note = Seed: QTVHSIPLTINKEEALQRPVASDFE
QTVHSIPATIIKFEALQRPVASDFE

SEQ ID NO: 49301 - protein, 25 aa, synthetic construct
  source 1..25: note = Seed: QTVHSIPLTINKEEALQRPVASDFE
QTVHSIPATILKFEALQRPVASDFE

SEQ ID NO: 49302 - protein, 25 aa, synthetic construct
  source 1..25: note = Seed: QTVHSIPLTINKEEALQRPVASDFE
QTVHSIPCTIFKFEAIQRPVASDFE

SEQ ID NO: 49303 - protein, 25 aa, synthetic construct
  source 1..25: note = Seed: QTVHSIPLTINKEEALQRPVASDFE
QTVHSIPCTIFKFEALQRPVASDFE

SEQ ID NO: 49304 - protein, 25 aa, synthetic construct
  source 1..25: note = Seed: QTVHSIPLTINKEEALQRPVASDFE
QTVHSIPCTIFKFEAMQRPVASDFE

SEQ ID NO: 49305 - protein, 25 aa, synthetic construct
  source 1..25: note = Seed: QTVHSIPLTINKEEALQRPVASDFE
QTVHSIPCTIFKFEAVQRPVASDFE

SEQ ID NO: 49306 - protein, 25 aa, synthetic construct
  source 1..25: note = Seed: QTVHSIPLTINKEEALQRPVASDFE
QTVHSIPCTIFKLEALQRPVASDFE

SEQ ID NO: 49307 - protein, 25 aa, synthetic construct
  source 1..25: note = Seed: QTVHSIPLTINKEEALQRPVASDFE
QTVHSIPCTIIKFEAIQRPVASDFE

SEQ ID NO: 49308 - protein, 25 aa, synthetic construct
  source 1..25: note = Seed: QTVHSIPLTINKEEALQRPVASDFE
QTVHSIPCTIIKFEALQRPVASDFE

SEQ ID NO: 49309 - protein, 25 aa, synthetic construct
  source 1..25: note = Seed: QTVHSIPLTINKEEALQRPVASDFE
QTVHSIPCTIIKFEAVQRPVASDFE

SEQ ID NO: 49310 - protein, 25 aa, synthetic construct
  source 1..25: note = Seed: QTVHSIPLTINKEEALQRPVASDFE
QTVHSIPCTILKFEAIQRPVASDFE

SEQ ID NO: 49311 - protein, 25 aa, synthetic construct
  source 1..25: note = Seed: QTVHSIPLTINKEEALQRPVASDFE
QTVHSIPCTILKFEALQRPVASDFE

SEQ ID NO: 49312 - protein, 25 aa, synthetic construct
  source 1..25: note = Seed: QTVHSIPLTINKEEALQRPVASDFE
QTVHSIPCTILKFEAVQRPVASDFE

SEQ ID NO: 49313 - protein, 25 aa, synthetic construct
  source 1..25: note = Seed: QTVHSIPLTINKEEALQRPVASDFE
QTVHSIPCTIMKFEALQRPVASDFE

SEQ ID NO: 49314 - protein, 25 aa, synthetic construct
  source 1..25: note = Seed: QTVHSIPLTINKEEALQRPVASDFE
QTVHSIPCTITKFEAIQRPVASDFE

SEQ ID NO: 49315 - protein, 25 aa, synthetic construct
  source 1..25: note = Seed: QTVHSIPLTINKEEALQRPVASDFE
QTVHSIPCTITKFEALQRPVASDFE

SEQ ID NO: 49316 - protein, 25 aa, synthetic construct
  source 1..25: note = Seed: QTVHSIPLTINKEEALQRPVASDFE
QTVHSIPCTIVKFEAIQRPVASDFE

SEQ ID NO: 49317 - protein, 25 aa, synthetic construct
  source 1..25: note = Seed: QTVHSIPLTINKEEALQRPVASDFE
QTVHSIPCTIVKFEALQRPVASDFE

SEQ ID NO: 49318 - protein, 25 aa, synthetic construct
  source 1..25: note = Seed: QTVHSIPLTINKEEALQRPVASDFE
QTVHSIPCTIVKFEAVQRPVASDFE

SEQ ID NO: 49319 - protein, 25 aa, synthetic construct
  source 1..25: note = Seed: QTVHSIPLTINKEEALQRPVASDFE
QTVHSIPFTIAKFEAAQRPVASDFE

SEQ ID NO: 49320 - protein, 25 aa, synthetic construct
  source 1..25: note = Seed: QTVHSIPLTINKEEALQRPVASDFE
QTVHSIPFTIAKFEACQRPVASDFE

SEQ ID NO: 49321 - protein, 25 aa, synthetic construct
  source 1..25: note = Seed: QTVHSIPLTINKEEALQRPVASDFE
QTVHSIPFTIAKFEADQRPVASDFE

SEQ ID NO: 49322 - protein, 25 aa, synthetic construct
  source 1..25: note = Seed: QTVHSIPLTINKEEALQRPVASDFE
QTVHSIPFTIAKFEAEQRPVASDFE

SEQ ID NO: 49323 - protein, 25 aa, synthetic construct
  source 1..25: note = Seed: QTVHSIPLTINKEEALQRPVASDFE
QTVHSIPFTIAKFEAFQRPVASDFE

SEQ ID NO: 49324 - protein, 25 aa, synthetic construct
  source 1..25: note = Seed: QTVHSIPLTINKEEALQRPVASDFE
QTVHSIPFTIAKFEAHQRPVASDFE

SEQ ID NO: 49325 - protein, 25 aa, synthetic construct
  source 1..25: note = Seed: QTVHSIPLTINKEEALQRPVASDFE
QTVHSIPFTIAKFEAIQRPVASDFE

SEQ ID NO: 49326 - protein, 25 aa, synthetic construct
  source 1..25: note = Seed: QTVHSIPLTINKEEALQRPVASDFE
QTVHSIPFTIAKFEALQRPVASDFE

SEQ ID NO: 49327 - protein, 25 aa, synthetic construct
  source 1..25: note = Seed: QTVHSIPLTINKEEALQRPVASDFE
QTVHSIPFTIAKFEAMQRPVASDFE

SEQ ID NO: 49328 - protein, 25 aa, synthetic construct
  source 1..25: note = Seed: QTVHSIPLTINKEEALQRPVASDFE
QTVHSIPFTIAKFEANQRPVASDFE

SEQ ID NO: 49329 - protein, 25 aa, synthetic construct
  source 1..25: note = Seed: QTVHSIPLTINKEEALQRPVASDFE
QTVHSIPFTIAKFEAPQRPVASDFE

SEQ ID NO: 49330 - protein, 25 aa, synthetic construct
  source 1..25: note = Seed: QTVHSIPLTINKEEALQRPVASDFE
QTVHSIPFTIAKFEARQRPVASDFE

SEQ ID NO: 49331 - protein, 25 aa, synthetic construct
  source 1..25: note = Seed: QTVHSIPLTINKEEALQRPVASDFE
QTVHSIPFTIAKFEASQRPVASDFE

SEQ ID NO: 49332 - protein, 25 aa, synthetic construct
  source 1..25: note = Seed: QTVHSIPLTINKEEALQRPVASDFE
QTVHSIPFTIAKFEATQRPVASDFE

SEQ ID NO: 49333 - protein, 25 aa, synthetic construct
  source 1..25: note = Seed: QTVHSIPLTINKEEALQRPVASDFE
QTVHSIPFTIAKFEAVQRPVASDFE

SEQ ID NO: 49334 - protein, 25 aa, synthetic construct
  source 1..25: note = Seed: QTVHSIPLTINKEEALQRPVASDFE
QTVHSIPFTIAKFEAWQRPVASDFE

SEQ ID NO: 49335 - protein, 25 aa, synthetic construct
  source 1..25: note = Seed: QTVHSIPLTINKEEALQRPVASDFE
QTVHSIPFTIAKFEAYQRPVASDFE

SEQ ID NO: 49336 - protein, 25 aa, synthetic construct
  source 1..25: note = Seed: QTVHSIPLTINKEEALQRPVASDFE
QTVHSIPFTIAKIEAFQRPVASDFE

SEQ ID NO: 49337 - protein, 25 aa, synthetic construct
  source 1..25: note = Seed: QTVHSIPLTINKEEALQRPVASDFE
QTVHSIPFTIAKIEAIQRPVASDFE

SEQ ID NO: 49338 - protein, 25 aa, synthetic construct
  source 1..25: note = Seed: QTVHSIPLTINKEEALQRPVASDFE
QTVHSIPFTIAKIEALQRPVASDFE

SEQ ID NO: 49339 - protein, 25 aa, synthetic construct
  source 1..25: note = Seed: QTVHSIPLTINKEEALQRPVASDFE
QTVHSIPFTIAKIEAVQRPVASDFE

SEQ ID NO: 49340 - protein, 25 aa, synthetic construct
  source 1..25: note = Seed: QTVHSIPLTINKEEALQRPVASDFE
QTVHSIPFTIAKLEAFQRPVASDFE

SEQ ID NO: 49341 - protein, 25 aa, synthetic construct
  source 1..25: note = Seed: QTVHSIPLTINKEEALQRPVASDFE
QTVHSIPFTIAKLEAIQRPVASDFE

SEQ ID NO: 49342 - protein, 25 aa, synthetic construct
  source 1..25: note = Seed: QTVHSIPLTINKEEALQRPVASDFE
QTVHSIPFTIAKLEALQRPVASDFE

SEQ ID NO: 49343 - protein, 25 aa, synthetic construct
  source 1..25: note = Seed: QTVHSIPLTINKEEALQRPVASDFE
QTVHSIPFTIAKLEAMQRPVASDFE

SEQ ID NO: 49344 - protein, 25 aa, synthetic construct
  source 1..25: note = Seed: QTVHSIPLTINKEEALQRPVASDFE
QTVHSIPFTIAKLEAVQRPVASDFE

SEQ ID NO: 49345 - protein, 25 aa, synthetic construct
  source 1..25: note = Seed: QTVHSIPLTINKEEALQRPVASDFE
QTVHSIPFTIAKLEAYQRPVASDFE

SEQ ID NO: 49346 - protein, 25 aa, synthetic construct
  source 1..25: note = Seed: QTVHSIPLTINKEEALQRPVASDFE
QTVHSIPFTIAKMEAFQRPVASDFE

SEQ ID NO: 49347 - protein, 25 aa, synthetic construct
  source 1..25: note = Seed: QTVHSIPLTINKEEALQRPVASDFE
QTVHSIPFTIAKMEAIQRPVASDFE

SEQ ID NO: 49348 - protein, 25 aa, synthetic construct
  source 1..25: note = Seed: QTVHSIPLTINKEEALQRPVASDFE
QTVHSIPFTIAKMEALQRPVASDFE

SEQ ID NO: 49349 - protein, 25 aa, synthetic construct
  source 1..25: note = Seed: QTVHSIPLTINKEEALQRPVASDFE
QTVHSIPFTIAKWEAFQRPVASDFE

SEQ ID NO: 49350 - protein, 25 aa, synthetic construct
  source 1..25: note = Seed: QTVHSIPLTINKEEALQRPVASDFE
QTVHSIPFTIAKWEAIQRPVASDFE

SEQ ID NO: 49351 - protein, 25 aa, synthetic construct
  source 1..25: note = Seed: QTVHSIPLTINKEEALQRPVASDFE
QTVHSIPFTIAKWEALQRPVASDFE

SEQ ID NO: 49352 - protein, 25 aa, synthetic construct
  source 1..25: note = Seed: QTVHSIPLTINKEEALQRPVASDFE
QTVHSIPFTIAKWEAMQRPVASDFE

SEQ ID NO: 49353 - protein, 25 aa, synthetic construct
  source 1..25: note = Seed: QTVHSIPLTINKEEALQRPVASDFE
QTVHSIPFTIAKWEAVQRPVASDFE

SEQ ID NO: 49354 - protein, 25 aa, synthetic construct
  source 1..25: note = Seed: QTVHSIPLTINKEEALQRPVASDFE
QTVHSIPFTIAKYEAFQRPVASDFE

SEQ ID NO: 49355 - protein, 25 aa, synthetic construct
  source 1..25: note = Seed: QTVHSIPLTINKEEALQRPVASDFE
QTVHSIPFTIAKYEAIQRPVASDFE

SEQ ID NO: 49356 - protein, 25 aa, synthetic construct
  source 1..25: note = Seed: QTVHSIPLTINKEEALQRPVASDFE
QTVHSIPFTIAKYEALQRPVASDFE

SEQ ID NO: 49357 - protein, 25 aa, synthetic construct
  source 1..25: note = Seed: QTVHSIPLTINKEEALQRPVASDFE
QTVHSIPFTIAKYEAMQRPVASDFE

SEQ ID NO: 49358 - protein, 25 aa, synthetic construct
  source 1..25: note = Seed: QTVHSIPLTINKEEALQRPVASDFE
QTVHSIPFTIAKYEAVQRPVASDFE

SEQ ID NO: 49359 - protein, 25 aa, synthetic construct
  source 1..25: note = Seed: QTVHSIPLTINKEEALQRPVASDFE
QTVHSIPFTICKFEAFQRPVASDFE

SEQ ID NO: 49360 - protein, 25 aa, synthetic construct
  source 1..25: note = Seed: QTVHSIPLTINKEEALQRPVASDFE
QTVHSIPFTICKFEAIQRPVASDFE

SEQ ID NO: 49361 - protein, 25 aa, synthetic construct
  source 1..25: note = Seed: QTVHSIPLTINKEEALQRPVASDFE
QTVHSIPFTICKFEALQRPVASDFE

SEQ ID NO: 49362 - protein, 25 aa, synthetic construct
  source 1..25: note = Seed: QTVHSIPLTINKEEALQRPVASDFE
QTVHSIPFTICKFEAMQRPVASDFE

SEQ ID NO: 49363 - protein, 25 aa, synthetic construct
  source 1..25: note = Seed: QTVHSIPLTINKEEALQRPVASDFE
QTVHSIPFTICKFEAVQRPVASDFE

SEQ ID NO: 49364 - protein, 25 aa, synthetic construct
  source 1..25: note = Seed: QTVHSIPLTINKEEALQRPVASDFE
QTVHSIPFTIDKFEAFQRPVASDFE

SEQ ID NO: 49365 - protein, 25 aa, synthetic construct
  source 1..25: note = Seed: QTVHSIPLTINKEEALQRPVASDFE
QTVHSIPFTIDKFEAIQRPVASDFE

SEQ ID NO: 49366 - protein, 25 aa, synthetic construct
  source 1..25: note = Seed: QTVHSIPLTINKEEALQRPVASDFE
QTVHSIPFTIDKFEALQRPVASDFE

SEQ ID NO: 49367 - protein, 25 aa, synthetic construct
  source 1..25: note = Seed: QTVHSIPLTINKEEALQRPVASDFE
QTVHSIPFTIDKFEAMQRPVASDFE

SEQ ID NO: 49368 - protein, 25 aa, synthetic construct
  source 1..25: note = Seed: QTVHSIPLTINKEEALQRPVASDFE
QTVHSIPFTIDKFEAVQRPVASDFE

SEQ ID NO: 49369 - protein, 25 aa, synthetic construct
  source 1..25: note = Seed: QTVHSIPLTINKEEALQRPVASDFE
QTVHSIPFTIEKFEAAQRPVASDFE

SEQ ID NO: 49370 - protein, 25 aa, synthetic construct
  source 1..25: note = Seed: QTVHSIPLTINKEEALQRPVASDFE
QTVHSIPFTIEKFEADQRPVASDFE

SEQ ID NO: 49371 - protein, 25 aa, synthetic construct
  source 1..25: note = Seed: QTVHSIPLTINKEEALQRPVASDFE
QTVHSIPFTIEKFEAEQRPVASDFE

SEQ ID NO: 49372 - protein, 25 aa, synthetic construct
  source 1..25: note = Seed: QTVHSIPLTINKEEALQRPVASDFE
QTVHSIPFTIEKFEAFQRPVASDFE

SEQ ID NO: 49373 - protein, 25 aa, synthetic construct
  source 1..25: note = Seed: QTVHSIPLTINKEEALQRPVASDFE
QTVHSIPFTIEKFEAIQRPVASDFE

SEQ ID NO: 49374 - protein, 25 aa, synthetic construct
  source 1..25: note = Seed: QTVHSIPLTINKEEALQRPVASDFE
QTVHSIPFTIEKFEALQRPVASDFE

SEQ ID NO: 49375 - protein, 25 aa, synthetic construct
  source 1..25: note = Seed: QTVHSIPLTINKEEALQRPVASDFE
QTVHSIPFTIEKFEAMQRPVASDFE

SEQ ID NO: 49376 - protein, 25 aa, synthetic construct
  source 1..25: note = Seed: QTVHSIPLTINKEEALQRPVASDFE
QTVHSIPFTIEKFEANQRPVASDFE

SEQ ID NO: 49377 - protein, 25 aa, synthetic construct
  source 1..25: note = Seed: QTVHSIPLTINKEEALQRPVASDFE
QTVHSIPFTIEKFEASQRPVASDFE

SEQ ID NO: 49378 - protein, 25 aa, synthetic construct
  source 1..25: note = Seed: QTVHSIPLTINKEEALQRPVASDFE
QTVHSIPFTIEKFEATQRPVASDFE

SEQ ID NO: 49379 - protein, 25 aa, synthetic construct
  source 1..25: note = Seed: QTVHSIPLTINKEEALQRPVASDFE
QTVHSIPFTIEKFEAVQRPVASDFE

SEQ ID NO: 49380 - protein, 25 aa, synthetic construct
  source 1..25: note = Seed: QTVHSIPLTINKEEALQRPVASDFE
QTVHSIPFTIEKFEAWQRPVASDFE

SEQ ID NO: 49381 - protein, 25 aa, synthetic construct
  source 1..25: note = Seed: QTVHSIPLTINKEEALQRPVASDFE
QTVHSIPFTIEKFEAYQRPVASDFE

SEQ ID NO: 49382 - protein, 25 aa, synthetic construct
  source 1..25: note = Seed: QTVHSIPLTINKEEALQRPVASDFE
QTVHSIPFTIEKIEAFQRPVASDFE

SEQ ID NO: 49383 - protein, 25 aa, synthetic construct
  source 1..25: note = Seed: QTVHSIPLTINKEEALQRPVASDFE
QTVHSIPFTIEKIEAIQRPVASDFE

SEQ ID NO: 49384 - protein, 25 aa, synthetic construct
  source 1..25: note = Seed: QTVHSIPLTINKEEALQRPVASDFE
QTVHSIPFTIEKIEALQRPVASDFE

SEQ ID NO: 49385 - protein, 25 aa, synthetic construct
  source 1..25: note = Seed: QTVHSIPLTINKEEALQRPVASDFE
QTVHSIPFTIEKIEAVQRPVASDFE

SEQ ID NO: 49386 - protein, 25 aa, synthetic construct
  source 1..25: note = Seed: QTVHSIPLTINKEEALQRPVASDFE
QTVHSIPFTIEKLEAFQRPVASDFE

SEQ ID NO: 49387 - protein, 25 aa, synthetic construct
  source 1..25: note = Seed: QTVHSIPLTINKEEALQRPVASDFE
QTVHSIPFTIEKLEAIQRPVASDFE

SEQ ID NO: 49388 - protein, 25 aa, synthetic construct
  source 1..25: note = Seed: QTVHSIPLTINKEEALQRPVASDFE
QTVHSIPFTIEKLEALQRPVASDFE

SEQ ID NO: 49389 - protein, 25 aa, synthetic construct
  source 1..25: note = Seed: QTVHSIPLTINKEEALQRPVASDFE
QTVHSIPFTIEKLEAMQRPVASDFE

SEQ ID NO: 49390 - protein, 25 aa, synthetic construct
  source 1..25: note = Seed: QTVHSIPLTINKEEALQRPVASDFE
QTVHSIPFTIEKLEAVQRPVASDFE

SEQ ID NO: 49391 - protein, 25 aa, synthetic construct
  source 1..25: note = Seed: QTVHSIPLTINKEEALQRPVASDFE
QTVHSIPFTIEKMEALQRPVASDFE

SEQ ID NO: 49392 - protein, 25 aa, synthetic construct
  source 1..25: note = Seed: QTVHSIPLTINKEEALQRPVASDFE
QTVHSIPFTIEKWEAFQRPVASDFE

SEQ ID NO: 49393 - protein, 25 aa, synthetic construct
  source 1..25: note = Seed: QTVHSIPLTINKEEALQRPVASDFE
QTVHSIPFTIEKWEAIQRPVASDFE

SEQ ID NO: 49394 - protein, 25 aa, synthetic construct
  source 1..25: note = Seed: QTVHSIPLTINKEEALQRPVASDFE
QTVHSIPFTIEKWEALQRPVASDFE

SEQ ID NO: 49395 - protein, 25 aa, synthetic construct
  source 1..25: note = Seed: QTVHSIPLTINKEEALQRPVASDFE
QTVHSIPFTIEKWEAVQRPVASDFE

SEQ ID NO: 49396 - protein, 25 aa, synthetic construct
  source 1..25: note = Seed: QTVHSIPLTINKEEALQRPVASDFE
QTVHSIPFTIEKYEAFQRPVASDFE

SEQ ID NO: 49397 - protein, 25 aa, synthetic construct
  source 1..25: note = Seed: QTVHSIPLTINKEEALQRPVASDFE
QTVHSIPFTIEKYEAIQRPVASDFE

SEQ ID NO: 49398 - protein, 25 aa, synthetic construct
  source 1..25: note = Seed: QTVHSIPLTINKEEALQRPVASDFE
QTVHSIPFTIEKYEALQRPVASDFE

SEQ ID NO: 49399 - protein, 25 aa, synthetic construct
  source 1..25: note = Seed: QTVHSIPLTINKEEALQRPVASDFE
QTVHSIPFTIEKYEAVQRPVASDFE

SEQ ID NO: 49400 - protein, 25 aa, synthetic construct
  source 1..25: note = Seed: QTVHSIPLTINKEEALQRPVASDFE
QTVHSIPFTIFKAEAAQRPVASDFE

SEQ ID NO: 49401 - protein, 25 aa, synthetic construct
  source 1..25: note = Seed: QTVHSIPLTINKEEALQRPVASDFE
QTVHSIPFTIFKAEAFQRPVASDFE

SEQ ID NO: 49402 - protein, 25 aa, synthetic construct
  source 1..25: note = Seed: QTVHSIPLTINKEEALQRPVASDFE
QTVHSIPFTIFKAEAIQRPVASDFE

SEQ ID NO: 49403 - protein, 25 aa, synthetic construct
  source 1..25: note = Seed: QTVHSIPLTINKEEALQRPVASDFE
QTVHSIPFTIFKAEALQRPVASDFE

SEQ ID NO: 49404 - protein, 25 aa, synthetic construct
  source 1..25: note = Seed: QTVHSIPLTINKEEALQRPVASDFE
QTVHSIPFTIFKAEAMQRPVASDFE

SEQ ID NO: 49405 - protein, 25 aa, synthetic construct
  source 1..25: note = Seed: QTVHSIPLTINKEEALQRPVASDFE
QTVHSIPFTIFKAEARQRPVASDFE

SEQ ID NO: 49406 - protein, 25 aa, synthetic construct
  source 1..25: note = Seed: QTVHSIPLTINKEEALQRPVASDFE
QTVHSIPFTIFKAEAVQRPVASDFE

SEQ ID NO: 49407 - protein, 25 aa, synthetic construct
  source 1..25: note = Seed: QTVHSIPLTINKEEALQRPVASDFE
QTVHSIPFTIFKAEAWQRPVASDFE

SEQ ID NO: 49408 - protein, 25 aa, synthetic construct
  source 1..25: note = Seed: QTVHSIPLTINKEEALQRPVASDFE
QTVHSIPFTIFKAEAYQRPVASDFE

SEQ ID NO: 49409 - protein, 25 aa, synthetic construct
  source 1..25: note = Seed: QTVHSIPLTINKEEALQRPVASDFE
QTVHSIPFTIFKDEAAQRPVASDFE

SEQ ID NO: 49410 - protein, 25 aa, synthetic construct
  source 1..25: note = Seed: QTVHSIPLTINKEEALQRPVASDFE
QTVHSIPFTIFKDEAFQRPVASDFE

SEQ ID NO: 49411 - protein, 25 aa, synthetic construct
  source 1..25: note = Seed: QTVHSIPLTINKEEALQRPVASDFE
QTVHSIPFTIFKDEAIQRPVASDFE

SEQ ID NO: 49412 - protein, 25 aa, synthetic construct
  source 1..25: note = Seed: QTVHSIPLTINKEEALQRPVASDFE
QTVHSIPFTIFKDEALQRPVASDFE

SEQ ID NO: 49413 - protein, 25 aa, synthetic construct
  source 1..25: note = Seed: QTVHSIPLTINKEEALQRPVASDFE
QTVHSIPFTIFKDEAMQRPVASDFE

SEQ ID NO: 49414 - protein, 25 aa, synthetic construct
  source 1..25: note = Seed: QTVHSIPLTINKEEALQRPVASDFE
QTVHSIPFTIFKDEAVQRPVASDFE

SEQ ID NO: 49415 - protein, 25 aa, synthetic construct
  source 1..25: note = Seed: QTVHSIPLTINKEEALQRPVASDFE
QTVHSIPFTIFKEEAFQRPVASDFE

SEQ ID NO: 49416 - protein, 25 aa, synthetic construct
  source 1..25: note = Seed: QTVHSIPLTINKEEALQRPVASDFE
QTVHSIPFTIFKEEAIQRPVASDFE

SEQ ID NO: 49417 - protein, 25 aa, synthetic construct
  source 1..25: note = Seed: QTVHSIPLTINKEEALQRPVASDFE
QTVHSIPFTIFKEEALQRPVASDFE

SEQ ID NO: 49418 - protein, 25 aa, synthetic construct
  source 1..25: note = Seed: QTVHSIPLTINKEEALQRPVASDFE
QTVHSIPFTIFKFEAAQRPVASDFE

SEQ ID NO: 49419 - protein, 25 aa, synthetic construct
  source 1..25: note = Seed: QTVHSIPLTINKEEALQRPVASDFE
QTVHSIPFTIFKFEACQRPVASDFE

SEQ ID NO: 49420 - protein, 25 aa, synthetic construct
  source 1..25: note = Seed: QTVHSIPLTINKEEALQRPVASDFE
QTVHSIPFTIFKFEADQRPVASDFE

SEQ ID NO: 49421 - protein, 25 aa, synthetic construct
  source 1..25: note = Seed: QTVHSIPLTINKEEALQRPVASDFE
QTVHSIPFTIFKFEAEQRPVASDFE

SEQ ID NO: 49422 - protein, 25 aa, synthetic construct
  source 1..25: note = Seed: QTVHSIPLTINKEEALQRPVASDFE
QTVHSIPFTIFKFEAFQRPVASDFE

SEQ ID NO: 49423 - protein, 25 aa, synthetic construct
  source 1..25: note = Seed: QTVHSIPLTINKEEALQRPVASDFE
QTVHSIPFTIFKFEAGQRPVASDFE

SEQ ID NO: 49424 - protein, 25 aa, synthetic construct
  source 1..25: note = Seed: QTVHSIPLTINKEEALQRPVASDFE
QTVHSIPFTIFKFEAHQRPVASDFE

SEQ ID NO: 49425 - protein, 25 aa, synthetic construct
  source 1..25: note = Seed: QTVHSIPLTINKEEALQRPVASDFE
QTVHSIPFTIFKFEAIQRPVASDFE

SEQ ID NO: 49426 - protein, 25 aa, synthetic construct
  source 1..25: note = Seed: QTVHSIPLTINKEEALQRPVASDFE
QTVHSIPFTIFKFEAKQRPVASDFE

SEQ ID NO: 49427 - protein, 25 aa, synthetic construct
  source 1..25: note = Seed: QTVHSIPLTINKEEALQRPVASDFE
QTVHSIPFTIFKFEALQRPVASDFE

SEQ ID NO: 49428 - protein, 25 aa, synthetic construct
  source 1..25: note = Seed: QTVHSIPLTINKEEALQRPVASDFE
QTVHSIPFTIFKFEAMQRPVASDFE

SEQ ID NO: 49429 - protein, 25 aa, synthetic construct
  source 1..25: note = Seed: QTVHSIPLTINKEEALQRPVASDFE
QTVHSIPFTIFKFEANQRPVASDFE

SEQ ID NO: 49430 - protein, 25 aa, synthetic construct
  source 1..25: note = Seed: QTVHSIPLTINKEEALQRPVASDFE
QTVHSIPFTIFKFEAPQRPVASDFE

SEQ ID NO: 49431 - protein, 25 aa, synthetic construct
  source 1..25: note = Seed: QTVHSIPLTINKEEALQRPVASDFE
QTVHSIPFTIFKFEAQQRPVASDFE

SEQ ID NO: 49432 - protein, 25 aa, synthetic construct
  source 1..25: note = Seed: QTVHSIPLTINKEEALQRPVASDFE
QTVHSIPFTIFKFEARQRPVASDFE

SEQ ID NO: 49433 - protein, 25 aa, synthetic construct
  source 1..25: note = Seed: QTVHSIPLTINKEEALQRPVASDFE
QTVHSIPFTIFKFEASQRPVASDFE

SEQ ID NO: 49434 - protein, 25 aa, synthetic construct
  source 1..25: note = Seed: QTVHSIPLTINKEEALQRPVASDFE
QTVHSIPFTIFKFEATQRPVASDFE

SEQ ID NO: 49435 - protein, 25 aa, synthetic construct
  source 1..25: note = Seed: QTVHSIPLTINKEEALQRPVASDFE
QTVHSIPFTIFKFEAVQRPVASDFE

SEQ ID NO: 49436 - protein, 25 aa, synthetic construct
  source 1..25: note = Seed: QTVHSIPLTINKEEALQRPVASDFE
QTVHSIPFTIFKFEAWQRPVASDFE

SEQ ID NO: 49437 - protein, 25 aa, synthetic construct
  source 1..25: note = Seed: QTVHSIPLTINKEEALQRPVASDFE
QTVHSIPFTIFKFEAYQRPVASDFE

SEQ ID NO: 49438 - protein, 25 aa, synthetic construct
  source 1..25: note = Seed: QTVHSIPLTINKEEALQRPVASDFE
QTVHSIPFTIFKGEAFQRPVASDFE

SEQ ID NO: 49439 - protein, 25 aa, synthetic construct
  source 1..25: note = Seed: QTVHSIPLTINKEEALQRPVASDFE
QTVHSIPFTIFKGEALQRPVASDFE

SEQ ID NO: 49440 - protein, 25 aa, synthetic construct
  source 1..25: note = Seed: QTVHSIPLTINKEEALQRPVASDFE
QTVHSIPFTIFKHEAFQRPVASDFE

SEQ ID NO: 49441 - protein, 25 aa, synthetic construct
  source 1..25: note = Seed: QTVHSIPLTINKEEALQRPVASDFE
QTVHSIPFTIFKHEAIQRPVASDFE

SEQ ID NO: 49442 - protein, 25 aa, synthetic construct
  source 1..25: note = Seed: QTVHSIPLTINKEEALQRPVASDFE
QTVHSIPFTIFKHEALQRPVASDFE

SEQ ID NO: 49443 - protein, 25 aa, synthetic construct
  source 1..25: note = Seed: QTVHSIPLTINKEEALQRPVASDFE
QTVHSIPFTIFKHEAMQRPVASDFE

SEQ ID NO: 49444 - protein, 25 aa, synthetic construct
  source 1..25: note = Seed: QTVHSIPLTINKEEALQRPVASDFE
QTVHSIPFTIFKHEAVQRPVASDFE

SEQ ID NO: 49445 - protein, 25 aa, synthetic construct
  source 1..25: note = Seed: QTVHSIPLTINKEEALQRPVASDFE
QTVHSIPFTIFKIEAAQRPVASDFE

SEQ ID NO: 49446 - protein, 25 aa, synthetic construct
  source 1..25: note = Seed: QTVHSIPLTINKEEALQRPVASDFE
QTVHSIPFTIFKIEADQRPVASDFE

SEQ ID NO: 49447 - protein, 25 aa, synthetic construct
  source 1..25: note = Seed: QTVHSIPLTINKEEALQRPVASDFE
QTVHSIPFTIFKIEAEQRPVASDFE

SEQ ID NO: 49448 - protein, 25 aa, synthetic construct
  source 1..25: note = Seed: QTVHSIPLTINKEEALQRPVASDFE
QTVHSIPFTIFKIEAFQRPVASDFE

SEQ ID NO: 49449 - protein, 25 aa, synthetic construct
  source 1..25: note = Seed: QTVHSIPLTINKEEALQRPVASDFE
QTVHSIPFTIFKIEAHQRPVASDFE

SEQ ID NO: 49450 - protein, 25 aa, synthetic construct
  source 1..25: note = Seed: QTVHSIPLTINKEEALQRPVASDFE
QTVHSIPFTIFKIEAIQRPVASDFE

SEQ ID NO: 49451 - protein, 25 aa, synthetic construct
  source 1..25: note = Seed: QTVHSIPLTINKEEALQRPVASDFE
QTVHSIPFTIFKIEAKQRPVASDFE

SEQ ID NO: 49452 - protein, 25 aa, synthetic construct
  source 1..25: note = Seed: QTVHSIPLTINKEEALQRPVASDFE
QTVHSIPFTIFKIEALQRPVASDFE

SEQ ID NO: 49453 - protein, 25 aa, synthetic construct
  source 1..25: note = Seed: QTVHSIPLTINKEEALQRPVASDFE
QTVHSIPFTIFKIEAMQRPVASDFE

SEQ ID NO: 49454 - protein, 25 aa, synthetic construct
  source 1..25: note = Seed: QTVHSIPLTINKEEALQRPVASDFE
QTVHSIPFTIFKIEANQRPVASDFE

SEQ ID NO: 49455 - protein, 25 aa, synthetic construct
  source 1..25: note = Seed: QTVHSIPLTINKEEALQRPVASDFE
QTVHSIPFTIFKIEAPQRPVASDFE

SEQ ID NO: 49456 - protein, 25 aa, synthetic construct
  source 1..25: note = Seed: QTVHSIPLTINKEEALQRPVASDFE
QTVHSIPFTIFKIEAQQRPVASDFE

SEQ ID NO: 49457 - protein, 25 aa, synthetic construct
  source 1..25: note = Seed: QTVHSIPLTINKEEALQRPVASDFE
QTVHSIPFTIFKIEARQRPVASDFE

SEQ ID NO: 49458 - protein, 25 aa, synthetic construct
  source 1..25: note = Seed: QTVHSIPLTINKEEALQRPVASDFE
QTVHSIPFTIFKIEASQRPVASDFE

SEQ ID NO: 49459 - protein, 25 aa, synthetic construct
  source 1..25: note = Seed: QTVHSIPLTINKEEALQRPVASDFE
QTVHSIPFTIFKIEATQRPVASDFE

SEQ ID NO: 49460 - protein, 25 aa, synthetic construct
  source 1..25: note = Seed: QTVHSIPLTINKEEALQRPVASDFE
QTVHSIPFTIFKIEAVQRPVASDFE

SEQ ID NO: 49461 - protein, 25 aa, synthetic construct
  source 1..25: note = Seed: QTVHSIPLTINKEEALQRPVASDFE
QTVHSIPFTIFKIEAWQRPVASDFE

SEQ ID NO: 49462 - protein, 25 aa, synthetic construct
  source 1..25: note = Seed: QTVHSIPLTINKEEALQRPVASDFE
QTVHSIPFTIFKIEAYQRPVASDFE

SEQ ID NO: 49463 - protein, 25 aa, synthetic construct
  source 1..25: note = Seed: QTVHSIPLTINKEEALQRPVASDFE
QTVHSIPFTIFKKEAFQRPVASDFE

SEQ ID NO: 49464 - protein, 25 aa, synthetic construct
  source 1..25: note = Seed: QTVHSIPLTINKEEALQRPVASDFE
QTVHSIPFTIFKKEAIQRPVASDFE

SEQ ID NO: 49465 - protein, 25 aa, synthetic construct
  source 1..25: note = Seed: QTVHSIPLTINKEEALQRPVASDFE
QTVHSIPFTIFKKEALQRPVASDFE

SEQ ID NO: 49466 - protein, 25 aa, synthetic construct
  source 1..25: note = Seed: QTVHSIPLTINKEEALQRPVASDFE
QTVHSIPFTIFKLEAAQRPVASDFE

SEQ ID NO: 49467 - protein, 25 aa, synthetic construct
  source 1..25: note = Seed: QTVHSIPLTINKEEALQRPVASDFE
QTVHSIPFTIFKLEADQRPVASDFE

SEQ ID NO: 49468 - protein, 25 aa, synthetic construct
  source 1..25: note = Seed: QTVHSIPLTINKEEALQRPVASDFE
QTVHSIPFTIFKLEAEQRPVASDFE

SEQ ID NO: 49469 - protein, 25 aa, synthetic construct
  source 1..25: note = Seed: QTVHSIPLTINKEEALQRPVASDFE
QTVHSIPFTIFKLEAFQRPVASDFE

SEQ ID NO: 49470 - protein, 25 aa, synthetic construct
  source 1..25: note = Seed: QTVHSIPLTINKEEALQRPVASDFE
QTVHSIPFTIFKLEAGQRPVASDFE

SEQ ID NO: 49471 - protein, 25 aa, synthetic construct
  source 1..25: note = Seed: QTVHSIPLTINKEEALQRPVASDFE
QTVHSIPFTIFKLEAHQRPVASDFE

SEQ ID NO: 49472 - protein, 25 aa, synthetic construct
  source 1..25: note = Seed: QTVHSIPLTINKEEALQRPVASDFE
QTVHSIPFTIFKLEAIQRPVASDFE

SEQ ID NO: 49473 - protein, 25 aa, synthetic construct
  source 1..25: note = Seed: QTVHSIPLTINKEEALQRPVASDFE
QTVHSIPFTIFKLEAKQRPVASDFE

SEQ ID NO: 49474 - protein, 25 aa, synthetic construct
  source 1..25: note = Seed: QTVHSIPLTINKEEALQRPVASDFE
QTVHSIPFTIFKLEALQRPVASDFE

SEQ ID NO: 49475 - protein, 25 aa, synthetic construct
  source 1..25: note = Seed: QTVHSIPLTINKEEALQRPVASDFE
QTVHSIPFTIFKLEAMQRPVASDFE

SEQ ID NO: 49476 - protein, 25 aa, synthetic construct
  source 1..25: note = Seed: QTVHSIPLTINKEEALQRPVASDFE
QTVHSIPFTIFKLEANQRPVASDFE

SEQ ID NO: 49477 - protein, 25 aa, synthetic construct
  source 1..25: note = Seed: QTVHSIPLTINKEEALQRPVASDFE
QTVHSIPFTIFKLEAPQRPVASDFE

SEQ ID NO: 49478 - protein, 25 aa, synthetic construct
  source 1..25: note = Seed: QTVHSIPLTINKEEALQRPVASDFE
QTVHSIPFTIFKLEAQQRPVASDFE

SEQ ID NO: 49479 - protein, 25 aa, synthetic construct
  source 1..25: note = Seed: QTVHSIPLTINKEEALQRPVASDFE
QTVHSIPFTIFKLEARQRPVASDFE

SEQ ID NO: 49480 - protein, 25 aa, synthetic construct
  source 1..25: note = Seed: QTVHSIPLTINKEEALQRPVASDFE
QTVHSIPFTIFKLEASQRPVASDFE

SEQ ID NO: 49481 - protein, 25 aa, synthetic construct
  source 1..25: note = Seed: QTVHSIPLTINKEEALQRPVASDFE
QTVHSIPFTIFKLEATQRPVASDFE

SEQ ID NO: 49482 - protein, 25 aa, synthetic construct
  source 1..25: note = Seed: QTVHSIPLTINKEEALQRPVASDFE
QTVHSIPFTIFKLEAVQRPVASDFE

SEQ ID NO: 49483 - protein, 25 aa, synthetic construct
  source 1..25: note = Seed: QTVHSIPLTINKEEALQRPVASDFE
QTVHSIPFTIFKLEAWQRPVASDFE

SEQ ID NO: 49484 - protein, 25 aa, synthetic construct
  source 1..25: note = Seed: QTVHSIPLTINKEEALQRPVASDFE
QTVHSIPFTIFKLEAYQRPVASDFE

SEQ ID NO: 49485 - protein, 25 aa, synthetic construct
  source 1..25: note = Seed: QTVHSIPLTINKEEALQRPVASDFE
QTVHSIPFTIFKMEAAQRPVASDFE

SEQ ID NO: 49486 - protein, 25 aa, synthetic construct
  source 1..25: note = Seed: QTVHSIPLTINKEEALQRPVASDFE
QTVHSIPFTIFKMEADQRPVASDFE

SEQ ID NO: 49487 - protein, 25 aa, synthetic construct
  source 1..25: note = Seed: QTVHSIPLTINKEEALQRPVASDFE
QTVHSIPFTIFKMEAEQRPVASDFE

SEQ ID NO: 49488 - protein, 25 aa, synthetic construct
  source 1..25: note = Seed: QTVHSIPLTINKEEALQRPVASDFE
QTVHSIPFTIFKMEAFQRPVASDFE

SEQ ID NO: 49489 - protein, 25 aa, synthetic construct
  source 1..25: note = Seed: QTVHSIPLTINKEEALQRPVASDFE
QTVHSIPFTIFKMEAHQRPVASDFE

SEQ ID NO: 49490 - protein, 25 aa, synthetic construct
  source 1..25: note = Seed: QTVHSIPLTINKEEALQRPVASDFE
QTVHSIPFTIFKMEAIQRPVASDFE

SEQ ID NO: 49491 - protein, 25 aa, synthetic construct
  source 1..25: note = Seed: QTVHSIPLTINKEEALQRPVASDFE
QTVHSIPFTIFKMEALQRPVASDFE

SEQ ID NO: 49492 - protein, 25 aa, synthetic construct
  source 1..25: note = Seed: QTVHSIPLTINKEEALQRPVASDFE
QTVHSIPFTIFKMEAMQRPVASDFE

SEQ ID NO: 49493 - protein, 25 aa, synthetic construct
  source 1..25: note = Seed: QTVHSIPLTINKEEALQRPVASDFE
QTVHSIPFTIFKMEANQRPVASDFE

SEQ ID NO: 49494 - protein, 25 aa, synthetic construct
  source 1..25: note = Seed: QTVHSIPLTINKEEALQRPVASDFE
QTVHSIPFTIFKMEAPQRPVASDFE

SEQ ID NO: 49495 - protein, 25 aa, synthetic construct
  source 1..25: note = Seed: QTVHSIPLTINKEEALQRPVASDFE
QTVHSIPFTIFKMEAQQRPVASDFE

SEQ ID NO: 49496 - protein, 25 aa, synthetic construct
  source 1..25: note = Seed: QTVHSIPLTINKEEALQRPVASDFE
QTVHSIPFTIFKMEARQRPVASDFE

SEQ ID NO: 49497 - protein, 25 aa, synthetic construct
  source 1..25: note = Seed: QTVHSIPLTINKEEALQRPVASDFE
QTVHSIPFTIFKMEASQRPVASDFE

SEQ ID NO: 49498 - protein, 25 aa, synthetic construct
  source 1..25: note = Seed: QTVHSIPLTINKEEALQRPVASDFE
QTVHSIPFTIFKMEATQRPVASDFE

SEQ ID NO: 49499 - protein, 25 aa, synthetic construct
  source 1..25: note = Seed: QTVHSIPLTINKEEALQRPVASDFE
QTVHSIPFTIFKMEAVQRPVASDFE

SEQ ID NO: 49500 - protein, 25 aa, synthetic construct
  source 1..25: note = Seed: QTVHSIPLTINKEEALQRPVASDFE
QTVHSIPFTIFKMEAYQRPVASDFE

SEQ ID NO: 49501 - protein, 25 aa, synthetic construct
  source 1..25: note = Seed: QTVHSIPLTINKEEALQRPVASDFE
QTVHSIPFTIFKNEAFQRPVASDFE

SEQ ID NO: 49502 - protein, 25 aa, synthetic construct
  source 1..25: note = Seed: QTVHSIPLTINKEEALQRPVASDFE
QTVHSIPFTIFKNEAIQRPVASDFE

SEQ ID NO: 49503 - protein, 25 aa, synthetic construct
  source 1..25: note = Seed: QTVHSIPLTINKEEALQRPVASDFE
QTVHSIPFTIFKNEALQRPVASDFE

SEQ ID NO: 49504 - protein, 25 aa, synthetic construct
  source 1..25: note = Seed: QTVHSIPLTINKEEALQRPVASDFE
QTVHSIPFTIFKPEAFQRPVASDFE

SEQ ID NO: 49505 - protein, 25 aa, synthetic construct
  source 1..25: note = Seed: QTVHSIPLTINKEEALQRPVASDFE
QTVHSIPFTIFKPEALQRPVASDFE

SEQ ID NO: 49506 - protein, 25 aa, synthetic construct
  source 1..25: note = Seed: QTVHSIPLTINKEEALQRPVASDFE
QTVHSIPFTIFKQEAFQRPVASDFE

SEQ ID NO: 49507 - protein, 25 aa, synthetic construct
  source 1..25: note = Seed: QTVHSIPLTINKEEALQRPVASDFE
QTVHSIPFTIFKQEAIQRPVASDFE

SEQ ID NO: 49508 - protein, 25 aa, synthetic construct
  source 1..25: note = Seed: QTVHSIPLTINKEEALQRPVASDFE
QTVHSIPFTIFKQEALQRPVASDFE

SEQ ID NO: 49509 - protein, 25 aa, synthetic construct
  source 1..25: note = Seed: QTVHSIPLTINKEEALQRPVASDFE
QTVHSIPFTIFKQEAMQRPVASDFE

SEQ ID NO: 49510 - protein, 25 aa, synthetic construct
  source 1..25: note = Seed: QTVHSIPLTINKEEALQRPVASDFE
QTVHSIPFTIFKQEAYQRPVASDFE

SEQ ID NO: 49511 - protein, 25 aa, synthetic construct
  source 1..25: note = Seed: QTVHSIPLTINKEEALQRPVASDFE
QTVHSIPFTIFKREAFQRPVASDFE

SEQ ID NO: 49512 - protein, 25 aa, synthetic construct
  source 1..25: note = Seed: QTVHSIPLTINKEEALQRPVASDFE
QTVHSIPFTIFKREAIQRPVASDFE

SEQ ID NO: 49513 - protein, 25 aa, synthetic construct
  source 1..25: note = Seed: QTVHSIPLTINKEEALQRPVASDFE
QTVHSIPFTIFKREALQRPVASDFE

SEQ ID NO: 49514 - protein, 25 aa, synthetic construct
  source 1..25: note = Seed: QTVHSIPLTINKEEALQRPVASDFE
QTVHSIPFTIFKREAMQRPVASDFE

SEQ ID NO: 49515 - protein, 25 aa, synthetic construct
  source 1..25: note = Seed: QTVHSIPLTINKEEALQRPVASDFE
QTVHSIPFTIFKREAVQRPVASDFE

SEQ ID NO: 49516 - protein, 25 aa, synthetic construct
  source 1..25: note = Seed: QTVHSIPLTINKEEALQRPVASDFE
QTVHSIPFTIFKREAYQRPVASDFE

SEQ ID NO: 49517 - protein, 25 aa, synthetic construct
  source 1..25: note = Seed: QTVHSIPLTINKEEALQRPVASDFE
QTVHSIPFTIFKSEAFQRPVASDFE

SEQ ID NO: 49518 - protein, 25 aa, synthetic construct
  source 1..25: note = Seed: QTVHSIPLTINKEEALQRPVASDFE
QTVHSIPFTIFKSEAIQRPVASDFE

SEQ ID NO: 49519 - protein, 25 aa, synthetic construct
  source 1..25: note = Seed: QTVHSIPLTINKEEALQRPVASDFE
QTVHSIPFTIFKSEALQRPVASDFE

SEQ ID NO: 49520 - protein, 25 aa, synthetic construct
  source 1..25: note = Seed: QTVHSIPLTINKEEALQRPVASDFE
QTVHSIPFTIFKSEAMQRPVASDFE

SEQ ID NO: 49521 - protein, 25 aa, synthetic construct
  source 1..25: note = Seed: QTVHSIPLTINKEEALQRPVASDFE
QTVHSIPFTIFKSEAVQRPVASDFE

SEQ ID NO: 49522 - protein, 25 aa, synthetic construct
  source 1..25: note = Seed: QTVHSIPLTINKEEALQRPVASDFE
QTVHSIPFTIFKSEAYQRPVASDFE

SEQ ID NO: 49523 - protein, 25 aa, synthetic construct
  source 1..25: note = Seed: QTVHSIPLTINKEEALQRPVASDFE
QTVHSIPFTIFKTEAFQRPVASDFE

SEQ ID NO: 49524 - protein, 25 aa, synthetic construct
  source 1..25: note = Seed: QTVHSIPLTINKEEALQRPVASDFE
QTVHSIPFTIFKTEAIQRPVASDFE

SEQ ID NO: 49525 - protein, 25 aa, synthetic construct
  source 1..25: note = Seed: QTVHSIPLTINKEEALQRPVASDFE
QTVHSIPFTIFKTEALQRPVASDFE

SEQ ID NO: 49526 - protein, 25 aa, synthetic construct
  source 1..25: note = Seed: QTVHSIPLTINKEEALQRPVASDFE
QTVHSIPFTIFKTEAMQRPVASDFE

SEQ ID NO: 49527 - protein, 25 aa, synthetic construct
  source 1..25: note = Seed: QTVHSIPLTINKEEALQRPVASDFE
QTVHSIPFTIFKTEAVQRPVASDFE

SEQ ID NO: 49528 - protein, 25 aa, synthetic construct
  source 1..25: note = Seed: QTVHSIPLTINKEEALQRPVASDFE
QTVHSIPFTIFKTEAYQRPVASDFE

SEQ ID NO: 49529 - protein, 25 aa, synthetic construct
  source 1..25: note = Seed: QTVHSIPLTINKEEALQRPVASDFE
QTVHSIPFTIFKVEAAQRPVASDFE

SEQ ID NO: 49530 - protein, 25 aa, synthetic construct
  source 1..25: note = Seed: QTVHSIPLTINKEEALQRPVASDFE
QTVHSIPFTIFKVEADQRPVASDFE

SEQ ID NO: 49531 - protein, 25 aa, synthetic construct
  source 1..25: note = Seed: QTVHSIPLTINKEEALQRPVASDFE
QTVHSIPFTIFKVEAEQRPVASDFE

SEQ ID NO: 49532 - protein, 25 aa, synthetic construct
  source 1..25: note = Seed: QTVHSIPLTINKEEALQRPVASDFE
QTVHSIPFTIFKVEAFQRPVASDFE

SEQ ID NO: 49533 - protein, 25 aa, synthetic construct
  source 1..25: note = Seed: QTVHSIPLTINKEEALQRPVASDFE
QTVHSIPFTIFKVEAIQRPVASDFE

SEQ ID NO: 49534 - protein, 25 aa, synthetic construct
  source 1..25: note = Seed: QTVHSIPLTINKEEALQRPVASDFE
QTVHSIPFTIFKVEAKQRPVASDFE

SEQ ID NO: 49535 - protein, 25 aa, synthetic construct
  source 1..25: note = Seed: QTVHSIPLTINKEEALQRPVASDFE
QTVHSIPFTIFKVEALQRPVASDFE

SEQ ID NO: 49536 - protein, 25 aa, synthetic construct
  source 1..25: note = Seed: QTVHSIPLTINKEEALQRPVASDFE
QTVHSIPFTIFKVEAMQRPVASDFE

SEQ ID NO: 49537 - protein, 25 aa, synthetic construct
  source 1..25: note = Seed: QTVHSIPLTINKEEALQRPVASDFE
QTVHSIPFTIFKVEARQRPVASDFE

SEQ ID NO: 49538 - protein, 25 aa, synthetic construct
  source 1..25: note = Seed: QTVHSIPLTINKEEALQRPVASDFE
QTVHSIPFTIFKVEASQRPVASDFE

SEQ ID NO: 49539 - protein, 25 aa, synthetic construct
  source 1..25: note = Seed: QTVHSIPLTINKEEALQRPVASDFE
QTVHSIPFTIFKVEATQRPVASDFE

SEQ ID NO: 49540 - protein, 25 aa, synthetic construct
  source 1..25: note = Seed: QTVHSIPLTINKEEALQRPVASDFE
QTVHSIPFTIFKVEAVQRPVASDFE

SEQ ID NO: 49541 - protein, 25 aa, synthetic construct
  source 1..25: note = Seed: QTVHSIPLTINKEEALQRPVASDFE
QTVHSIPFTIFKVEAYQRPVASDFE

SEQ ID NO: 49542 - protein, 25 aa, synthetic construct
  source 1..25: note = Seed: QTVHSIPLTINKEEALQRPVASDFE
QTVHSIPFTIFKWEAAQRPVASDFE

SEQ ID NO: 49543 - protein, 25 aa, synthetic construct
  source 1..25: note = Seed: QTVHSIPLTINKEEALQRPVASDFE
QTVHSIPFTIFKWEAEQRPVASDFE

SEQ ID NO: 49544 - protein, 25 aa, synthetic construct
  source 1..25: note = Seed: QTVHSIPLTINKEEALQRPVASDFE
QTVHSIPFTIFKWEAFQRPVASDFE

SEQ ID NO: 49545 - protein, 25 aa, synthetic construct
  source 1..25: note = Seed: QTVHSIPLTINKEEALQRPVASDFE
QTVHSIPFTIFKWEAIQRPVASDFE

SEQ ID NO: 49546 - protein, 25 aa, synthetic construct
  source 1..25: note = Seed: QTVHSIPLTINKEEALQRPVASDFE
QTVHSIPFTIFKWEALQRPVASDFE

SEQ ID NO: 49547 - protein, 25 aa, synthetic construct
  source 1..25: note = Seed: QTVHSIPLTINKEEALQRPVASDFE
QTVHSIPFTIFKWEAMQRPVASDFE

SEQ ID NO: 49548 - protein, 25 aa, synthetic construct
  source 1..25: note = Seed: QTVHSIPLTINKEEALQRPVASDFE
QTVHSIPFTIFKWEARQRPVASDFE

SEQ ID NO: 49549 - protein, 25 aa, synthetic construct
  source 1..25: note = Seed: QTVHSIPLTINKEEALQRPVASDFE
QTVHSIPFTIFKWEASQRPVASDFE

SEQ ID NO: 49550 - protein, 25 aa, synthetic construct
  source 1..25: note = Seed: QTVHSIPLTINKEEALQRPVASDFE
QTVHSIPFTIFKWEATQRPVASDFE

SEQ ID NO: 49551 - protein, 25 aa, synthetic construct
  source 1..25: note = Seed: QTVHSIPLTINKEEALQRPVASDFE
QTVHSIPFTIFKWEAVQRPVASDFE

SEQ ID NO: 49552 - protein, 25 aa, synthetic construct
  source 1..25: note = Seed: QTVHSIPLTINKEEALQRPVASDFE
QTVHSIPFTIFKWEAYQRPVASDFE

SEQ ID NO: 49553 - protein, 25 aa, synthetic construct
  source 1..25: note = Seed: QTVHSIPLTINKEEALQRPVASDFE
QTVHSIPFTIFKYEAAQRPVASDFE

SEQ ID NO: 49554 - protein, 25 aa, synthetic construct
  source 1..25: note = Seed: QTVHSIPLTINKEEALQRPVASDFE
QTVHSIPFTIFKYEACQRPVASDFE

SEQ ID NO: 49555 - protein, 25 aa, synthetic construct
  source 1..25: note = Seed: QTVHSIPLTINKEEALQRPVASDFE
QTVHSIPFTIFKYEADQRPVASDFE

SEQ ID NO: 49556 - protein, 25 aa, synthetic construct
  source 1..25: note = Seed: QTVHSIPLTINKEEALQRPVASDFE
QTVHSIPFTIFKYEAEQRPVASDFE

SEQ ID NO: 49557 - protein, 25 aa, synthetic construct
  source 1..25: note = Seed: QTVHSIPLTINKEEALQRPVASDFE
QTVHSIPFTIFKYEAFQRPVASDFE

SEQ ID NO: 49558 - protein, 25 aa, synthetic construct
  source 1..25: note = Seed: QTVHSIPLTINKEEALQRPVASDFE
QTVHSIPFTIFKYEAHQRPVASDFE

SEQ ID NO: 49559 - protein, 25 aa, synthetic construct
  source 1..25: note = Seed: QTVHSIPLTINKEEALQRPVASDFE
QTVHSIPFTIFKYEAIQRPVASDFE

SEQ ID NO: 49560 - protein, 25 aa, synthetic construct
  source 1..25: note = Seed: QTVHSIPLTINKEEALQRPVASDFE
QTVHSIPFTIFKYEAKQRPVASDFE

SEQ ID NO: 49561 - protein, 25 aa, synthetic construct
  source 1..25: note = Seed: QTVHSIPLTINKEEALQRPVASDFE
QTVHSIPFTIFKYEALQRPVASDFE

SEQ ID NO: 49562 - protein, 25 aa, synthetic construct
  source 1..25: note = Seed: QTVHSIPLTINKEEALQRPVASDFE
QTVHSIPFTIFKYEAMQRPVASDFE

SEQ ID NO: 49563 - protein, 25 aa, synthetic construct
  source 1..25: note = Seed: QTVHSIPLTINKEEALQRPVASDFE
QTVHSIPFTIFKYEANQRPVASDFE

SEQ ID NO: 49564 - protein, 25 aa, synthetic construct
  source 1..25: note = Seed: QTVHSIPLTINKEEALQRPVASDFE
QTVHSIPFTIFKYEAPQRPVASDFE

SEQ ID NO: 49565 - protein, 25 aa, synthetic construct
  source 1..25: note = Seed: QTVHSIPLTINKEEALQRPVASDFE
QTVHSIPFTIFKYEAQQRPVASDFE

SEQ ID NO: 49566 - protein, 25 aa, synthetic construct
  source 1..25: note = Seed: QTVHSIPLTINKEEALQRPVASDFE
QTVHSIPFTIFKYEARQRPVASDFE

SEQ ID NO: 49567 - protein, 25 aa, synthetic construct
  source 1..25: note = Seed: QTVHSIPLTINKEEALQRPVASDFE
QTVHSIPFTIFKYEASQRPVASDFE

SEQ ID NO: 49568 - protein, 25 aa, synthetic construct
  source 1..25: note = Seed: QTVHSIPLTINKEEALQRPVASDFE
QTVHSIPFTIFKYEATQRPVASDFE

SEQ ID NO: 49569 - protein, 25 aa, synthetic construct
  source 1..25: note = Seed: QTVHSIPLTINKEEALQRPVASDFE
QTVHSIPFTIFKYEAVQRPVASDFE

SEQ ID NO: 49570 - protein, 25 aa, synthetic construct
  source 1..25: note = Seed: QTVHSIPLTINKEEALQRPVASDFE
QTVHSIPFTIFKYEAWQRPVASDFE

SEQ ID NO: 49571 - protein, 25 aa, synthetic construct
  source 1..25: note = Seed: QTVHSIPLTINKEEALQRPVASDFE
QTVHSIPFTIFKYEAYQRPVASDFE

SEQ ID NO: 49572 - protein, 25 aa, synthetic construct
  source 1..25: note = Seed: QTVHSIPLTINKEEALQRPVASDFE
QTVHSIPFTIGKFEAFQRPVASDFE

SEQ ID NO: 49573 - protein, 25 aa, synthetic construct
  source 1..25: note = Seed: QTVHSIPLTINKEEALQRPVASDFE
QTVHSIPFTIGKFEAIQRPVASDFE

SEQ ID NO: 49574 - protein, 25 aa, synthetic construct
  source 1..25: note = Seed: QTVHSIPLTINKEEALQRPVASDFE
QTVHSIPFTIGKFEALQRPVASDFE

SEQ ID NO: 49575 - protein, 25 aa, synthetic construct
  source 1..25: note = Seed: QTVHSIPLTINKEEALQRPVASDFE
QTVHSIPFTIGKFEAVQRPVASDFE

SEQ ID NO: 49576 - protein, 25 aa, synthetic construct
  source 1..25: note = Seed: QTVHSIPLTINKEEALQRPVASDFE
QTVHSIPFTIHKFEAAQRPVASDFE

SEQ ID NO: 49577 - protein, 25 aa, synthetic construct
  source 1..25: note = Seed: QTVHSIPLTINKEEALQRPVASDFE
QTVHSIPFTIHKFEADQRPVASDFE

SEQ ID NO: 49578 - protein, 25 aa, synthetic construct
  source 1..25: note = Seed: QTVHSIPLTINKEEALQRPVASDFE
QTVHSIPFTIHKFEAEQRPVASDFE

SEQ ID NO: 49579 - protein, 25 aa, synthetic construct
  source 1..25: note = Seed: QTVHSIPLTINKEEALQRPVASDFE
QTVHSIPFTIHKFEAFQRPVASDFE

SEQ ID NO: 49580 - protein, 25 aa, synthetic construct
  source 1..25: note = Seed: QTVHSIPLTINKEEALQRPVASDFE
QTVHSIPFTIHKFEAIQRPVASDFE

SEQ ID NO: 49581 - protein, 25 aa, synthetic construct
  source 1..25: note = Seed: QTVHSIPLTINKEEALQRPVASDFE
QTVHSIPFTIHKFEALQRPVASDFE

SEQ ID NO: 49582 - protein, 25 aa, synthetic construct
  source 1..25: note = Seed: QTVHSIPLTINKEEALQRPVASDFE
QTVHSIPFTIHKFEAMQRPVASDFE

SEQ ID NO: 49583 - protein, 25 aa, synthetic construct
  source 1..25: note = Seed: QTVHSIPLTINKEEALQRPVASDFE
QTVHSIPFTIHKFEANQRPVASDFE

SEQ ID NO: 49584 - protein, 25 aa, synthetic construct
  source 1..25: note = Seed: QTVHSIPLTINKEEALQRPVASDFE
QTVHSIPFTIHKFEASQRPVASDFE

SEQ ID NO: 49585 - protein, 25 aa, synthetic construct
  source 1..25: note = Seed: QTVHSIPLTINKEEALQRPVASDFE
QTVHSIPFTIHKFEATQRPVASDFE

SEQ ID NO: 49586 - protein, 25 aa, synthetic construct
  source 1..25: note = Seed: QTVHSIPLTINKEEALQRPVASDFE
QTVHSIPFTIHKFEAVQRPVASDFE

SEQ ID NO: 49587 - protein, 25 aa, synthetic construct
  source 1..25: note = Seed: QTVHSIPLTINKEEALQRPVASDFE
QTVHSIPFTIHKFEAWQRPVASDFE

SEQ ID NO: 49588 - protein, 25 aa, synthetic construct
  source 1..25: note = Seed: QTVHSIPLTINKEEALQRPVASDFE
QTVHSIPFTIHKFEAYQRPVASDFE

SEQ ID NO: 49589 - protein, 25 aa, synthetic construct
  source 1..25: note = Seed: QTVHSIPLTINKEEALQRPVASDFE
QTVHSIPFTIHKIEAFQRPVASDFE

SEQ ID NO: 49590 - protein, 25 aa, synthetic construct
  source 1..25: note = Seed: QTVHSIPLTINKEEALQRPVASDFE
QTVHSIPFTIHKIEAIQRPVASDFE

SEQ ID NO: 49591 - protein, 25 aa, synthetic construct
  source 1..25: note = Seed: QTVHSIPLTINKEEALQRPVASDFE
QTVHSIPFTIHKIEALQRPVASDFE

SEQ ID NO: 49592 - protein, 25 aa, synthetic construct
  source 1..25: note = Seed: QTVHSIPLTINKEEALQRPVASDFE
QTVHSIPFTIHKIEAVQRPVASDFE

SEQ ID NO: 49593 - protein, 25 aa, synthetic construct
  source 1..25: note = Seed: QTVHSIPLTINKEEALQRPVASDFE
QTVHSIPFTIHKLEAFQRPVASDFE

SEQ ID NO: 49594 - protein, 25 aa, synthetic construct
  source 1..25: note = Seed: QTVHSIPLTINKEEALQRPVASDFE
QTVHSIPFTIHKLEAIQRPVASDFE

SEQ ID NO: 49595 - protein, 25 aa, synthetic construct
  source 1..25: note = Seed: QTVHSIPLTINKEEALQRPVASDFE
QTVHSIPFTIHKLEALQRPVASDFE

SEQ ID NO: 49596 - protein, 25 aa, synthetic construct
  source 1..25: note = Seed: QTVHSIPLTINKEEALQRPVASDFE
QTVHSIPFTIHKLEAMQRPVASDFE

SEQ ID NO: 49597 - protein, 25 aa, synthetic construct
  source 1..25: note = Seed: QTVHSIPLTINKEEALQRPVASDFE
QTVHSIPFTIHKLEAVQRPVASDFE

SEQ ID NO: 49598 - protein, 25 aa, synthetic construct
  source 1..25: note = Seed: QTVHSIPLTINKEEALQRPVASDFE
QTVHSIPFTIHKMEAFQRPVASDFE

SEQ ID NO: 49599 - protein, 25 aa, synthetic construct
  source 1..25: note = Seed: QTVHSIPLTINKEEALQRPVASDFE
QTVHSIPFTIHKMEAIQRPVASDFE

SEQ ID NO: 49600 - protein, 25 aa, synthetic construct
  source 1..25: note = Seed: QTVHSIPLTINKEEALQRPVASDFE
QTVHSIPFTIHKMEALQRPVASDFE

SEQ ID NO: 49601 - protein, 25 aa, synthetic construct
  source 1..25: note = Seed: QTVHSIPLTINKEEALQRPVASDFE
QTVHSIPFTIHKWEAFQRPVASDFE

SEQ ID NO: 49602 - protein, 25 aa, synthetic construct
  source 1..25: note = Seed: QTVHSIPLTINKEEALQRPVASDFE
QTVHSIPFTIHKWEAIQRPVASDFE

SEQ ID NO: 49603 - protein, 25 aa, synthetic construct
  source 1..25: note = Seed: QTVHSIPLTINKEEALQRPVASDFE
QTVHSIPFTIHKWEALQRPVASDFE

SEQ ID NO: 49604 - protein, 25 aa, synthetic construct
  source 1..25: note = Seed: QTVHSIPLTINKEEALQRPVASDFE
QTVHSIPFTIHKWEAVQRPVASDFE

SEQ ID NO: 49605 - protein, 25 aa, synthetic construct
  source 1..25: note = Seed: QTVHSIPLTINKEEALQRPVASDFE
QTVHSIPFTIHKYEAFQRPVASDFE

SEQ ID NO: 49606 - protein, 25 aa, synthetic construct
  source 1..25: note = Seed: QTVHSIPLTINKEEALQRPVASDFE
QTVHSIPFTIHKYEAIQRPVASDFE

SEQ ID NO: 49607 - protein, 25 aa, synthetic construct
  source 1..25: note = Seed: QTVHSIPLTINKEEALQRPVASDFE
QTVHSIPFTIHKYEALQRPVASDFE

SEQ ID NO: 49608 - protein, 25 aa, synthetic construct
  source 1..25: note = Seed: QTVHSIPLTINKEEALQRPVASDFE
QTVHSIPFTIHKYEAMQRPVASDFE

SEQ ID NO: 49609 - protein, 25 aa, synthetic construct
  source 1..25: note = Seed: QTVHSIPLTINKEEALQRPVASDFE
QTVHSIPFTIHKYEAVQRPVASDFE

SEQ ID NO: 49610 - protein, 25 aa, synthetic construct
  source 1..25: note = Seed: QTVHSIPLTINKEEALQRPVASDFE
QTVHSIPFTIIKAEAAQRPVASDFE

SEQ ID NO: 49611 - protein, 25 aa, synthetic construct
  source 1..25: note = Seed: QTVHSIPLTINKEEALQRPVASDFE
QTVHSIPFTIIKAEAFQRPVASDFE

SEQ ID NO: 49612 - protein, 25 aa, synthetic construct
  source 1..25: note = Seed: QTVHSIPLTINKEEALQRPVASDFE
QTVHSIPFTIIKAEAIQRPVASDFE

SEQ ID NO: 49613 - protein, 25 aa, synthetic construct
  source 1..25: note = Seed: QTVHSIPLTINKEEALQRPVASDFE
QTVHSIPFTIIKAEALQRPVASDFE

SEQ ID NO: 49614 - protein, 25 aa, synthetic construct
  source 1..25: note = Seed: QTVHSIPLTINKEEALQRPVASDFE
QTVHSIPFTIIKAEAMQRPVASDFE

SEQ ID NO: 49615 - protein, 25 aa, synthetic construct
  source 1..25: note = Seed: QTVHSIPLTINKEEALQRPVASDFE
QTVHSIPFTIIKAEAVQRPVASDFE

SEQ ID NO: 49616 - protein, 25 aa, synthetic construct
  source 1..25: note = Seed: QTVHSIPLTINKEEALQRPVASDFE
QTVHSIPFTIIKAEAWQRPVASDFE

SEQ ID NO: 49617 - protein, 25 aa, synthetic construct
  source 1..25: note = Seed: QTVHSIPLTINKEEALQRPVASDFE
QTVHSIPFTIIKAEAYQRPVASDFE

SEQ ID NO: 49618 - protein, 25 aa, synthetic construct
  source 1..25: note = Seed: QTVHSIPLTINKEEALQRPVASDFE
QTVHSIPFTIIKEEAFQRPVASDFE

SEQ ID NO: 49619 - protein, 25 aa, synthetic construct
  source 1..25: note = Seed: QTVHSIPLTINKEEALQRPVASDFE
QTVHSIPFTIIKEEAIQRPVASDFE

SEQ ID NO: 49620 - protein, 25 aa, synthetic construct
  source 1..25: note = Seed: QTVHSIPLTINKEEALQRPVASDFE
QTVHSIPFTIIKEEALQRPVASDFE

SEQ ID NO: 49621 - protein, 25 aa, synthetic construct
  source 1..25: note = Seed: QTVHSIPLTINKEEALQRPVASDFE
QTVHSIPFTIIKFEAAQRPVASDFE

SEQ ID NO: 49622 - protein, 25 aa, synthetic construct
  source 1..25: note = Seed: QTVHSIPLTINKEEALQRPVASDFE
QTVHSIPFTIIKFEACQRPVASDFE

SEQ ID NO: 49623 - protein, 25 aa, synthetic construct
  source 1..25: note = Seed: QTVHSIPLTINKEEALQRPVASDFE
QTVHSIPFTIIKFEADQRPVASDFE

SEQ ID NO: 49624 - protein, 25 aa, synthetic construct
  source 1..25: note = Seed: QTVHSIPLTINKEEALQRPVASDFE
QTVHSIPFTIIKFEAEQRPVASDFE

SEQ ID NO: 49625 - protein, 25 aa, synthetic construct
  source 1..25: note = Seed: QTVHSIPLTINKEEALQRPVASDFE
QTVHSIPFTIIKFEAFQRPVASDFE

SEQ ID NO: 49626 - protein, 25 aa, synthetic construct
  source 1..25: note = Seed: QTVHSIPLTINKEEALQRPVASDFE
QTVHSIPFTIIKFEAGQRPVASDFE

SEQ ID NO: 49627 - protein, 25 aa, synthetic construct
  source 1..25: note = Seed: QTVHSIPLTINKEEALQRPVASDFE
QTVHSIPFTIIKFEAHQRPVASDFE

SEQ ID NO: 49628 - protein, 25 aa, synthetic construct
  source 1..25: note = Seed: QTVHSIPLTINKEEALQRPVASDFE
QTVHSIPFTIIKFEAIQRPVASDFE

SEQ ID NO: 49629 - protein, 25 aa, synthetic construct
  source 1..25: note = Seed: QTVHSIPLTINKEEALQRPVASDFE
QTVHSIPFTIIKFEAKQRPVASDFE

SEQ ID NO: 49630 - protein, 25 aa, synthetic construct
  source 1..25: note = Seed: QTVHSIPLTINKEEALQRPVASDFE
QTVHSIPFTIIKFEALQRPVASDFE

SEQ ID NO: 49631 - protein, 25 aa, synthetic construct
  source 1..25: note = Seed: QTVHSIPLTINKEEALQRPVASDFE
QTVHSIPFTIIKFEAMQRPVASDFE

SEQ ID NO: 49632 - protein, 25 aa, synthetic construct
  source 1..25: note = Seed: QTVHSIPLTINKEEALQRPVASDFE
QTVHSIPFTIIKFEANQRPVASDFE

SEQ ID NO: 49633 - protein, 25 aa, synthetic construct
  source 1..25: note = Seed: QTVHSIPLTINKEEALQRPVASDFE
QTVHSIPFTIIKFEAPQRPVASDFE

SEQ ID NO: 49634 - protein, 25 aa, synthetic construct
  source 1..25: note = Seed: QTVHSIPLTINKEEALQRPVASDFE
QTVHSIPFTIIKFEAQQRPVASDFE

SEQ ID NO: 49635 - protein, 25 aa, synthetic construct
  source 1..25: note = Seed: QTVHSIPLTINKEEALQRPVASDFE
QTVHSIPFTIIKFEARQRPVASDFE

SEQ ID NO: 49636 - protein, 25 aa, synthetic construct
  source 1..25: note = Seed: QTVHSIPLTINKEEALQRPVASDFE
QTVHSIPFTIIKFEASQRPVASDFE

SEQ ID NO: 49637 - protein, 25 aa, synthetic construct
  source 1..25: note = Seed: QTVHSIPLTINKEEALQRPVASDFE
QTVHSIPFTIIKFEATQRPVASDFE

SEQ ID NO: 49638 - protein, 25 aa, synthetic construct
  source 1..25: note = Seed: QTVHSIPLTINKEEALQRPVASDFE
QTVHSIPFTIIKFEAVQRPVASDFE

SEQ ID NO: 49639 - protein, 25 aa, synthetic construct
  source 1..25: note = Seed: QTVHSIPLTINKEEALQRPVASDFE
QTVHSIPFTIIKFEAWQRPVASDFE

SEQ ID NO: 49640 - protein, 25 aa, synthetic construct
  source 1..25: note = Seed: QTVHSIPLTINKEEALQRPVASDFE
QTVHSIPFTIIKFEAYQRPVASDFE

SEQ ID NO: 49641 - protein, 25 aa, synthetic construct
  source 1..25: note = Seed: QTVHSIPLTINKEEALQRPVASDFE
QTVHSIPFTIIKGEALQRPVASDFE

SEQ ID NO: 49642 - protein, 25 aa, synthetic construct
  source 1..25: note = Seed: QTVHSIPLTINKEEALQRPVASDFE
QTVHSIPFTIIKHEAFQRPVASDFE

SEQ ID NO: 49643 - protein, 25 aa, synthetic construct
  source 1..25: note = Seed: QTVHSIPLTINKEEALQRPVASDFE
QTVHSIPFTIIKHEAIQRPVASDFE

SEQ ID NO: 49644 - protein, 25 aa, synthetic construct
  source 1..25: note = Seed: QTVHSIPLTINKEEALQRPVASDFE
QTVHSIPFTIIKHEALQRPVASDFE

SEQ ID NO: 49645 - protein, 25 aa, synthetic construct
  source 1..25: note = Seed: QTVHSIPLTINKEEALQRPVASDFE
QTVHSIPFTIIKHEAMQRPVASDFE

SEQ ID NO: 49646 - protein, 25 aa, synthetic construct
  source 1..25: note = Seed: QTVHSIPLTINKEEALQRPVASDFE
QTVHSIPFTIIKHEAVQRPVASDFE

SEQ ID NO: 49647 - protein, 25 aa, synthetic construct
  source 1..25: note = Seed: QTVHSIPLTINKEEALQRPVASDFE
QTVHSIPFTIIKHEAYQRPVASDFE

SEQ ID NO: 49648 - protein, 25 aa, synthetic construct
  source 1..25: note = Seed: QTVHSIPLTINKEEALQRPVASDFE
QTVHSIPFTIIKIEAAQRPVASDFE

SEQ ID NO: 49649 - protein, 25 aa, synthetic construct
  source 1..25: note = Seed: QTVHSIPLTINKEEALQRPVASDFE
QTVHSIPFTIIKIEADQRPVASDFE

SEQ ID NO: 49650 - protein, 25 aa, synthetic construct
  source 1..25: note = Seed: QTVHSIPLTINKEEALQRPVASDFE
QTVHSIPFTIIKIEAEQRPVASDFE

SEQ ID NO: 49651 - protein, 25 aa, synthetic construct
  source 1..25: note = Seed: QTVHSIPLTINKEEALQRPVASDFE
QTVHSIPFTIIKIEAFQRPVASDFE

SEQ ID NO: 49652 - protein, 25 aa, synthetic construct
  source 1..25: note = Seed: QTVHSIPLTINKEEALQRPVASDFE
QTVHSIPFTIIKIEAHQRPVASDFE

SEQ ID NO: 49653 - protein, 25 aa, synthetic construct
  source 1..25: note = Seed: QTVHSIPLTINKEEALQRPVASDFE
QTVHSIPFTIIKIEAIQRPVASDFE

SEQ ID NO: 49654 - protein, 25 aa, synthetic construct
  source 1..25: note = Seed: QTVHSIPLTINKEEALQRPVASDFE
QTVHSIPFTIIKIEALQRPVASDFE

SEQ ID NO: 49655 - protein, 25 aa, synthetic construct
  source 1..25: note = Seed: QTVHSIPLTINKEEALQRPVASDFE
QTVHSIPFTIIKIEAMQRPVASDFE

SEQ ID NO: 49656 - protein, 25 aa, synthetic construct
  source 1..25: note = Seed: QTVHSIPLTINKEEALQRPVASDFE
QTVHSIPFTIIKIEANQRPVASDFE

SEQ ID NO: 49657 - protein, 25 aa, synthetic construct
  source 1..25: note = Seed: QTVHSIPLTINKEEALQRPVASDFE
QTVHSIPFTIIKIEAQQRPVASDFE

SEQ ID NO: 49658 - protein, 25 aa, synthetic construct
  source 1..25: note = Seed: QTVHSIPLTINKEEALQRPVASDFE
QTVHSIPFTIIKIEARQRPVASDFE

SEQ ID NO: 49659 - protein, 25 aa, synthetic construct
  source 1..25: note = Seed: QTVHSIPLTINKEEALQRPVASDFE
QTVHSIPFTIIKIEASQRPVASDFE

SEQ ID NO: 49660 - protein, 25 aa, synthetic construct
  source 1..25: note = Seed: QTVHSIPLTINKEEALQRPVASDFE
QTVHSIPFTIIKIEATQRPVASDFE

SEQ ID NO: 49661 - protein, 25 aa, synthetic construct
  source 1..25: note = Seed: QTVHSIPLTINKEEALQRPVASDFE
QTVHSIPFTIIKIEAVQRPVASDFE

SEQ ID NO: 49662 - protein, 25 aa, synthetic construct
  source 1..25: note = Seed: QTVHSIPLTINKEEALQRPVASDFE
QTVHSIPFTIIKIEAWQRPVASDFE

SEQ ID NO: 49663 - protein, 25 aa, synthetic construct
  source 1..25: note = Seed: QTVHSIPLTINKEEALQRPVASDFE
QTVHSIPFTIIKIEAYQRPVASDFE

SEQ ID NO: 49664 - protein, 25 aa, synthetic construct
  source 1..25: note = Seed: QTVHSIPLTINKEEALQRPVASDFE
QTVHSIPFTIIKLEAAQRPVASDFE

SEQ ID NO: 49665 - protein, 25 aa, synthetic construct
  source 1..25: note = Seed: QTVHSIPLTINKEEALQRPVASDFE
QTVHSIPFTIIKLEACQRPVASDFE

SEQ ID NO: 49666 - protein, 25 aa, synthetic construct
  source 1..25: note = Seed: QTVHSIPLTINKEEALQRPVASDFE
QTVHSIPFTIIKLEADQRPVASDFE

SEQ ID NO: 49667 - protein, 25 aa, synthetic construct
  source 1..25: note = Seed: QTVHSIPLTINKEEALQRPVASDFE
QTVHSIPFTIIKLEAEQRPVASDFE

SEQ ID NO: 49668 - protein, 25 aa, synthetic construct
  source 1..25: note = Seed: QTVHSIPLTINKEEALQRPVASDFE
QTVHSIPFTIIKLEAFQRPVASDFE

SEQ ID NO: 49669 - protein, 25 aa, synthetic construct
  source 1..25: note = Seed: QTVHSIPLTINKEEALQRPVASDFE
QTVHSIPFTIIKLEAGQRPVASDFE

SEQ ID NO: 49670 - protein, 25 aa, synthetic construct
  source 1..25: note = Seed: QTVHSIPLTINKEEALQRPVASDFE
QTVHSIPFTIIKLEAHQRPVASDFE

SEQ ID NO: 49671 - protein, 25 aa, synthetic construct
  source 1..25: note = Seed: QTVHSIPLTINKEEALQRPVASDFE
QTVHSIPFTIIKLEAIQRPVASDFE

SEQ ID NO: 49672 - protein, 25 aa, synthetic construct
  source 1..25: note = Seed: QTVHSIPLTINKEEALQRPVASDFE
QTVHSIPFTIIKLEAKQRPVASDFE

SEQ ID NO: 49673 - protein, 25 aa, synthetic construct
  source 1..25: note = Seed: QTVHSIPLTINKEEALQRPVASDFE
QTVHSIPFTIIKLEALQRPVASDFE

SEQ ID NO: 49674 - protein, 25 aa, synthetic construct
  source 1..25: note = Seed: QTVHSIPLTINKEEALQRPVASDFE
QTVHSIPFTIIKLEAMQRPVASDFE

SEQ ID NO: 49675 - protein, 25 aa, synthetic construct
  source 1..25: note = Seed: QTVHSIPLTINKEEALQRPVASDFE
QTVHSIPFTIIKLEANQRPVASDFE

SEQ ID NO: 49676 - protein, 25 aa, synthetic construct
  source 1..25: note = Seed: QTVHSIPLTINKEEALQRPVASDFE
QTVHSIPFTIIKLEAPQRPVASDFE

SEQ ID NO: 49677 - protein, 25 aa, synthetic construct
  source 1..25: note = Seed: QTVHSIPLTINKEEALQRPVASDFE
QTVHSIPFTIIKLEAQQRPVASDFE

SEQ ID NO: 49678 - protein, 25 aa, synthetic construct
  source 1..25: note = Seed: QTVHSIPLTINKEEALQRPVASDFE
QTVHSIPFTIIKLEARQRPVASDFE

SEQ ID NO: 49679 - protein, 25 aa, synthetic construct
  source 1..25: note = Seed: QTVHSIPLTINKEEALQRPVASDFE
QTVHSIPFTIIKLEASQRPVASDFE

SEQ ID NO: 49680 - protein, 25 aa, synthetic construct
  source 1..25: note = Seed: QTVHSIPLTINKEEALQRPVASDFE
QTVHSIPFTIIKLEATQRPVASDFE

SEQ ID NO: 49681 - protein, 25 aa, synthetic construct
  source 1..25: note = Seed: QTVHSIPLTINKEEALQRPVASDFE
QTVHSIPFTIIKLEAVQRPVASDFE

SEQ ID NO: 49682 - protein, 25 aa, synthetic construct
  source 1..25: note = Seed: QTVHSIPLTINKEEALQRPVASDFE
QTVHSIPFTIIKLEAWQRPVASDFE

SEQ ID NO: 49683 - protein, 25 aa, synthetic construct
  source 1..25: note = Seed: QTVHSIPLTINKEEALQRPVASDFE
QTVHSIPFTIIKLEAYQRPVASDFE

SEQ ID NO: 49684 - protein, 25 aa, synthetic construct
  source 1..25: note = Seed: QTVHSIPLTINKEEALQRPVASDFE
QTVHSIPFTIIKMEAAQRPVASDFE

SEQ ID NO: 49685 - protein, 25 aa, synthetic construct
  source 1..25: note = Seed: QTVHSIPLTINKEEALQRPVASDFE
QTVHSIPFTIIKMEADQRPVASDFE

SEQ ID NO: 49686 - protein, 25 aa, synthetic construct
  source 1..25: note = Seed: QTVHSIPLTINKEEALQRPVASDFE
QTVHSIPFTIIKMEAEQRPVASDFE

SEQ ID NO: 49687 - protein, 25 aa, synthetic construct
  source 1..25: note = Seed: QTVHSIPLTINKEEALQRPVASDFE
QTVHSIPFTIIKMEAFQRPVASDFE

SEQ ID NO: 49688 - protein, 25 aa, synthetic construct
  source 1..25: note = Seed: QTVHSIPLTINKEEALQRPVASDFE
QTVHSIPFTIIKMEAIQRPVASDFE

SEQ ID NO: 49689 - protein, 25 aa, synthetic construct
  source 1..25: note = Seed: QTVHSIPLTINKEEALQRPVASDFE
QTVHSIPFTIIKMEALQRPVASDFE

SEQ ID NO: 49690 - protein, 25 aa, synthetic construct
  source 1..25: note = Seed: QTVHSIPLTINKEEALQRPVASDFE
QTVHSIPFTIIKMEAMQRPVASDFE

SEQ ID NO: 49691 - protein, 25 aa, synthetic construct
  source 1..25: note = Seed: QTVHSIPLTINKEEALQRPVASDFE
QTVHSIPFTIIKMEANQRPVASDFE

SEQ ID NO: 49692 - protein, 25 aa, synthetic construct
  source 1..25: note = Seed: QTVHSIPLTINKEEALQRPVASDFE
QTVHSIPFTIIKMEAQQRPVASDFE

SEQ ID NO: 49693 - protein, 25 aa, synthetic construct
  source 1..25: note = Seed: QTVHSIPLTINKEEALQRPVASDFE
QTVHSIPFTIIKMEARQRPVASDFE

SEQ ID NO: 49694 - protein, 25 aa, synthetic construct
  source 1..25: note = Seed: QTVHSIPLTINKEEALQRPVASDFE
QTVHSIPFTIIKMEASQRPVASDFE

SEQ ID NO: 49695 - protein, 25 aa, synthetic construct
  source 1..25: note = Seed: QTVHSIPLTINKEEALQRPVASDFE
QTVHSIPFTIIKMEATQRPVASDFE

SEQ ID NO: 49696 - protein, 25 aa, synthetic construct
  source 1..25: note = Seed: QTVHSIPLTINKEEALQRPVASDFE
QTVHSIPFTIIKMEAVQRPVASDFE

SEQ ID NO: 49697 - protein, 25 aa, synthetic construct
  source 1..25: note = Seed: QTVHSIPLTINKEEALQRPVASDFE
QTVHSIPFTIIKMEAYQRPVASDFE

SEQ ID NO: 49698 - protein, 25 aa, synthetic construct
  source 1..25: note = Seed: QTVHSIPLTINKEEALQRPVASDFE
QTVHSIPFTIIKNEAFQRPVASDFE

SEQ ID NO: 49699 - protein, 25 aa, synthetic construct
  source 1..25: note = Seed: QTVHSIPLTINKEEALQRPVASDFE
QTVHSIPFTIIKNEAIQRPVASDFE

SEQ ID NO: 49700 - protein, 25 aa, synthetic construct
  source 1..25: note = Seed: QTVHSIPLTINKEEALQRPVASDFE
QTVHSIPFTIIKNEALQRPVASDFE

SEQ ID NO: 49701 - protein, 25 aa, synthetic construct
  source 1..25: note = Seed: QTVHSIPLTINKEEALQRPVASDFE
QTVHSIPFTIIKNEAVQRPVASDFE

SEQ ID NO: 49702 - protein, 25 aa, synthetic construct
  source 1..25: note = Seed: QTVHSIPLTINKEEALQRPVASDFE
QTVHSIPFTIIKPEAFQRPVASDFE

SEQ ID NO: 49703 - protein, 25 aa, synthetic construct
  source 1..25: note = Seed: QTVHSIPLTINKEEALQRPVASDFE
QTVHSIPFTIIKPEAIQRPVASDFE

SEQ ID NO: 49704 - protein, 25 aa, synthetic construct
  source 1..25: note = Seed: QTVHSIPLTINKEEALQRPVASDFE
QTVHSIPFTIIKPEALQRPVASDFE

SEQ ID NO: 49705 - protein, 25 aa, synthetic construct
  source 1..25: note = Seed: QTVHSIPLTINKEEALQRPVASDFE
QTVHSIPFTIIKQEAFQRPVASDFE

SEQ ID NO: 49706 - protein, 25 aa, synthetic construct
  source 1..25: note = Seed: QTVHSIPLTINKEEALQRPVASDFE
QTVHSIPFTIIKQEAIQRPVASDFE

SEQ ID NO: 49707 - protein, 25 aa, synthetic construct
  source 1..25: note = Seed: QTVHSIPLTINKEEALQRPVASDFE
QTVHSIPFTIIKQEALQRPVASDFE

SEQ ID NO: 49708 - protein, 25 aa, synthetic construct
  source 1..25: note = Seed: QTVHSIPLTINKEEALQRPVASDFE
QTVHSIPFTIIKQEAVQRPVASDFE

SEQ ID NO: 49709 - protein, 25 aa, synthetic construct
  source 1..25: note = Seed: QTVHSIPLTINKEEALQRPVASDFE
QTVHSIPFTIIKREALQRPVASDFE

SEQ ID NO: 49710 - protein, 25 aa, synthetic construct
  source 1..25: note = Seed: QTVHSIPLTINKEEALQRPVASDFE
QTVHSIPFTIIKREARQRPVASDFE

SEQ ID NO: 49711 - protein, 25 aa, synthetic construct
  source 1..25: note = Seed: QTVHSIPLTINKEEALQRPVASDFE
QTVHSIPFTIIKREAYQRPVASDFE

SEQ ID NO: 49712 - protein, 25 aa, synthetic construct
  source 1..25: note = Seed: QTVHSIPLTINKEEALQRPVASDFE
QTVHSIPFTIIKSEAIQRPVASDFE

SEQ ID NO: 49713 - protein, 25 aa, synthetic construct
  source 1..25: note = Seed: QTVHSIPLTINKEEALQRPVASDFE
QTVHSIPFTIIKSEALQRPVASDFE

SEQ ID NO: 49714 - protein, 25 aa, synthetic construct
  source 1..25: note = Seed: QTVHSIPLTINKEEALQRPVASDFE
QTVHSIPFTIIKSEAMQRPVASDFE

SEQ ID NO: 49715 - protein, 25 aa, synthetic construct
  source 1..25: note = Seed: QTVHSIPLTINKEEALQRPVASDFE
QTVHSIPFTIIKSEAVQRPVASDFE

SEQ ID NO: 49716 - protein, 25 aa, synthetic construct
  source 1..25: note = Seed: QTVHSIPLTINKEEALQRPVASDFE
QTVHSIPFTIIKSEAYQRPVASDFE

SEQ ID NO: 49717 - protein, 25 aa, synthetic construct
  source 1..25: note = Seed: QTVHSIPLTINKEEALQRPVASDFE
QTVHSIPFTIIKTEAIQRPVASDFE

SEQ ID NO: 49718 - protein, 25 aa, synthetic construct
  source 1..25: note = Seed: QTVHSIPLTINKEEALQRPVASDFE
QTVHSIPFTIIKTEALQRPVASDFE

SEQ ID NO: 49719 - protein, 25 aa, synthetic construct
  source 1..25: note = Seed: QTVHSIPLTINKEEALQRPVASDFE
QTVHSIPFTIIKTEAMQRPVASDFE

SEQ ID NO: 49720 - protein, 25 aa, synthetic construct
  source 1..25: note = Seed: QTVHSIPLTINKEEALQRPVASDFE
QTVHSIPFTIIKTEAVQRPVASDFE

SEQ ID NO: 49721 - protein, 25 aa, synthetic construct
  source 1..25: note = Seed: QTVHSIPLTINKEEALQRPVASDFE
QTVHSIPFTIIKTEAYQRPVASDFE

SEQ ID NO: 49722 - protein, 25 aa, synthetic construct
  source 1..25: note = Seed: QTVHSIPLTINKEEALQRPVASDFE
QTVHSIPFTIIKVEAAQRPVASDFE

SEQ ID NO: 49723 - protein, 25 aa, synthetic construct
  source 1..25: note = Seed: QTVHSIPLTINKEEALQRPVASDFE
QTVHSIPFTIIKVEADQRPVASDFE

SEQ ID NO: 49724 - protein, 25 aa, synthetic construct
  source 1..25: note = Seed: QTVHSIPLTINKEEALQRPVASDFE
QTVHSIPFTIIKVEAEQRPVASDFE

SEQ ID NO: 49725 - protein, 25 aa, synthetic construct
  source 1..25: note = Seed: QTVHSIPLTINKEEALQRPVASDFE
QTVHSIPFTIIKVEAFQRPVASDFE

SEQ ID NO: 49726 - protein, 25 aa, synthetic construct
  source 1..25: note = Seed: QTVHSIPLTINKEEALQRPVASDFE
QTVHSIPFTIIKVEAIQRPVASDFE

SEQ ID NO: 49727 - protein, 25 aa, synthetic construct
  source 1..25: note = Seed: QTVHSIPLTINKEEALQRPVASDFE
QTVHSIPFTIIKVEALQRPVASDFE

SEQ ID NO: 49728 - protein, 25 aa, synthetic construct
  source 1..25: note = Seed: QTVHSIPLTINKEEALQRPVASDFE
QTVHSIPFTIIKVEAMQRPVASDFE

SEQ ID NO: 49729 - protein, 25 aa, synthetic construct
  source 1..25: note = Seed: QTVHSIPLTINKEEALQRPVASDFE
QTVHSIPFTIIKVEANQRPVASDFE

SEQ ID NO: 49730 - protein, 25 aa, synthetic construct
  source 1..25: note = Seed: QTVHSIPLTINKEEALQRPVASDFE
QTVHSIPFTIIKVEAQQRPVASDFE

SEQ ID NO: 49731 - protein, 25 aa, synthetic construct
  source 1..25: note = Seed: QTVHSIPLTINKEEALQRPVASDFE
QTVHSIPFTIIKVEARQRPVASDFE

SEQ ID NO: 49732 - protein, 25 aa, synthetic construct
  source 1..25: note = Seed: QTVHSIPLTINKEEALQRPVASDFE
QTVHSIPFTIIKVEASQRPVASDFE

SEQ ID NO: 49733 - protein, 25 aa, synthetic construct
  source 1..25: note = Seed: QTVHSIPLTINKEEALQRPVASDFE
QTVHSIPFTIIKVEATQRPVASDFE

SEQ ID NO: 49734 - protein, 25 aa, synthetic construct
  source 1..25: note = Seed: QTVHSIPLTINKEEALQRPVASDFE
QTVHSIPFTIIKVEAVQRPVASDFE

SEQ ID NO: 49735 - protein, 25 aa, synthetic construct
  source 1..25: note = Seed: QTVHSIPLTINKEEALQRPVASDFE
QTVHSIPFTIIKVEAWQRPVASDFE

SEQ ID NO: 49736 - protein, 25 aa, synthetic construct
  source 1..25: note = Seed: QTVHSIPLTINKEEALQRPVASDFE
QTVHSIPFTIIKVEAYQRPVASDFE

SEQ ID NO: 49737 - protein, 25 aa, synthetic construct
  source 1..25: note = Seed: QTVHSIPLTINKEEALQRPVASDFE
QTVHSIPFTIIKWEAAQRPVASDFE

SEQ ID NO: 49738 - protein, 25 aa, synthetic construct
  source 1..25: note = Seed: QTVHSIPLTINKEEALQRPVASDFE
QTVHSIPFTIIKWEADQRPVASDFE

SEQ ID NO: 49739 - protein, 25 aa, synthetic construct
  source 1..25: note = Seed: QTVHSIPLTINKEEALQRPVASDFE
QTVHSIPFTIIKWEAEQRPVASDFE

SEQ ID NO: 49740 - protein, 25 aa, synthetic construct
  source 1..25: note = Seed: QTVHSIPLTINKEEALQRPVASDFE
QTVHSIPFTIIKWEAFQRPVASDFE

SEQ ID NO: 49741 - protein, 25 aa, synthetic construct
  source 1..25: note = Seed: QTVHSIPLTINKEEALQRPVASDFE
QTVHSIPFTIIKWEAHQRPVASDFE

SEQ ID NO: 49742 - protein, 25 aa, synthetic construct
  source 1..25: note = Seed: QTVHSIPLTINKEEALQRPVASDFE
QTVHSIPFTIIKWEAIQRPVASDFE

SEQ ID NO: 49743 - protein, 25 aa, synthetic construct
  source 1..25: note = Seed: QTVHSIPLTINKEEALQRPVASDFE
QTVHSIPFTIIKWEALQRPVASDFE

SEQ ID NO: 49744 - protein, 25 aa, synthetic construct
  source 1..25: note = Seed: QTVHSIPLTINKEEALQRPVASDFE
QTVHSIPFTIIKWEAMQRPVASDFE

SEQ ID NO: 49745 - protein, 25 aa, synthetic construct
  source 1..25: note = Seed: QTVHSIPLTINKEEALQRPVASDFE
QTVHSIPFTIIKWEANQRPVASDFE

SEQ ID NO: 49746 - protein, 25 aa, synthetic construct
  source 1..25: note = Seed: QTVHSIPLTINKEEALQRPVASDFE
QTVHSIPFTIIKWEAPQRPVASDFE

SEQ ID NO: 49747 - protein, 25 aa, synthetic construct
  source 1..25: note = Seed: QTVHSIPLTINKEEALQRPVASDFE
QTVHSIPFTIIKWEAQQRPVASDFE

SEQ ID NO: 49748 - protein, 25 aa, synthetic construct
  source 1..25: note = Seed: QTVHSIPLTINKEEALQRPVASDFE
QTVHSIPFTIIKWEARQRPVASDFE

SEQ ID NO: 49749 - protein, 25 aa, synthetic construct
  source 1..25: note = Seed: QTVHSIPLTINKEEALQRPVASDFE
QTVHSIPFTIIKWEASQRPVASDFE

SEQ ID NO: 49750 - protein, 25 aa, synthetic construct
  source 1..25: note = Seed: QTVHSIPLTINKEEALQRPVASDFE
QTVHSIPFTIIKWEATQRPVASDFE

SEQ ID NO: 49751 - protein, 25 aa, synthetic construct
  source 1..25: note = Seed: QTVHSIPLTINKEEALQRPVASDFE
QTVHSIPFTIIKWEAVQRPVASDFE

SEQ ID NO: 49752 - protein, 25 aa, synthetic construct
  source 1..25: note = Seed: QTVHSIPLTINKEEALQRPVASDFE
QTVHSIPFTIIKWEAYQRPVASDFE

SEQ ID NO: 49753 - protein, 25 aa, synthetic construct
  source 1..25: note = Seed: QTVHSIPLTINKEEALQRPVASDFE
QTVHSIPFTIIKYEAAQRPVASDFE

SEQ ID NO: 49754 - protein, 25 aa, synthetic construct
  source 1..25: note = Seed: QTVHSIPLTINKEEALQRPVASDFE
QTVHSIPFTIIKYEACQRPVASDFE

SEQ ID NO: 49755 - protein, 25 aa, synthetic construct
  source 1..25: note = Seed: QTVHSIPLTINKEEALQRPVASDFE
QTVHSIPFTIIKYEADQRPVASDFE

SEQ ID NO: 49756 - protein, 25 aa, synthetic construct
  source 1..25: note = Seed: QTVHSIPLTINKEEALQRPVASDFE
QTVHSIPFTIIKYEAEQRPVASDFE

SEQ ID NO: 49757 - protein, 25 aa, synthetic construct
  source 1..25: note = Seed: QTVHSIPLTINKEEALQRPVASDFE
QTVHSIPFTIIKYEAFQRPVASDFE

SEQ ID NO: 49758 - protein, 25 aa, synthetic construct
  source 1..25: note = Seed: QTVHSIPLTINKEEALQRPVASDFE
QTVHSIPFTIIKYEAGQRPVASDFE

SEQ ID NO: 49759 - protein, 25 aa, synthetic construct
  source 1..25: note = Seed: QTVHSIPLTINKEEALQRPVASDFE
QTVHSIPFTIIKYEAHQRPVASDFE

SEQ ID NO: 49760 - protein, 25 aa, synthetic construct
  source 1..25: note = Seed: QTVHSIPLTINKEEALQRPVASDFE
QTVHSIPFTIIKYEAIQRPVASDFE

SEQ ID NO: 49761 - protein, 25 aa, synthetic construct
  source 1..25: note = Seed: QTVHSIPLTINKEEALQRPVASDFE
QTVHSIPFTIIKYEALQRPVASDFE

SEQ ID NO: 49762 - protein, 25 aa, synthetic construct
  source 1..25: note = Seed: QTVHSIPLTINKEEALQRPVASDFE
QTVHSIPFTIIKYEAMQRPVASDFE

SEQ ID NO: 49763 - protein, 25 aa, synthetic construct
  source 1..25: note = Seed: QTVHSIPLTINKEEALQRPVASDFE
QTVHSIPFTIIKYEANQRPVASDFE

SEQ ID NO: 49764 - protein, 25 aa, synthetic construct
  source 1..25: note = Seed: QTVHSIPLTINKEEALQRPVASDFE
QTVHSIPFTIIKYEAPQRPVASDFE

SEQ ID NO: 49765 - protein, 25 aa, synthetic construct
  source 1..25: note = Seed: QTVHSIPLTINKEEALQRPVASDFE
QTVHSIPFTIIKYEAQQRPVASDFE

SEQ ID NO: 49766 - protein, 25 aa, synthetic construct
  source 1..25: note = Seed: QTVHSIPLTINKEEALQRPVASDFE
QTVHSIPFTIIKYEARQRPVASDFE

SEQ ID NO: 49767 - protein, 25 aa, synthetic construct
  source 1..25: note = Seed: QTVHSIPLTINKEEALQRPVASDFE
QTVHSIPFTIIKYEASQRPVASDFE

SEQ ID NO: 49768 - protein, 25 aa, synthetic construct
  source 1..25: note = Seed: QTVHSIPLTINKEEALQRPVASDFE
QTVHSIPFTIIKYEATQRPVASDFE

SEQ ID NO: 49769 - protein, 25 aa, synthetic construct
  source 1..25: note = Seed: QTVHSIPLTINKEEALQRPVASDFE
QTVHSIPFTIIKYEAVQRPVASDFE

SEQ ID NO: 49770 - protein, 25 aa, synthetic construct
  source 1..25: note = Seed: QTVHSIPLTINKEEALQRPVASDFE
QTVHSIPFTIIKYEAWQRPVASDFE

SEQ ID NO: 49771 - protein, 25 aa, synthetic construct
  source 1..25: note = Seed: QTVHSIPLTINKEEALQRPVASDFE
QTVHSIPFTIIKYEAYQRPVASDFE

SEQ ID NO: 49772 - protein, 25 aa, synthetic construct
  source 1..25: note = Seed: QTVHSIPLTINKEEALQRPVASDFE
QTVHSIPFTIKKFEAFQRPVASDFE

SEQ ID NO: 49773 - protein, 25 aa, synthetic construct
  source 1..25: note = Seed: QTVHSIPLTINKEEALQRPVASDFE
QTVHSIPFTIKKFEAIQRPVASDFE

SEQ ID NO: 49774 - protein, 25 aa, synthetic construct
  source 1..25: note = Seed: QTVHSIPLTINKEEALQRPVASDFE
QTVHSIPFTIKKFEALQRPVASDFE

SEQ ID NO: 49775 - protein, 25 aa, synthetic construct
  source 1..25: note = Seed: QTVHSIPLTINKEEALQRPVASDFE
QTVHSIPFTIKKFEAMQRPVASDFE

SEQ ID NO: 49776 - protein, 25 aa, synthetic construct
  source 1..25: note = Seed: QTVHSIPLTINKEEALQRPVASDFE
QTVHSIPFTIKKFEAVQRPVASDFE

SEQ ID NO: 49777 - protein, 25 aa, synthetic construct
  source 1..25: note = Seed: QTVHSIPLTINKEEALQRPVASDFE
QTVHSIPFTILKAEAAQRPVASDFE

SEQ ID NO: 49778 - protein, 25 aa, synthetic construct
  source 1..25: note = Seed: QTVHSIPLTINKEEALQRPVASDFE
QTVHSIPFTILKAEAFQRPVASDFE

SEQ ID NO: 49779 - protein, 25 aa, synthetic construct
  source 1..25: note = Seed: QTVHSIPLTINKEEALQRPVASDFE
QTVHSIPFTILKAEAIQRPVASDFE

SEQ ID NO: 49780 - protein, 25 aa, synthetic construct
  source 1..25: note = Seed: QTVHSIPLTINKEEALQRPVASDFE
QTVHSIPFTILKAEALQRPVASDFE

SEQ ID NO: 49781 - protein, 25 aa, synthetic construct
  source 1..25: note = Seed: QTVHSIPLTINKEEALQRPVASDFE
QTVHSIPFTILKAEAMQRPVASDFE

SEQ ID NO: 49782 - protein, 25 aa, synthetic construct
  source 1..25: note = Seed: QTVHSIPLTINKEEALQRPVASDFE
QTVHSIPFTILKAEAVQRPVASDFE

SEQ ID NO: 49783 - protein, 25 aa, synthetic construct
  source 1..25: note = Seed: QTVHSIPLTINKEEALQRPVASDFE
QTVHSIPFTILKAEAYQRPVASDFE

SEQ ID NO: 49784 - protein, 25 aa, synthetic construct
  source 1..25: note = Seed: QTVHSIPLTINKEEALQRPVASDFE
QTVHSIPFTILKEEAFQRPVASDFE

SEQ ID NO: 49785 - protein, 25 aa, synthetic construct
  source 1..25: note = Seed: QTVHSIPLTINKEEALQRPVASDFE
QTVHSIPFTILKEEAIQRPVASDFE

SEQ ID NO: 49786 - protein, 25 aa, synthetic construct
  source 1..25: note = Seed: QTVHSIPLTINKEEALQRPVASDFE
QTVHSIPFTILKEEALQRPVASDFE

SEQ ID NO: 49787 - protein, 25 aa, synthetic construct
  source 1..25: note = Seed: QTVHSIPLTINKEEALQRPVASDFE
QTVHSIPFTILKFEAAQRPVASDFE

SEQ ID NO: 49788 - protein, 25 aa, synthetic construct
  source 1..25: note = Seed: QTVHSIPLTINKEEALQRPVASDFE
QTVHSIPFTILKFEACQRPVASDFE

SEQ ID NO: 49789 - protein, 25 aa, synthetic construct
  source 1..25: note = Seed: QTVHSIPLTINKEEALQRPVASDFE
QTVHSIPFTILKFEADQRPVASDFE

SEQ ID NO: 49790 - protein, 25 aa, synthetic construct
  source 1..25: note = Seed: QTVHSIPLTINKEEALQRPVASDFE
QTVHSIPFTILKFEAEQRPVASDFE

SEQ ID NO: 49791 - protein, 25 aa, synthetic construct
  source 1..25: note = Seed: QTVHSIPLTINKEEALQRPVASDFE
QTVHSIPFTILKFEAFQRPVASDFE

SEQ ID NO: 49792 - protein, 25 aa, synthetic construct
  source 1..25: note = Seed: QTVHSIPLTINKEEALQRPVASDFE
QTVHSIPFTILKFEAGQRPVASDFE

SEQ ID NO: 49793 - protein, 25 aa, synthetic construct
  source 1..25: note = Seed: QTVHSIPLTINKEEALQRPVASDFE
QTVHSIPFTILKFEAHQRPVASDFE

SEQ ID NO: 49794 - protein, 25 aa, synthetic construct
  source 1..25: note = Seed: QTVHSIPLTINKEEALQRPVASDFE
QTVHSIPFTILKFEAIQRPVASDFE

SEQ ID NO: 49795 - protein, 25 aa, synthetic construct
  source 1..25: note = Seed: QTVHSIPLTINKEEALQRPVASDFE
QTVHSIPFTILKFEAKQRPVASDFE

SEQ ID NO: 49796 - protein, 25 aa, synthetic construct
  source 1..25: note = Seed: QTVHSIPLTINKEEALQRPVASDFE
QTVHSIPFTILKFEALQRPVASDFE

SEQ ID NO: 49797 - protein, 25 aa, synthetic construct
  source 1..25: note = Seed: QTVHSIPLTINKEEALQRPVASDFE
QTVHSIPFTILKFEAMQRPVASDFE

SEQ ID NO: 49798 - protein, 25 aa, synthetic construct
  source 1..25: note = Seed: QTVHSIPLTINKEEALQRPVASDFE
QTVHSIPFTILKFEANQRPVASDFE

SEQ ID NO: 49799 - protein, 25 aa, synthetic construct
  source 1..25: note = Seed: QTVHSIPLTINKEEALQRPVASDFE
QTVHSIPFTILKFEAPQRPVASDFE

SEQ ID NO: 49800 - protein, 25 aa, synthetic construct
  source 1..25: note = Seed: QTVHSIPLTINKEEALQRPVASDFE
QTVHSIPFTILKFEAQQRPVASDFE

SEQ ID NO: 49801 - protein, 25 aa, synthetic construct
  source 1..25: note = Seed: QTVHSIPLTINKEEALQRPVASDFE
QTVHSIPFTILKFEARQRPVASDFE

SEQ ID NO: 49802 - protein, 25 aa, synthetic construct
  source 1..25: note = Seed: QTVHSIPLTINKEEALQRPVASDFE
QTVHSIPFTILKFEASQRPVASDFE

SEQ ID NO: 49803 - protein, 25 aa, synthetic construct
  source 1..25: note = Seed: QTVHSIPLTINKEEALQRPVASDFE
QTVHSIPFTILKFEATQRPVASDFE

SEQ ID NO: 49804 - protein, 25 aa, synthetic construct
  source 1..25: note = Seed: QTVHSIPLTINKEEALQRPVASDFE
QTVHSIPFTILKFEAVQRPVASDFE

SEQ ID NO: 49805 - protein, 25 aa, synthetic construct
  source 1..25: note = Seed: QTVHSIPLTINKEEALQRPVASDFE
QTVHSIPFTILKFEAWQRPVASDFE

SEQ ID NO: 49806 - protein, 25 aa, synthetic construct
  source 1..25: note = Seed: QTVHSIPLTINKEEALQRPVASDFE
QTVHSIPFTILKFEAYQRPVASDFE

SEQ ID NO: 49807 - protein, 25 aa, synthetic construct
  source 1..25: note = Seed: QTVHSIPLTINKEEALQRPVASDFE
QTVHSIPFTILKGEAFQRPVASDFE

SEQ ID NO: 49808 - protein, 25 aa, synthetic construct
  source 1..25: note = Seed: QTVHSIPLTINKEEALQRPVASDFE
QTVHSIPFTILKGEALQRPVASDFE

SEQ ID NO: 49809 - protein, 25 aa, synthetic construct
  source 1..25: note = Seed: QTVHSIPLTINKEEALQRPVASDFE
QTVHSIPFTILKHEAFQRPVASDFE

SEQ ID NO: 49810 - protein, 25 aa, synthetic construct
  source 1..25: note = Seed: QTVHSIPLTINKEEALQRPVASDFE
QTVHSIPFTILKHEAIQRPVASDFE

SEQ ID NO: 49811 - protein, 25 aa, synthetic construct
  source 1..25: note = Seed: QTVHSIPLTINKEEALQRPVASDFE
QTVHSIPFTILKHEALQRPVASDFE

SEQ ID NO: 49812 - protein, 25 aa, synthetic construct
  source 1..25: note = Seed: QTVHSIPLTINKEEALQRPVASDFE
QTVHSIPFTILKHEAMQRPVASDFE

SEQ ID NO: 49813 - protein, 25 aa, synthetic construct
  source 1..25: note = Seed: QTVHSIPLTINKEEALQRPVASDFE
QTVHSIPFTILKHEAVQRPVASDFE

SEQ ID NO: 49814 - protein, 25 aa, synthetic construct
  source 1..25: note = Seed: QTVHSIPLTINKEEALQRPVASDFE
QTVHSIPFTILKHEAYQRPVASDFE

SEQ ID NO: 49815 - protein, 25 aa, synthetic construct
  source 1..25: note = Seed: QTVHSIPLTINKEEALQRPVASDFE
QTVHSIPFTILKIEAAQRPVASDFE

SEQ ID NO: 49816 - protein, 25 aa, synthetic construct
  source 1..25: note = Seed: QTVHSIPLTINKEEALQRPVASDFE
QTVHSIPFTILKIEADQRPVASDFE

SEQ ID NO: 49817 - protein, 25 aa, synthetic construct
  source 1..25: note = Seed: QTVHSIPLTINKEEALQRPVASDFE
QTVHSIPFTILKIEAEQRPVASDFE

SEQ ID NO: 49818 - protein, 25 aa, synthetic construct
  source 1..25: note = Seed: QTVHSIPLTINKEEALQRPVASDFE
QTVHSIPFTILKIEAFQRPVASDFE

SEQ ID NO: 49819 - protein, 25 aa, synthetic construct
  source 1..25: note = Seed: QTVHSIPLTINKEEALQRPVASDFE
QTVHSIPFTILKIEAGQRPVASDFE

SEQ ID NO: 49820 - protein, 25 aa, synthetic construct
  source 1..25: note = Seed: QTVHSIPLTINKEEALQRPVASDFE
QTVHSIPFTILKIEAHQRPVASDFE

SEQ ID NO: 49821 - protein, 25 aa, synthetic construct
  source 1..25: note = Seed: QTVHSIPLTINKEEALQRPVASDFE
QTVHSIPFTILKIEAIQRPVASDFE

SEQ ID NO: 49822 - protein, 25 aa, synthetic construct
  source 1..25: note = Seed: QTVHSIPLTINKEEALQRPVASDFE
QTVHSIPFTILKIEAKQRPVASDFE

SEQ ID NO: 49823 - protein, 25 aa, synthetic construct
  source 1..25: note = Seed: QTVHSIPLTINKEEALQRPVASDFE
QTVHSIPFTILKIEALQRPVASDFE

SEQ ID NO: 49824 - protein, 25 aa, synthetic construct
  source 1..25: note = Seed: QTVHSIPLTINKEEALQRPVASDFE
QTVHSIPFTILKIEAMQRPVASDFE

SEQ ID NO: 49825 - protein, 25 aa, synthetic construct
  source 1..25: note = Seed: QTVHSIPLTINKEEALQRPVASDFE
QTVHSIPFTILKIEANQRPVASDFE

SEQ ID NO: 49826 - protein, 25 aa, synthetic construct
  source 1..25: note = Seed: QTVHSIPLTINKEEALQRPVASDFE
QTVHSIPFTILKIEAQQRPVASDFE

SEQ ID NO: 49827 - protein, 25 aa, synthetic construct
  source 1..25: note = Seed: QTVHSIPLTINKEEALQRPVASDFE
QTVHSIPFTILKIEARQRPVASDFE

SEQ ID NO: 49828 - protein, 25 aa, synthetic construct
  source 1..25: note = Seed: QTVHSIPLTINKEEALQRPVASDFE
QTVHSIPFTILKIEASQRPVASDFE

SEQ ID NO: 49829 - protein, 25 aa, synthetic construct
  source 1..25: note = Seed: QTVHSIPLTINKEEALQRPVASDFE
QTVHSIPFTILKIEATQRPVASDFE

SEQ ID NO: 49830 - protein, 25 aa, synthetic construct
  source 1..25: note = Seed: QTVHSIPLTINKEEALQRPVASDFE
QTVHSIPFTILKIEAVQRPVASDFE

SEQ ID NO: 49831 - protein, 25 aa, synthetic construct
  source 1..25: note = Seed: QTVHSIPLTINKEEALQRPVASDFE
QTVHSIPFTILKIEAYQRPVASDFE

SEQ ID NO: 49832 - protein, 25 aa, synthetic construct
  source 1..25: note = Seed: QTVHSIPLTINKEEALQRPVASDFE
QTVHSIPFTILKLEAAQRPVASDFE

SEQ ID NO: 49833 - protein, 25 aa, synthetic construct
  source 1..25: note = Seed: QTVHSIPLTINKEEALQRPVASDFE
QTVHSIPFTILKLEADQRPVASDFE

SEQ ID NO: 49834 - protein, 25 aa, synthetic construct
  source 1..25: note = Seed: QTVHSIPLTINKEEALQRPVASDFE
QTVHSIPFTILKLEAEQRPVASDFE

SEQ ID NO: 49835 - protein, 25 aa, synthetic construct
  source 1..25: note = Seed: QTVHSIPLTINKEEALQRPVASDFE
QTVHSIPFTILKLEAFQRPVASDFE

SEQ ID NO: 49836 - protein, 25 aa, synthetic construct
  source 1..25: note = Seed: QTVHSIPLTINKEEALQRPVASDFE
QTVHSIPFTILKLEAGQRPVASDFE

SEQ ID NO: 49837 - protein, 25 aa, synthetic construct
  source 1..25: note = Seed: QTVHSIPLTINKEEALQRPVASDFE
QTVHSIPFTILKLEAHQRPVASDFE

SEQ ID NO: 49838 - protein, 25 aa, synthetic construct
  source 1..25: note = Seed: QTVHSIPLTINKEEALQRPVASDFE
QTVHSIPFTILKLEAIQRPVASDFE

SEQ ID NO: 49839 - protein, 25 aa, synthetic construct
  source 1..25: note = Seed: QTVHSIPLTINKEEALQRPVASDFE
QTVHSIPFTILKLEAKQRPVASDFE

SEQ ID NO: 49840 - protein, 25 aa, synthetic construct
  source 1..25: note = Seed: QTVHSIPLTINKEEALQRPVASDFE
QTVHSIPFTILKLEALQRPVASDFE

SEQ ID NO: 49841 - protein, 25 aa, synthetic construct
  source 1..25: note = Seed: QTVHSIPLTINKEEALQRPVASDFE
QTVHSIPFTILKLEAMQRPVASDFE

SEQ ID NO: 49842 - protein, 25 aa, synthetic construct
  source 1..25: note = Seed: QTVHSIPLTINKEEALQRPVASDFE
QTVHSIPFTILKLEANQRPVASDFE

SEQ ID NO: 49843 - protein, 25 aa, synthetic construct
  source 1..25: note = Seed: QTVHSIPLTINKEEALQRPVASDFE
QTVHSIPFTILKLEAPQRPVASDFE

SEQ ID NO: 49844 - protein, 25 aa, synthetic construct
  source 1..25: note = Seed: QTVHSIPLTINKEEALQRPVASDFE
QTVHSIPFTILKLEAQQRPVASDFE

SEQ ID NO: 49845 - protein, 25 aa, synthetic construct
  source 1..25: note = Seed: QTVHSIPLTINKEEALQRPVASDFE
QTVHSIPFTILKLEARQRPVASDFE

SEQ ID NO: 49846 - protein, 25 aa, synthetic construct
  source 1..25: note = Seed: QTVHSIPLTINKEEALQRPVASDFE
QTVHSIPFTILKLEASQRPVASDFE

SEQ ID NO: 49847 - protein, 25 aa, synthetic construct
  source 1..25: note = Seed: QTVHSIPLTINKEEALQRPVASDFE
QTVHSIPFTILKLEATQRPVASDFE

SEQ ID NO: 49848 - protein, 25 aa, synthetic construct
  source 1..25: note = Seed: QTVHSIPLTINKEEALQRPVASDFE
QTVHSIPFTILKLEAVQRPVASDFE

SEQ ID NO: 49849 - protein, 25 aa, synthetic construct
  source 1..25: note = Seed: QTVHSIPLTINKEEALQRPVASDFE
QTVHSIPFTILKLEAWQRPVASDFE

SEQ ID NO: 49850 - protein, 25 aa, synthetic construct
  source 1..25: note = Seed: QTVHSIPLTINKEEALQRPVASDFE
QTVHSIPFTILKLEAYQRPVASDFE

SEQ ID NO: 49851 - protein, 25 aa, synthetic construct
  source 1..25: note = Seed: QTVHSIPLTINKEEALQRPVASDFE
QTVHSIPFTILKMEAAQRPVASDFE

SEQ ID NO: 49852 - protein, 25 aa, synthetic construct
  source 1..25: note = Seed: QTVHSIPLTINKEEALQRPVASDFE
QTVHSIPFTILKMEADQRPVASDFE

SEQ ID NO: 49853 - protein, 25 aa, synthetic construct
  source 1..25: note = Seed: QTVHSIPLTINKEEALQRPVASDFE
QTVHSIPFTILKMEAEQRPVASDFE

SEQ ID NO: 49854 - protein, 25 aa, synthetic construct
  source 1..25: note = Seed: QTVHSIPLTINKEEALQRPVASDFE
QTVHSIPFTILKMEAFQRPVASDFE

SEQ ID NO: 49855 - protein, 25 aa, synthetic construct
  source 1..25: note = Seed: QTVHSIPLTINKEEALQRPVASDFE
QTVHSIPFTILKMEAIQRPVASDFE

SEQ ID NO: 49856 - protein, 25 aa, synthetic construct
  source 1..25: note = Seed: QTVHSIPLTINKEEALQRPVASDFE
QTVHSIPFTILKMEALQRPVASDFE

SEQ ID NO: 49857 - protein, 25 aa, synthetic construct
  source 1..25: note = Seed: QTVHSIPLTINKEEALQRPVASDFE
QTVHSIPFTILKMEAMQRPVASDFE

SEQ ID NO: 49858 - protein, 25 aa, synthetic construct
  source 1..25: note = Seed: QTVHSIPLTINKEEALQRPVASDFE
QTVHSIPFTILKMEANQRPVASDFE

SEQ ID NO: 49859 - protein, 25 aa, synthetic construct
  source 1..25: note = Seed: QTVHSIPLTINKEEALQRPVASDFE
QTVHSIPFTILKMEARQRPVASDFE

SEQ ID NO: 49860 - protein, 25 aa, synthetic construct
  source 1..25: note = Seed: QTVHSIPLTINKEEALQRPVASDFE
QTVHSIPFTILKMEASQRPVASDFE

SEQ ID NO: 49861 - protein, 25 aa, synthetic construct
  source 1..25: note = Seed: QTVHSIPLTINKEEALQRPVASDFE
QTVHSIPFTILKMEATQRPVASDFE

SEQ ID NO: 49862 - protein, 25 aa, synthetic construct
  source 1..25: note = Seed: QTVHSIPLTINKEEALQRPVASDFE
QTVHSIPFTILKMEAVQRPVASDFE

SEQ ID NO: 49863 - protein, 25 aa, synthetic construct
  source 1..25: note = Seed: QTVHSIPLTINKEEALQRPVASDFE
QTVHSIPFTILKMEAYQRPVASDFE

SEQ ID NO: 49864 - protein, 25 aa, synthetic construct
  source 1..25: note = Seed: QTVHSIPLTINKEEALQRPVASDFE
QTVHSIPFTILKNEALQRPVASDFE

SEQ ID NO: 49865 - protein, 25 aa, synthetic construct
  source 1..25: note = Seed: QTVHSIPLTINKEEALQRPVASDFE
QTVHSIPFTILKPEAFQRPVASDFE

SEQ ID NO: 49866 - protein, 25 aa, synthetic construct
  source 1..25: note = Seed: QTVHSIPLTINKEEALQRPVASDFE
QTVHSIPFTILKPEALQRPVASDFE

SEQ ID NO: 49867 - protein, 25 aa, synthetic construct
  source 1..25: note = Seed: QTVHSIPLTINKEEALQRPVASDFE
QTVHSIPFTILKQEAFQRPVASDFE

SEQ ID NO: 49868 - protein, 25 aa, synthetic construct
  source 1..25: note = Seed: QTVHSIPLTINKEEALQRPVASDFE
QTVHSIPFTILKQEALQRPVASDFE

SEQ ID NO: 49869 - protein, 25 aa, synthetic construct
  source 1..25: note = Seed: QTVHSIPLTINKEEALQRPVASDFE
QTVHSIPFTILKQEAVQRPVASDFE

SEQ ID NO: 49870 - protein, 25 aa, synthetic construct
  source 1..25: note = Seed: QTVHSIPLTINKEEALQRPVASDFE
QTVHSIPFTILKQEAYQRPVASDFE

SEQ ID NO: 49871 - protein, 25 aa, synthetic construct
  source 1..25: note = Seed: QTVHSIPLTINKEEALQRPVASDFE
QTVHSIPFTILKSEAFQRPVASDFE

SEQ ID NO: 49872 - protein, 25 aa, synthetic construct
  source 1..25: note = Seed: QTVHSIPLTINKEEALQRPVASDFE
QTVHSIPFTILKSEAIQRPVASDFE

SEQ ID NO: 49873 - protein, 25 aa, synthetic construct
  source 1..25: note = Seed: QTVHSIPLTINKEEALQRPVASDFE
QTVHSIPFTILKSEALQRPVASDFE

SEQ ID NO: 49874 - protein, 25 aa, synthetic construct
  source 1..25: note = Seed: QTVHSIPLTINKEEALQRPVASDFE
QTVHSIPFTILKSEAMQRPVASDFE

SEQ ID NO: 49875 - protein, 25 aa, synthetic construct
  source 1..25: note = Seed: QTVHSIPLTINKEEALQRPVASDFE
QTVHSIPFTILKSEAVQRPVASDFE

SEQ ID NO: 49876 - protein, 25 aa, synthetic construct
  source 1..25: note = Seed: QTVHSIPLTINKEEALQRPVASDFE
QTVHSIPFTILKSEAYQRPVASDFE

SEQ ID NO: 49877 - protein, 25 aa, synthetic construct
  source 1..25: note = Seed: QTVHSIPLTINKEEALQRPVASDFE
QTVHSIPFTILKTEAIQRPVASDFE

SEQ ID NO: 49878 - protein, 25 aa, synthetic construct
  source 1..25: note = Seed: QTVHSIPLTINKEEALQRPVASDFE
QTVHSIPFTILKTEALQRPVASDFE

SEQ ID NO: 49879 - protein, 25 aa, synthetic construct
  source 1..25: note = Seed: QTVHSIPLTINKEEALQRPVASDFE
QTVHSIPFTILKTEAMQRPVASDFE

SEQ ID NO: 49880 - protein, 25 aa, synthetic construct
  source 1..25: note = Seed: QTVHSIPLTINKEEALQRPVASDFE
QTVHSIPFTILKTEAVQRPVASDFE

SEQ ID NO: 49881 - protein, 25 aa, synthetic construct
  source 1..25: note = Seed: QTVHSIPLTINKEEALQRPVASDFE
QTVHSIPFTILKTEAYQRPVASDFE

SEQ ID NO: 49882 - protein, 25 aa, synthetic construct
  source 1..25: note = Seed: QTVHSIPLTINKEEALQRPVASDFE
QTVHSIPFTILKVEAAQRPVASDFE

SEQ ID NO: 49883 - protein, 25 aa, synthetic construct
  source 1..25: note = Seed: QTVHSIPLTINKEEALQRPVASDFE
QTVHSIPFTILKVEADQRPVASDFE

SEQ ID NO: 49884 - protein, 25 aa, synthetic construct
  source 1..25: note = Seed: QTVHSIPLTINKEEALQRPVASDFE
QTVHSIPFTILKVEAEQRPVASDFE

SEQ ID NO: 49885 - protein, 25 aa, synthetic construct
  source 1..25: note = Seed: QTVHSIPLTINKEEALQRPVASDFE
QTVHSIPFTILKVEAFQRPVASDFE

SEQ ID NO: 49886 - protein, 25 aa, synthetic construct
  source 1..25: note = Seed: QTVHSIPLTINKEEALQRPVASDFE
QTVHSIPFTILKVEAIQRPVASDFE

SEQ ID NO: 49887 - protein, 25 aa, synthetic construct
  source 1..25: note = Seed: QTVHSIPLTINKEEALQRPVASDFE
QTVHSIPFTILKVEALQRPVASDFE

SEQ ID NO: 49888 - protein, 25 aa, synthetic construct
  source 1..25: note = Seed: QTVHSIPLTINKEEALQRPVASDFE
QTVHSIPFTILKVEAMQRPVASDFE

SEQ ID NO: 49889 - protein, 25 aa, synthetic construct
  source 1..25: note = Seed: QTVHSIPLTINKEEALQRPVASDFE
QTVHSIPFTILKVEARQRPVASDFE

SEQ ID NO: 49890 - protein, 25 aa, synthetic construct
  source 1..25: note = Seed: QTVHSIPLTINKEEALQRPVASDFE
QTVHSIPFTILKVEASQRPVASDFE

SEQ ID NO: 49891 - protein, 25 aa, synthetic construct
  source 1..25: note = Seed: QTVHSIPLTINKEEALQRPVASDFE
QTVHSIPFTILKVEATQRPVASDFE

SEQ ID NO: 49892 - protein, 25 aa, synthetic construct
  source 1..25: note = Seed: QTVHSIPLTINKEEALQRPVASDFE
QTVHSIPFTILKVEAVQRPVASDFE

SEQ ID NO: 49893 - protein, 25 aa, synthetic construct
  source 1..25: note = Seed: QTVHSIPLTINKEEALQRPVASDFE
QTVHSIPFTILKVEAYQRPVASDFE

SEQ ID NO: 49894 - protein, 25 aa, synthetic construct
  source 1..25: note = Seed: QTVHSIPLTINKEEALQRPVASDFE
QTVHSIPFTILKWEAAQRPVASDFE

SEQ ID NO: 49895 - protein, 25 aa, synthetic construct
  source 1..25: note = Seed: QTVHSIPLTINKEEALQRPVASDFE
QTVHSIPFTILKWEADQRPVASDFE

SEQ ID NO: 49896 - protein, 25 aa, synthetic construct
  source 1..25: note = Seed: QTVHSIPLTINKEEALQRPVASDFE
QTVHSIPFTILKWEAEQRPVASDFE

SEQ ID NO: 49897 - protein, 25 aa, synthetic construct
  source 1..25: note = Seed: QTVHSIPLTINKEEALQRPVASDFE
QTVHSIPFTILKWEAFQRPVASDFE

SEQ ID NO: 49898 - protein, 25 aa, synthetic construct
  source 1..25: note = Seed: QTVHSIPLTINKEEALQRPVASDFE
QTVHSIPFTILKWEAHQRPVASDFE

SEQ ID NO: 49899 - protein, 25 aa, synthetic construct
  source 1..25: note = Seed: QTVHSIPLTINKEEALQRPVASDFE
QTVHSIPFTILKWEAIQRPVASDFE

SEQ ID NO: 49900 - protein, 25 aa, synthetic construct
  source 1..25: note = Seed: QTVHSIPLTINKEEALQRPVASDFE
QTVHSIPFTILKWEALQRPVASDFE

SEQ ID NO: 49901 - protein, 25 aa, synthetic construct
  source 1..25: note = Seed: QTVHSIPLTINKEEALQRPVASDFE
QTVHSIPFTILKWEAMQRPVASDFE

SEQ ID NO: 49902 - protein, 25 aa, synthetic construct
  source 1..25: note = Seed: QTVHSIPLTINKEEALQRPVASDFE
QTVHSIPFTILKWEANQRPVASDFE

SEQ ID NO: 49903 - protein, 25 aa, synthetic construct
  source 1..25: note = Seed: QTVHSIPLTINKEEALQRPVASDFE
QTVHSIPFTILKWEAQQRPVASDFE

SEQ ID NO: 49904 - protein, 25 aa, synthetic construct
  source 1..25: note = Seed: QTVHSIPLTINKEEALQRPVASDFE
QTVHSIPFTILKWEARQRPVASDFE

SEQ ID NO: 49905 - protein, 25 aa, synthetic construct
  source 1..25: note = Seed: QTVHSIPLTINKEEALQRPVASDFE
QTVHSIPFTILKWEASQRPVASDFE

SEQ ID NO: 49906 - protein, 25 aa, synthetic construct
  source 1..25: note = Seed: QTVHSIPLTINKEEALQRPVASDFE
QTVHSIPFTILKWEATQRPVASDFE

SEQ ID NO: 49907 - protein, 25 aa, synthetic construct
  source 1..25: note = Seed: QTVHSIPLTINKEEALQRPVASDFE
QTVHSIPFTILKWEAVQRPVASDFE

SEQ ID NO: 49908 - protein, 25 aa, synthetic construct
  source 1..25: note = Seed: QTVHSIPLTINKEEALQRPVASDFE
QTVHSIPFTILKWEAYQRPVASDFE

SEQ ID NO: 49909 - protein, 25 aa, synthetic construct
  source 1..25: note = Seed: QTVHSIPLTINKEEALQRPVASDFE
QTVHSIPFTILKYEAAQRPVASDFE

SEQ ID NO: 49910 - protein, 25 aa, synthetic construct
  source 1..25: note = Seed: QTVHSIPLTINKEEALQRPVASDFE
QTVHSIPFTILKYEACQRPVASDFE

SEQ ID NO: 49911 - protein, 25 aa, synthetic construct
  source 1..25: note = Seed: QTVHSIPLTINKEEALQRPVASDFE
QTVHSIPFTILKYEADQRPVASDFE

SEQ ID NO: 49912 - protein, 25 aa, synthetic construct
  source 1..25: note = Seed: QTVHSIPLTINKEEALQRPVASDFE
QTVHSIPFTILKYEAEQRPVASDFE

SEQ ID NO: 49913 - protein, 25 aa, synthetic construct
  source 1..25: note = Seed: QTVHSIPLTINKEEALQRPVASDFE
QTVHSIPFTILKYEAFQRPVASDFE

SEQ ID NO: 49914 - protein, 25 aa, synthetic construct
  source 1..25: note = Seed: QTVHSIPLTINKEEALQRPVASDFE
QTVHSIPFTILKYEAGQRPVASDFE

SEQ ID NO: 49915 - protein, 25 aa, synthetic construct
  source 1..25: note = Seed: QTVHSIPLTINKEEALQRPVASDFE
QTVHSIPFTILKYEAHQRPVASDFE

SEQ ID NO: 49916 - protein, 25 aa, synthetic construct
  source 1..25: note = Seed: QTVHSIPLTINKEEALQRPVASDFE
QTVHSIPFTILKYEAIQRPVASDFE

SEQ ID NO: 49917 - protein, 25 aa, synthetic construct
  source 1..25: note = Seed: QTVHSIPLTINKEEALQRPVASDFE
QTVHSIPFTILKYEALQRPVASDFE

SEQ ID NO: 49918 - protein, 25 aa, synthetic construct
  source 1..25: note = Seed: QTVHSIPLTINKEEALQRPVASDFE
QTVHSIPFTILKYEAMQRPVASDFE

SEQ ID NO: 49919 - protein, 25 aa, synthetic construct
  source 1..25: note = Seed: QTVHSIPLTINKEEALQRPVASDFE
QTVHSIPFTILKYEANQRPVASDFE

SEQ ID NO: 49920 - protein, 25 aa, synthetic construct
  source 1..25: note = Seed: QTVHSIPLTINKEEALQRPVASDFE
QTVHSIPFTILKYEAPQRPVASDFE

SEQ ID NO: 49921 - protein, 25 aa, synthetic construct
  source 1..25: note = Seed: QTVHSIPLTINKEEALQRPVASDFE
QTVHSIPFTILKYEAQQRPVASDFE

SEQ ID NO: 49922 - protein, 25 aa, synthetic construct
  source 1..25: note = Seed: QTVHSIPLTINKEEALQRPVASDFE
QTVHSIPFTILKYEARQRPVASDFE

SEQ ID NO: 49923 - protein, 25 aa, synthetic construct
  source 1..25: note = Seed: QTVHSIPLTINKEEALQRPVASDFE
QTVHSIPFTILKYEASQRPVASDFE

SEQ ID NO: 49924 - protein, 25 aa, synthetic construct
  source 1..25: note = Seed: QTVHSIPLTINKEEALQRPVASDFE
QTVHSIPFTILKYEATQRPVASDFE

SEQ ID NO: 49925 - protein, 25 aa, synthetic construct
  source 1..25: note = Seed: QTVHSIPLTINKEEALQRPVASDFE
QTVHSIPFTILKYEAVQRPVASDFE

SEQ ID NO: 49926 - protein, 25 aa, synthetic construct
  source 1..25: note = Seed: QTVHSIPLTINKEEALQRPVASDFE
QTVHSIPFTILKYEAWQRPVASDFE

SEQ ID NO: 49927 - protein, 25 aa, synthetic construct
  source 1..25: note = Seed: QTVHSIPLTINKEEALQRPVASDFE
QTVHSIPFTILKYEAYQRPVASDFE

SEQ ID NO: 49928 - protein, 25 aa, synthetic construct
  source 1..25: note = Seed: QTVHSIPLTINKEEALQRPVASDFE
QTVHSIPFTIMKAEAFQRPVASDFE

SEQ ID NO: 49929 - protein, 25 aa, synthetic construct
  source 1..25: note = Seed: QTVHSIPLTINKEEALQRPVASDFE
QTVHSIPFTIMKAEAIQRPVASDFE

SEQ ID NO: 49930 - protein, 25 aa, synthetic construct
  source 1..25: note = Seed: QTVHSIPLTINKEEALQRPVASDFE
QTVHSIPFTIMKAEALQRPVASDFE

SEQ ID NO: 49931 - protein, 25 aa, synthetic construct
  source 1..25: note = Seed: QTVHSIPLTINKEEALQRPVASDFE
QTVHSIPFTIMKAEAVQRPVASDFE

SEQ ID NO: 49932 - protein, 25 aa, synthetic construct
  source 1..25: note = Seed: QTVHSIPLTINKEEALQRPVASDFE
QTVHSIPFTIMKFEAAQRPVASDFE

SEQ ID NO: 49933 - protein, 25 aa, synthetic construct
  source 1..25: note = Seed: QTVHSIPLTINKEEALQRPVASDFE
QTVHSIPFTIMKFEACQRPVASDFE

SEQ ID NO: 49934 - protein, 25 aa, synthetic construct
  source 1..25: note = Seed: QTVHSIPLTINKEEALQRPVASDFE
QTVHSIPFTIMKFEADQRPVASDFE

SEQ ID NO: 49935 - protein, 25 aa, synthetic construct
  source 1..25: note = Seed: QTVHSIPLTINKEEALQRPVASDFE
QTVHSIPFTIMKFEAEQRPVASDFE

SEQ ID NO: 49936 - protein, 25 aa, synthetic construct
  source 1..25: note = Seed: QTVHSIPLTINKEEALQRPVASDFE
QTVHSIPFTIMKFEAFQRPVASDFE

SEQ ID NO: 49937 - protein, 25 aa, synthetic construct
  source 1..25: note = Seed: QTVHSIPLTINKEEALQRPVASDFE
QTVHSIPFTIMKFEAGQRPVASDFE

SEQ ID NO: 49938 - protein, 25 aa, synthetic construct
  source 1..25: note = Seed: QTVHSIPLTINKEEALQRPVASDFE
QTVHSIPFTIMKFEAHQRPVASDFE

SEQ ID NO: 49939 - protein, 25 aa, synthetic construct
  source 1..25: note = Seed: QTVHSIPLTINKEEALQRPVASDFE
QTVHSIPFTIMKFEAIQRPVASDFE

SEQ ID NO: 49940 - protein, 25 aa, synthetic construct
  source 1..25: note = Seed: QTVHSIPLTINKEEALQRPVASDFE
QTVHSIPFTIMKFEAKQRPVASDFE

SEQ ID NO: 49941 - protein, 25 aa, synthetic construct
  source 1..25: note = Seed: QTVHSIPLTINKEEALQRPVASDFE
QTVHSIPFTIMKFEALQRPVASDFE

SEQ ID NO: 49942 - protein, 25 aa, synthetic construct
  source 1..25: note = Seed: QTVHSIPLTINKEEALQRPVASDFE
QTVHSIPFTIMKFEAMQRPVASDFE

SEQ ID NO: 49943 - protein, 25 aa, synthetic construct
  source 1..25: note = Seed: QTVHSIPLTINKEEALQRPVASDFE
QTVHSIPFTIMKFEANQRPVASDFE

SEQ ID NO: 49944 - protein, 25 aa, synthetic construct
  source 1..25: note = Seed: QTVHSIPLTINKEEALQRPVASDFE
QTVHSIPFTIMKFEAPQRPVASDFE

SEQ ID NO: 49945 - protein, 25 aa, synthetic construct
  source 1..25: note = Seed: QTVHSIPLTINKEEALQRPVASDFE
QTVHSIPFTIMKFEAQQRPVASDFE

SEQ ID NO: 49946 - protein, 25 aa, synthetic construct
  source 1..25: note = Seed: QTVHSIPLTINKEEALQRPVASDFE
QTVHSIPFTIMKFEARQRPVASDFE

SEQ ID NO: 49947 - protein, 25 aa, synthetic construct
  source 1..25: note = Seed: QTVHSIPLTINKEEALQRPVASDFE
QTVHSIPFTIMKFEASQRPVASDFE

SEQ ID NO: 49948 - protein, 25 aa, synthetic construct
  source 1..25: note = Seed: QTVHSIPLTINKEEALQRPVASDFE
QTVHSIPFTIMKFEATQRPVASDFE

SEQ ID NO: 49949 - protein, 25 aa, synthetic construct
  source 1..25: note = Seed: QTVHSIPLTINKEEALQRPVASDFE
QTVHSIPFTIMKFEAVQRPVASDFE

SEQ ID NO: 49950 - protein, 25 aa, synthetic construct
  source 1..25: note = Seed: QTVHSIPLTINKEEALQRPVASDFE
QTVHSIPFTIMKFEAWQRPVASDFE

SEQ ID NO: 49951 - protein, 25 aa, synthetic construct
  source 1..25: note = Seed: QTVHSIPLTINKEEALQRPVASDFE
QTVHSIPFTIMKFEAYQRPVASDFE

SEQ ID NO: 49952 - protein, 25 aa, synthetic construct
  source 1..25: note = Seed: QTVHSIPLTINKEEALQRPVASDFE
QTVHSIPFTIMKHEAFQRPVASDFE

SEQ ID NO: 49953 - protein, 25 aa, synthetic construct
  source 1..25: note = Seed: QTVHSIPLTINKEEALQRPVASDFE
QTVHSIPFTIMKIEAAQRPVASDFE

SEQ ID NO: 49954 - protein, 25 aa, synthetic construct
  source 1..25: note = Seed: QTVHSIPLTINKEEALQRPVASDFE
QTVHSIPFTIMKIEAEQRPVASDFE

SEQ ID NO: 49955 - protein, 25 aa, synthetic construct
  source 1..25: note = Seed: QTVHSIPLTINKEEALQRPVASDFE
QTVHSIPFTIMKIEAFQRPVASDFE

SEQ ID NO: 49956 - protein, 25 aa, synthetic construct
  source 1..25: note = Seed: QTVHSIPLTINKEEALQRPVASDFE
QTVHSIPFTIMKIEAIQRPVASDFE

SEQ ID NO: 49957 - protein, 25 aa, synthetic construct
  source 1..25: note = Seed: QTVHSIPLTINKEEALQRPVASDFE
QTVHSIPFTIMKIEALQRPVASDFE

SEQ ID NO: 49958 - protein, 25 aa, synthetic construct
  source 1..25: note = Seed: QTVHSIPLTINKEEALQRPVASDFE
QTVHSIPFTIMKIEAMQRPVASDFE

SEQ ID NO: 49959 - protein, 25 aa, synthetic construct
  source 1..25: note = Seed: QTVHSIPLTINKEEALQRPVASDFE
QTVHSIPFTIMKIEARQRPVASDFE

SEQ ID NO: 49960 - protein, 25 aa, synthetic construct
  source 1..25: note = Seed: QTVHSIPLTINKEEALQRPVASDFE
QTVHSIPFTIMKIEASQRPVASDFE

SEQ ID NO: 49961 - protein, 25 aa, synthetic construct
  source 1..25: note = Seed: QTVHSIPLTINKEEALQRPVASDFE
QTVHSIPFTIMKIEATQRPVASDFE

SEQ ID NO: 49962 - protein, 25 aa, synthetic construct
  source 1..25: note = Seed: QTVHSIPLTINKEEALQRPVASDFE
QTVHSIPFTIMKIEAVQRPVASDFE

SEQ ID NO: 49963 - protein, 25 aa, synthetic construct
  source 1..25: note = Seed: QTVHSIPLTINKEEALQRPVASDFE
QTVHSIPFTIMKIEAYQRPVASDFE

SEQ ID NO: 49964 - protein, 25 aa, synthetic construct
  source 1..25: note = Seed: QTVHSIPLTINKEEALQRPVASDFE
QTVHSIPFTIMKLEAAQRPVASDFE

SEQ ID NO: 49965 - protein, 25 aa, synthetic construct
  source 1..25: note = Seed: QTVHSIPLTINKEEALQRPVASDFE
QTVHSIPFTIMKLEADQRPVASDFE

SEQ ID NO: 49966 - protein, 25 aa, synthetic construct
  source 1..25: note = Seed: QTVHSIPLTINKEEALQRPVASDFE
QTVHSIPFTIMKLEAEQRPVASDFE

SEQ ID NO: 49967 - protein, 25 aa, synthetic construct
  source 1..25: note = Seed: QTVHSIPLTINKEEALQRPVASDFE
QTVHSIPFTIMKLEAFQRPVASDFE

SEQ ID NO: 49968 - protein, 25 aa, synthetic construct
  source 1..25: note = Seed: QTVHSIPLTINKEEALQRPVASDFE
QTVHSIPFTIMKLEAHQRPVASDFE

SEQ ID NO: 49969 - protein, 25 aa, synthetic construct
  source 1..25: note = Seed: QTVHSIPLTINKEEALQRPVASDFE
QTVHSIPFTIMKLEAIQRPVASDFE

SEQ ID NO: 49970 - protein, 25 aa, synthetic construct
  source 1..25: note = Seed: QTVHSIPLTINKEEALQRPVASDFE
QTVHSIPFTIMKLEALQRPVASDFE

SEQ ID NO: 49971 - protein, 25 aa, synthetic construct
  source 1..25: note = Seed: QTVHSIPLTINKEEALQRPVASDFE
QTVHSIPFTIMKLEAMQRPVASDFE

SEQ ID NO: 49972 - protein, 25 aa, synthetic construct
  source 1..25: note = Seed: QTVHSIPLTINKEEALQRPVASDFE
QTVHSIPFTIMKLEANQRPVASDFE

SEQ ID NO: 49973 - protein, 25 aa, synthetic construct
  source 1..25: note = Seed: QTVHSIPLTINKEEALQRPVASDFE
QTVHSIPFTIMKLEAQQRPVASDFE

SEQ ID NO: 49974 - protein, 25 aa, synthetic construct
  source 1..25: note = Seed: QTVHSIPLTINKEEALQRPVASDFE
QTVHSIPFTIMKLEARQRPVASDFE

SEQ ID NO: 49975 - protein, 25 aa, synthetic construct
  source 1..25: note = Seed: QTVHSIPLTINKEEALQRPVASDFE
QTVHSIPFTIMKLEASQRPVASDFE

SEQ ID NO: 49976 - protein, 25 aa, synthetic construct
  source 1..25: note = Seed: QTVHSIPLTINKEEALQRPVASDFE
QTVHSIPFTIMKLEATQRPVASDFE

SEQ ID NO: 49977 - protein, 25 aa, synthetic construct
  source 1..25: note = Seed: QTVHSIPLTINKEEALQRPVASDFE
QTVHSIPFTIMKLEAVQRPVASDFE

SEQ ID NO: 49978 - protein, 25 aa, synthetic construct
  source 1..25: note = Seed: QTVHSIPLTINKEEALQRPVASDFE
QTVHSIPFTIMKLEAWQRPVASDFE

SEQ ID NO: 49979 - protein, 25 aa, synthetic construct
  source 1..25: note = Seed: QTVHSIPLTINKEEALQRPVASDFE
QTVHSIPFTIMKLEAYQRPVASDFE

SEQ ID NO: 49980 - protein, 25 aa, synthetic construct
  source 1..25: note = Seed: QTVHSIPLTINKEEALQRPVASDFE
QTVHSIPFTIMKMEAFQRPVASDFE

SEQ ID NO: 49981 - protein, 25 aa, synthetic construct
  source 1..25: note = Seed: QTVHSIPLTINKEEALQRPVASDFE
QTVHSIPFTIMKMEAIQRPVASDFE

SEQ ID NO: 49982 - protein, 25 aa, synthetic construct
  source 1..25: note = Seed: QTVHSIPLTINKEEALQRPVASDFE
QTVHSIPFTIMKMEALQRPVASDFE

SEQ ID NO: 49983 - protein, 25 aa, synthetic construct
  source 1..25: note = Seed: QTVHSIPLTINKEEALQRPVASDFE
QTVHSIPFTIMKMEAMQRPVASDFE

SEQ ID NO: 49984 - protein, 25 aa, synthetic construct
  source 1..25: note = Seed: QTVHSIPLTINKEEALQRPVASDFE
QTVHSIPFTIMKMEAVQRPVASDFE

SEQ ID NO: 49985 - protein, 25 aa, synthetic construct
  source 1..25: note = Seed: QTVHSIPLTINKEEALQRPVASDFE
QTVHSIPFTIMKMEAWQRPVASDFE

SEQ ID NO: 49986 - protein, 25 aa, synthetic construct
  source 1..25: note = Seed: QTVHSIPLTINKEEALQRPVASDFE
QTVHSIPFTIMKMEAYQRPVASDFE

SEQ ID NO: 49987 - protein, 25 aa, synthetic construct
  source 1..25: note = Seed: QTVHSIPLTINKEEALQRPVASDFE
QTVHSIPFTIMKQEAFQRPVASDFE

SEQ ID NO: 49988 - protein, 25 aa, synthetic construct
  source 1..25: note = Seed: QTVHSIPLTINKEEALQRPVASDFE
QTVHSIPFTIMKSEAFQRPVASDFE

SEQ ID NO: 49989 - protein, 25 aa, synthetic construct
  source 1..25: note = Seed: QTVHSIPLTINKEEALQRPVASDFE
QTVHSIPFTIMKSEALQRPVASDFE

SEQ ID NO: 49990 - protein, 25 aa, synthetic construct
  source 1..25: note = Seed: QTVHSIPLTINKEEALQRPVASDFE
QTVHSIPFTIMKVEAFQRPVASDFE

SEQ ID NO: 49991 - protein, 25 aa, synthetic construct
  source 1..25: note = Seed: QTVHSIPLTINKEEALQRPVASDFE
QTVHSIPFTIMKVEAIQRPVASDFE

SEQ ID NO: 49992 - protein, 25 aa, synthetic construct
  source 1..25: note = Seed: QTVHSIPLTINKEEALQRPVASDFE
QTVHSIPFTIMKVEALQRPVASDFE

SEQ ID NO: 49993 - protein, 25 aa, synthetic construct
  source 1..25: note = Seed: QTVHSIPLTINKEEALQRPVASDFE
QTVHSIPFTIMKVEAMQRPVASDFE

SEQ ID NO: 49994 - protein, 25 aa, synthetic construct
  source 1..25: note = Seed: QTVHSIPLTINKEEALQRPVASDFE
QTVHSIPFTIMKVEAVQRPVASDFE

SEQ ID NO: 49995 - protein, 25 aa, synthetic construct
  source 1..25: note = Seed: QTVHSIPLTINKEEALQRPVASDFE
QTVHSIPFTIMKVEAYQRPVASDFE

SEQ ID NO: 49996 - protein, 25 aa, synthetic construct
  source 1..25: note = Seed: QTVHSIPLTINKEEALQRPVASDFE
QTVHSIPFTIMKWEAFQRPVASDFE

SEQ ID NO: 49997 - protein, 25 aa, synthetic construct
  source 1..25: note = Seed: QTVHSIPLTINKEEALQRPVASDFE
QTVHSIPFTIMKWEAIQRPVASDFE

SEQ ID NO: 49998 - protein, 25 aa, synthetic construct
  source 1..25: note = Seed: QTVHSIPLTINKEEALQRPVASDFE
QTVHSIPFTIMKWEALQRPVASDFE

SEQ ID NO: 49999 - protein, 25 aa, synthetic construct
  source 1..25: note = Seed: QTVHSIPLTINKEEALQRPVASDFE
QTVHSIPFTIMKWEAMQRPVASDFE

SEQ ID NO: 50000 - protein, 25 aa, synthetic construct
  source 1..25: note = Seed: QTVHSIPLTINKEEALQRPVASDFE
QTVHSIPFTIMKWEAVQRPVASDFE

SEQ ID NO: 50001 - protein, 25 aa, synthetic construct
  source 1..25: note = Seed: QTVHSIPLTINKEEALQRPVASDFE
QTVHSIPFTIMKWEAYQRPVASDFE

SEQ ID NO: 50002 - protein, 25 aa, synthetic construct
  source 1..25: note = Seed: QTVHSIPLTINKEEALQRPVASDFE
QTVHSIPFTIMKYEAAQRPVASDFE

SEQ ID NO: 50003 - protein, 25 aa, synthetic construct
  source 1..25: note = Seed: QTVHSIPLTINKEEALQRPVASDFE
QTVHSIPFTIMKYEAFQRPVASDFE

SEQ ID NO: 50004 - protein, 25 aa, synthetic construct
  source 1..25: note = Seed: QTVHSIPLTINKEEALQRPVASDFE
QTVHSIPFTIMKYEAIQRPVASDFE

SEQ ID NO: 50005 - protein, 25 aa, synthetic construct
  source 1..25: note = Seed: QTVHSIPLTINKEEALQRPVASDFE
QTVHSIPFTIMKYEALQRPVASDFE

SEQ ID NO: 50006 - protein, 25 aa, synthetic construct
  source 1..25: note = Seed: QTVHSIPLTINKEEALQRPVASDFE
QTVHSIPFTIMKYEAMQRPVASDFE

SEQ ID NO: 50007 - protein, 25 aa, synthetic construct
  source 1..25: note = Seed: QTVHSIPLTINKEEALQRPVASDFE
QTVHSIPFTIMKYEATQRPVASDFE

SEQ ID NO: 50008 - protein, 25 aa, synthetic construct
  source 1..25: note = Seed: QTVHSIPLTINKEEALQRPVASDFE
QTVHSIPFTIMKYEAVQRPVASDFE

SEQ ID NO: 50009 - protein, 25 aa, synthetic construct
  source 1..25: note = Seed: QTVHSIPLTINKEEALQRPVASDFE
QTVHSIPFTIMKYEAWQRPVASDFE

SEQ ID NO: 50010 - protein, 25 aa, synthetic construct
  source 1..25: note = Seed: QTVHSIPLTINKEEALQRPVASDFE
QTVHSIPFTIMKYEAYQRPVASDFE

SEQ ID NO: 50011 - protein, 25 aa, synthetic construct
  source 1..25: note = Seed: QTVHSIPLTINKEEALQRPVASDFE
QTVHSIPFTINKAEAAQRPVASDFE

SEQ ID NO: 50012 - protein, 25 aa, synthetic construct
  source 1..25: note = Seed: QTVHSIPLTINKEEALQRPVASDFE
QTVHSIPFTINKAEAFQRPVASDFE

SEQ ID NO: 50013 - protein, 25 aa, synthetic construct
  source 1..25: note = Seed: QTVHSIPLTINKEEALQRPVASDFE
QTVHSIPFTINKAEAIQRPVASDFE

SEQ ID NO: 50014 - protein, 25 aa, synthetic construct
  source 1..25: note = Seed: QTVHSIPLTINKEEALQRPVASDFE
QTVHSIPFTINKAEALQRPVASDFE

SEQ ID NO: 50015 - protein, 25 aa, synthetic construct
  source 1..25: note = Seed: QTVHSIPLTINKEEALQRPVASDFE
QTVHSIPFTINKAEAMQRPVASDFE

SEQ ID NO: 50016 - protein, 25 aa, synthetic construct
  source 1..25: note = Seed: QTVHSIPLTINKEEALQRPVASDFE
QTVHSIPFTINKAEAVQRPVASDFE

SEQ ID NO: 50017 - protein, 25 aa, synthetic construct
  source 1..25: note = Seed: QTVHSIPLTINKEEALQRPVASDFE
QTVHSIPFTINKAEAWQRPVASDFE

SEQ ID NO: 50018 - protein, 25 aa, synthetic construct
  source 1..25: note = Seed: QTVHSIPLTINKEEALQRPVASDFE
QTVHSIPFTINKAEAYQRPVASDFE

SEQ ID NO: 50019 - protein, 25 aa, synthetic construct
  source 1..25: note = Seed: QTVHSIPLTINKEEALQRPVASDFE
QTVHSIPFTINKFEAAQRPVASDFE

SEQ ID NO: 50020 - protein, 25 aa, synthetic construct
  source 1..25: note = Seed: QTVHSIPLTINKEEALQRPVASDFE
QTVHSIPFTINKFEAEQRPVASDFE

SEQ ID NO: 50021 - protein, 25 aa, synthetic construct
  source 1..25: note = Seed: QTVHSIPLTINKEEALQRPVASDFE
QTVHSIPFTINKFEAFQRPVASDFE

SEQ ID NO: 50022 - protein, 25 aa, synthetic construct
  source 1..25: note = Seed: QTVHSIPLTINKEEALQRPVASDFE
QTVHSIPFTINKFEAIQRPVASDFE

SEQ ID NO: 50023 - protein, 25 aa, synthetic construct
  source 1..25: note = Seed: QTVHSIPLTINKEEALQRPVASDFE
QTVHSIPFTINKFEALQRPVASDFE

SEQ ID NO: 50024 - protein, 25 aa, synthetic construct
  source 1..25: note = Seed: QTVHSIPLTINKEEALQRPVASDFE
QTVHSIPFTINKFEAMQRPVASDFE

SEQ ID NO: 50025 - protein, 25 aa, synthetic construct
  source 1..25: note = Seed: QTVHSIPLTINKEEALQRPVASDFE
QTVHSIPFTINKFEANQRPVASDFE

SEQ ID NO: 50026 - protein, 25 aa, synthetic construct
  source 1..25: note = Seed: QTVHSIPLTINKEEALQRPVASDFE
QTVHSIPFTINKFEASQRPVASDFE

SEQ ID NO: 50027 - protein, 25 aa, synthetic construct
  source 1..25: note = Seed: QTVHSIPLTINKEEALQRPVASDFE
QTVHSIPFTINKFEATQRPVASDFE

SEQ ID NO: 50028 - protein, 25 aa, synthetic construct
  source 1..25: note = Seed: QTVHSIPLTINKEEALQRPVASDFE
QTVHSIPFTINKFEAVQRPVASDFE

SEQ ID NO: 50029 - protein, 25 aa, synthetic construct
  source 1..25: note = Seed: QTVHSIPLTINKEEALQRPVASDFE
QTVHSIPFTINKFEAWQRPVASDFE

SEQ ID NO: 50030 - protein, 25 aa, synthetic construct
  source 1..25: note = Seed: QTVHSIPLTINKEEALQRPVASDFE
QTVHSIPFTINKFEAYQRPVASDFE

SEQ ID NO: 50031 - protein, 25 aa, synthetic construct
  source 1..25: note = Seed: QTVHSIPLTINKEEALQRPVASDFE
QTVHSIPFTINKGEAFQRPVASDFE

SEQ ID NO: 50032 - protein, 25 aa, synthetic construct
  source 1..25: note = Seed: QTVHSIPLTINKEEALQRPVASDFE
QTVHSIPFTINKGEAIQRPVASDFE

SEQ ID NO: 50033 - protein, 25 aa, synthetic construct
  source 1..25: note = Seed: QTVHSIPLTINKEEALQRPVASDFE
QTVHSIPFTINKGEALQRPVASDFE

SEQ ID NO: 50034 - protein, 25 aa, synthetic construct
  source 1..25: note = Seed: QTVHSIPLTINKEEALQRPVASDFE
QTVHSIPFTINKGEAMQRPVASDFE

SEQ ID NO: 50035 - protein, 25 aa, synthetic construct
  source 1..25: note = Seed: QTVHSIPLTINKEEALQRPVASDFE
QTVHSIPFTINKGEAVQRPVASDFE

SEQ ID NO: 50036 - protein, 25 aa, synthetic construct
  source 1..25: note = Seed: QTVHSIPLTINKEEALQRPVASDFE
QTVHSIPFTINKGEAYQRPVASDFE

SEQ ID NO: 50037 - protein, 25 aa, synthetic construct
  source 1..25: note = Seed: QTVHSIPLTINKEEALQRPVASDFE
QTVHSIPFTINKHEAIQRPVASDFE

SEQ ID NO: 50038 - protein, 25 aa, synthetic construct
  source 1..25: note = Seed: QTVHSIPLTINKEEALQRPVASDFE
QTVHSIPFTINKIEAFQRPVASDFE

SEQ ID NO: 50039 - protein, 25 aa, synthetic construct
  source 1..25: note = Seed: QTVHSIPLTINKEEALQRPVASDFE
QTVHSIPFTINKIEAIQRPVASDFE

SEQ ID NO: 50040 - protein, 25 aa, synthetic construct
  source 1..25: note = Seed: QTVHSIPLTINKEEALQRPVASDFE
QTVHSIPFTINKIEALQRPVASDFE

SEQ ID NO: 50041 - protein, 25 aa, synthetic construct
  source 1..25: note = Seed: QTVHSIPLTINKEEALQRPVASDFE
QTVHSIPFTINKIEAMQRPVASDFE

SEQ ID NO: 50042 - protein, 25 aa, synthetic construct
  source 1..25: note = Seed: QTVHSIPLTINKEEALQRPVASDFE
QTVHSIPFTINKIEAVQRPVASDFE

SEQ ID NO: 50043 - protein, 25 aa, synthetic construct
  source 1..25: note = Seed: QTVHSIPLTINKEEALQRPVASDFE
QTVHSIPFTINKIEAYQRPVASDFE

SEQ ID NO: 50044 - protein, 25 aa, synthetic construct
  source 1..25: note = Seed: QTVHSIPLTINKEEALQRPVASDFE
QTVHSIPFTINKLEAFQRPVASDFE

SEQ ID NO: 50045 - protein, 25 aa, synthetic construct
  source 1..25: note = Seed: QTVHSIPLTINKEEALQRPVASDFE
QTVHSIPFTINKLEAIQRPVASDFE

SEQ ID NO: 50046 - protein, 25 aa, synthetic construct
  source 1..25: note = Seed: QTVHSIPLTINKEEALQRPVASDFE
QTVHSIPFTINKLEALQRPVASDFE

SEQ ID NO: 50047 - protein, 25 aa, synthetic construct
  source 1..25: note = Seed: QTVHSIPLTINKEEALQRPVASDFE
QTVHSIPFTINKLEAVQRPVASDFE

SEQ ID NO: 50048 - protein, 25 aa, synthetic construct
  source 1..25: note = Seed: QTVHSIPLTINKEEALQRPVASDFE
QTVHSIPFTINKMEAIQRPVASDFE

SEQ ID NO: 50049 - protein, 25 aa, synthetic construct
  source 1..25: note = Seed: QTVHSIPLTINKEEALQRPVASDFE
QTVHSIPFTINKMEALQRPVASDFE

SEQ ID NO: 50050 - protein, 25 aa, synthetic construct
  source 1..25: note = Seed: QTVHSIPLTINKEEALQRPVASDFE
QTVHSIPFTINKMEAVQRPVASDFE

SEQ ID NO: 50051 - protein, 25 aa, synthetic construct
  source 1..25: note = Seed: QTVHSIPLTINKEEALQRPVASDFE
QTVHSIPFTINKNEAAQRPVASDFE

SEQ ID NO: 50052 - protein, 25 aa, synthetic construct
  source 1..25: note = Seed: QTVHSIPLTINKEEALQRPVASDFE
QTVHSIPFTINKNEAFQRPVASDFE

SEQ ID NO: 50053 - protein, 25 aa, synthetic construct
  source 1..25: note = Seed: QTVHSIPLTINKEEALQRPVASDFE
QTVHSIPFTINKNEAIQRPVASDFE

SEQ ID NO: 50054 - protein, 25 aa, synthetic construct
  source 1..25: note = Seed: QTVHSIPLTINKEEALQRPVASDFE
QTVHSIPFTINKNEALQRPVASDFE

SEQ ID NO: 50055 - protein, 25 aa, synthetic construct
  source 1..25: note = Seed: QTVHSIPLTINKEEALQRPVASDFE
QTVHSIPFTINKNEAMQRPVASDFE

SEQ ID NO: 50056 - protein, 25 aa, synthetic construct
  source 1..25: note = Seed: QTVHSIPLTINKEEALQRPVASDFE
QTVHSIPFTINKNEAVQRPVASDFE

SEQ ID NO: 50057 - protein, 25 aa, synthetic construct
  source 1..25: note = Seed: QTVHSIPLTINKEEALQRPVASDFE
QTVHSIPFTINKNEAWQRPVASDFE

SEQ ID NO: 50058 - protein, 25 aa, synthetic construct
  source 1..25: note = Seed: QTVHSIPLTINKEEALQRPVASDFE
QTVHSIPFTINKNEAYQRPVASDFE

SEQ ID NO: 50059 - protein, 25 aa, synthetic construct
  source 1..25: note = Seed: QTVHSIPLTINKEEALQRPVASDFE
QTVHSIPFTINKPEAFQRPVASDFE

SEQ ID NO: 50060 - protein, 25 aa, synthetic construct
  source 1..25: note = Seed: QTVHSIPLTINKEEALQRPVASDFE
QTVHSIPFTINKPEAIQRPVASDFE

SEQ ID NO: 50061 - protein, 25 aa, synthetic construct
  source 1..25: note = Seed: QTVHSIPLTINKEEALQRPVASDFE
QTVHSIPFTINKPEALQRPVASDFE

SEQ ID NO: 50062 - protein, 25 aa, synthetic construct
  source 1..25: note = Seed: QTVHSIPLTINKEEALQRPVASDFE
QTVHSIPFTINKPEAMQRPVASDFE

SEQ ID NO: 50063 - protein, 25 aa, synthetic construct
  source 1..25: note = Seed: QTVHSIPLTINKEEALQRPVASDFE
QTVHSIPFTINKPEAVQRPVASDFE

SEQ ID NO: 50064 - protein, 25 aa, synthetic construct
  source 1..25: note = Seed: QTVHSIPLTINKEEALQRPVASDFE
QTVHSIPFTINKPEAYQRPVASDFE

SEQ ID NO: 50065 - protein, 25 aa, synthetic construct
  source 1..25: note = Seed: QTVHSIPLTINKEEALQRPVASDFE
QTVHSIPFTINKSEAAQRPVASDFE

SEQ ID NO: 50066 - protein, 25 aa, synthetic construct
  source 1..25: note = Seed: QTVHSIPLTINKEEALQRPVASDFE
QTVHSIPFTINKSEAFQRPVASDFE

SEQ ID NO: 50067 - protein, 25 aa, synthetic construct
  source 1..25: note = Seed: QTVHSIPLTINKEEALQRPVASDFE
QTVHSIPFTINKSEAIQRPVASDFE

SEQ ID NO: 50068 - protein, 25 aa, synthetic construct
  source 1..25: note = Seed: QTVHSIPLTINKEEALQRPVASDFE
QTVHSIPFTINKSEALQRPVASDFE

SEQ ID NO: 50069 - protein, 25 aa, synthetic construct
  source 1..25: note = Seed: QTVHSIPLTINKEEALQRPVASDFE
QTVHSIPFTINKSEAMQRPVASDFE

SEQ ID NO: 50070 - protein, 25 aa, synthetic construct
  source 1..25: note = Seed: QTVHSIPLTINKEEALQRPVASDFE
QTVHSIPFTINKSEAVQRPVASDFE

SEQ ID NO: 50071 - protein, 25 aa, synthetic construct
  source 1..25: note = Seed: QTVHSIPLTINKEEALQRPVASDFE
QTVHSIPFTINKSEAYQRPVASDFE

SEQ ID NO: 50072 - protein, 25 aa, synthetic construct
  source 1..25: note = Seed: QTVHSIPLTINKEEALQRPVASDFE
QTVHSIPFTINKTEAFQRPVASDFE

SEQ ID NO: 50073 - protein, 25 aa, synthetic construct
  source 1..25: note = Seed: QTVHSIPLTINKEEALQRPVASDFE
QTVHSIPFTINKTEAIQRPVASDFE

SEQ ID NO: 50074 - protein, 25 aa, synthetic construct
  source 1..25: note = Seed: QTVHSIPLTINKEEALQRPVASDFE
QTVHSIPFTINKTEALQRPVASDFE

SEQ ID NO: 50075 - protein, 25 aa, synthetic construct
  source 1..25: note = Seed: QTVHSIPLTINKEEALQRPVASDFE
QTVHSIPFTINKTEAMQRPVASDFE

SEQ ID NO: 50076 - protein, 25 aa, synthetic construct
  source 1..25: note = Seed: QTVHSIPLTINKEEALQRPVASDFE
QTVHSIPFTINKTEAVQRPVASDFE

SEQ ID NO: 50077 - protein, 25 aa, synthetic construct
  source 1..25: note = Seed: QTVHSIPLTINKEEALQRPVASDFE
QTVHSIPFTINKTEAYQRPVASDFE

SEQ ID NO: 50078 - protein, 25 aa, synthetic construct
  source 1..25: note = Seed: QTVHSIPLTINKEEALQRPVASDFE
QTVHSIPFTINKVEAFQRPVASDFE

SEQ ID NO: 50079 - protein, 25 aa, synthetic construct
  source 1..25: note = Seed: QTVHSIPLTINKEEALQRPVASDFE
QTVHSIPFTINKVEAIQRPVASDFE

SEQ ID NO: 50080 - protein, 25 aa, synthetic construct
  source 1..25: note = Seed: QTVHSIPLTINKEEALQRPVASDFE
QTVHSIPFTINKVEALQRPVASDFE

SEQ ID NO: 50081 - protein, 25 aa, synthetic construct
  source 1..25: note = Seed: QTVHSIPLTINKEEALQRPVASDFE
QTVHSIPFTINKVEAMQRPVASDFE

SEQ ID NO: 50082 - protein, 25 aa, synthetic construct
  source 1..25: note = Seed: QTVHSIPLTINKEEALQRPVASDFE
QTVHSIPFTINKVEAVQRPVASDFE

SEQ ID NO: 50083 - protein, 25 aa, synthetic construct
  source 1..25: note = Seed: QTVHSIPLTINKEEALQRPVASDFE
QTVHSIPFTINKVEAYQRPVASDFE

SEQ ID NO: 50084 - protein, 25 aa, synthetic construct
  source 1..25: note = Seed: QTVHSIPLTINKEEALQRPVASDFE
QTVHSIPFTINKYEAFQRPVASDFE

SEQ ID NO: 50085 - protein, 25 aa, synthetic construct
  source 1..25: note = Seed: QTVHSIPLTINKEEALQRPVASDFE
QTVHSIPFTINKYEAIQRPVASDFE

SEQ ID NO: 50086 - protein, 25 aa, synthetic construct
  source 1..25: note = Seed: QTVHSIPLTINKEEALQRPVASDFE
QTVHSIPFTINKYEALQRPVASDFE

SEQ ID NO: 50087 - protein, 25 aa, synthetic construct
  source 1..25: note = Seed: QTVHSIPLTINKEEALQRPVASDFE
QTVHSIPFTINKYEAVQRPVASDFE

SEQ ID NO: 50088 - protein, 25 aa, synthetic construct
  source 1..25: note = Seed: QTVHSIPLTINKEEALQRPVASDFE
QTVHSIPFTIPKFEALQRPVASDFE

SEQ ID NO: 50089 - protein, 25 aa, synthetic construct
  source 1..25: note = Seed: QTVHSIPLTINKEEALQRPVASDFE
QTVHSIPFTIQKFEAAQRPVASDFE

SEQ ID NO: 50090 - protein, 25 aa, synthetic construct
  source 1..25: note = Seed: QTVHSIPLTINKEEALQRPVASDFE
QTVHSIPFTIQKFEAEQRPVASDFE

SEQ ID NO: 50091 - protein, 25 aa, synthetic construct
  source 1..25: note = Seed: QTVHSIPLTINKEEALQRPVASDFE
QTVHSIPFTIQKFEAFQRPVASDFE

SEQ ID NO: 50092 - protein, 25 aa, synthetic construct
  source 1..25: note = Seed: QTVHSIPLTINKEEALQRPVASDFE
QTVHSIPFTIQKFEAIQRPVASDFE

SEQ ID NO: 50093 - protein, 25 aa, synthetic construct
  source 1..25: note = Seed: QTVHSIPLTINKEEALQRPVASDFE
QTVHSIPFTIQKFEALQRPVASDFE

SEQ ID NO: 50094 - protein, 25 aa, synthetic construct
  source 1..25: note = Seed: QTVHSIPLTINKEEALQRPVASDFE
QTVHSIPFTIQKFEAMQRPVASDFE

SEQ ID NO: 50095 - protein, 25 aa, synthetic construct
  source 1..25: note = Seed: QTVHSIPLTINKEEALQRPVASDFE
QTVHSIPFTIQKFEANQRPVASDFE

SEQ ID NO: 50096 - protein, 25 aa, synthetic construct
  source 1..25: note = Seed: QTVHSIPLTINKEEALQRPVASDFE
QTVHSIPFTIQKFEASQRPVASDFE

SEQ ID NO: 50097 - protein, 25 aa, synthetic construct
  source 1..25: note = Seed: QTVHSIPLTINKEEALQRPVASDFE
QTVHSIPFTIQKFEATQRPVASDFE

SEQ ID NO: 50098 - protein, 25 aa, synthetic construct
  source 1..25: note = Seed: QTVHSIPLTINKEEALQRPVASDFE
QTVHSIPFTIQKFEAVQRPVASDFE

SEQ ID NO: 50099 - protein, 25 aa, synthetic construct
  source 1..25: note = Seed: QTVHSIPLTINKEEALQRPVASDFE
QTVHSIPFTIQKFEAWQRPVASDFE

SEQ ID NO: 50100 - protein, 25 aa, synthetic construct
  source 1..25: note = Seed: QTVHSIPLTINKEEALQRPVASDFE
QTVHSIPFTIQKFEAYQRPVASDFE

SEQ ID NO: 50101 - protein, 25 aa, synthetic construct
  source 1..25: note = Seed: QTVHSIPLTINKEEALQRPVASDFE
QTVHSIPFTIQKIEAFQRPVASDFE

SEQ ID NO: 50102 - protein, 25 aa, synthetic construct
  source 1..25: note = Seed: QTVHSIPLTINKEEALQRPVASDFE
QTVHSIPFTIQKIEAIQRPVASDFE

SEQ ID NO: 50103 - protein, 25 aa, synthetic construct
  source 1..25: note = Seed: QTVHSIPLTINKEEALQRPVASDFE
QTVHSIPFTIQKIEALQRPVASDFE

SEQ ID NO: 50104 - protein, 25 aa, synthetic construct
  source 1..25: note = Seed: QTVHSIPLTINKEEALQRPVASDFE
QTVHSIPFTIQKLEAFQRPVASDFE

SEQ ID NO: 50105 - protein, 25 aa, synthetic construct
  source 1..25: note = Seed: QTVHSIPLTINKEEALQRPVASDFE
QTVHSIPFTIQKLEAIQRPVASDFE

SEQ ID NO: 50106 - protein, 25 aa, synthetic construct
  source 1..25: note = Seed: QTVHSIPLTINKEEALQRPVASDFE
QTVHSIPFTIQKLEALQRPVASDFE

SEQ ID NO: 50107 - protein, 25 aa, synthetic construct
  source 1..25: note = Seed: QTVHSIPLTINKEEALQRPVASDFE
QTVHSIPFTIQKLEAMQRPVASDFE

SEQ ID NO: 50108 - protein, 25 aa, synthetic construct
  source 1..25: note = Seed: QTVHSIPLTINKEEALQRPVASDFE
QTVHSIPFTIQKLEAVQRPVASDFE

SEQ ID NO: 50109 - protein, 25 aa, synthetic construct
  source 1..25: note = Seed: QTVHSIPLTINKEEALQRPVASDFE
QTVHSIPFTIQKMEALQRPVASDFE

SEQ ID NO: 50110 - protein, 25 aa, synthetic construct
  source 1..25: note = Seed: QTVHSIPLTINKEEALQRPVASDFE
QTVHSIPFTIQKWEAFQRPVASDFE

SEQ ID NO: 50111 - protein, 25 aa, synthetic construct
  source 1..25: note = Seed: QTVHSIPLTINKEEALQRPVASDFE
QTVHSIPFTIQKWEAIQRPVASDFE

SEQ ID NO: 50112 - protein, 25 aa, synthetic construct
  source 1..25: note = Seed: QTVHSIPLTINKEEALQRPVASDFE
QTVHSIPFTIQKWEALQRPVASDFE

SEQ ID NO: 50113 - protein, 25 aa, synthetic construct
  source 1..25: note = Seed: QTVHSIPLTINKEEALQRPVASDFE
QTVHSIPFTIQKYEAFQRPVASDFE

SEQ ID NO: 50114 - protein, 25 aa, synthetic construct
  source 1..25: note = Seed: QTVHSIPLTINKEEALQRPVASDFE
QTVHSIPFTIQKYEAIQRPVASDFE

SEQ ID NO: 50115 - protein, 25 aa, synthetic construct
  source 1..25: note = Seed: QTVHSIPLTINKEEALQRPVASDFE
QTVHSIPFTIQKYEALQRPVASDFE

SEQ ID NO: 50116 - protein, 25 aa, synthetic construct
  source 1..25: note = Seed: QTVHSIPLTINKEEALQRPVASDFE
QTVHSIPFTIQKYEAVQRPVASDFE

SEQ ID NO: 50117 - protein, 25 aa, synthetic construct
  source 1..25: note = Seed: QTVHSIPLTINKEEALQRPVASDFE
QTVHSIPFTIRKFEAFQRPVASDFE

SEQ ID NO: 50118 - protein, 25 aa, synthetic construct
  source 1..25: note = Seed: QTVHSIPLTINKEEALQRPVASDFE
QTVHSIPFTIRKFEAIQRPVASDFE

SEQ ID NO: 50119 - protein, 25 aa, synthetic construct
  source 1..25: note = Seed: QTVHSIPLTINKEEALQRPVASDFE
QTVHSIPFTIRKFEALQRPVASDFE

SEQ ID NO: 50120 - protein, 25 aa, synthetic construct
  source 1..25: note = Seed: QTVHSIPLTINKEEALQRPVASDFE
QTVHSIPFTIRKFEAMQRPVASDFE

SEQ ID NO: 50121 - protein, 25 aa, synthetic construct
  source 1..25: note = Seed: QTVHSIPLTINKEEALQRPVASDFE
QTVHSIPFTIRKFEAVQRPVASDFE

SEQ ID NO: 50122 - protein, 25 aa, synthetic construct
  source 1..25: note = Seed: QTVHSIPLTINKEEALQRPVASDFE
QTVHSIPFTISKFEAAQRPVASDFE

SEQ ID NO: 50123 - protein, 25 aa, synthetic construct
  source 1..25: note = Seed: QTVHSIPLTINKEEALQRPVASDFE
QTVHSIPFTISKFEACQRPVASDFE

SEQ ID NO: 50124 - protein, 25 aa, synthetic construct
  source 1..25: note = Seed: QTVHSIPLTINKEEALQRPVASDFE
QTVHSIPFTISKFEADQRPVASDFE

SEQ ID NO: 50125 - protein, 25 aa, synthetic construct
  source 1..25: note = Seed: QTVHSIPLTINKEEALQRPVASDFE
QTVHSIPFTISKFEAEQRPVASDFE

SEQ ID NO: 50126 - protein, 25 aa, synthetic construct
  source 1..25: note = Seed: QTVHSIPLTINKEEALQRPVASDFE
QTVHSIPFTISKFEAFQRPVASDFE

SEQ ID NO: 50127 - protein, 25 aa, synthetic construct
  source 1..25: note = Seed: QTVHSIPLTINKEEALQRPVASDFE
QTVHSIPFTISKFEAIQRPVASDFE

SEQ ID NO: 50128 - protein, 25 aa, synthetic construct
  source 1..25: note = Seed: QTVHSIPLTINKEEALQRPVASDFE
QTVHSIPFTISKFEALQRPVASDFE

SEQ ID NO: 50129 - protein, 25 aa, synthetic construct
  source 1..25: note = Seed: QTVHSIPLTINKEEALQRPVASDFE
QTVHSIPFTISKFEAMQRPVASDFE

SEQ ID NO: 50130 - protein, 25 aa, synthetic construct
  source 1..25: note = Seed: QTVHSIPLTINKEEALQRPVASDFE
QTVHSIPFTISKFEANQRPVASDFE

SEQ ID NO: 50131 - protein, 25 aa, synthetic construct
  source 1..25: note = Seed: QTVHSIPLTINKEEALQRPVASDFE
QTVHSIPFTISKFEASQRPVASDFE

SEQ ID NO: 50132 - protein, 25 aa, synthetic construct
  source 1..25: note = Seed: QTVHSIPLTINKEEALQRPVASDFE
QTVHSIPFTISKFEATQRPVASDFE

SEQ ID NO: 50133 - protein, 25 aa, synthetic construct
  source 1..25: note = Seed: QTVHSIPLTINKEEALQRPVASDFE
QTVHSIPFTISKFEAVQRPVASDFE

SEQ ID NO: 50134 - protein, 25 aa, synthetic construct
  source 1..25: note = Seed: QTVHSIPLTINKEEALQRPVASDFE
QTVHSIPFTISKFEAWQRPVASDFE

SEQ ID NO: 50135 - protein, 25 aa, synthetic construct
  source 1..25: note = Seed: QTVHSIPLTINKEEALQRPVASDFE
QTVHSIPFTISKFEAYQRPVASDFE

SEQ ID NO: 50136 - protein, 25 aa, synthetic construct
  source 1..25: note = Seed: QTVHSIPLTINKEEALQRPVASDFE
QTVHSIPFTISKIEAFQRPVASDFE

SEQ ID NO: 50137 - protein, 25 aa, synthetic construct
  source 1..25: note = Seed: QTVHSIPLTINKEEALQRPVASDFE
QTVHSIPFTISKIEAIQRPVASDFE

SEQ ID NO: 50138 - protein, 25 aa, synthetic construct
  source 1..25: note = Seed: QTVHSIPLTINKEEALQRPVASDFE
QTVHSIPFTISKIEALQRPVASDFE

SEQ ID NO: 50139 - protein, 25 aa, synthetic construct
  source 1..25: note = Seed: QTVHSIPLTINKEEALQRPVASDFE
QTVHSIPFTISKIEAVQRPVASDFE

SEQ ID NO: 50140 - protein, 25 aa, synthetic construct
  source 1..25: note = Seed: QTVHSIPLTINKEEALQRPVASDFE
QTVHSIPFTISKLEAFQRPVASDFE

SEQ ID NO: 50141 - protein, 25 aa, synthetic construct
  source 1..25: note = Seed: QTVHSIPLTINKEEALQRPVASDFE
QTVHSIPFTISKLEAIQRPVASDFE

SEQ ID NO: 50142 - protein, 25 aa, synthetic construct
  source 1..25: note = Seed: QTVHSIPLTINKEEALQRPVASDFE
QTVHSIPFTISKLEALQRPVASDFE

SEQ ID NO: 50143 - protein, 25 aa, synthetic construct
  source 1..25: note = Seed: QTVHSIPLTINKEEALQRPVASDFE
QTVHSIPFTISKLEAMQRPVASDFE

SEQ ID NO: 50144 - protein, 25 aa, synthetic construct
  source 1..25: note = Seed: QTVHSIPLTINKEEALQRPVASDFE
QTVHSIPFTISKLEAVQRPVASDFE

SEQ ID NO: 50145 - protein, 25 aa, synthetic construct
  source 1..25: note = Seed: QTVHSIPLTINKEEALQRPVASDFE
QTVHSIPFTISKMEAIQRPVASDFE

SEQ ID NO: 50146 - protein, 25 aa, synthetic construct
  source 1..25: note = Seed: QTVHSIPLTINKEEALQRPVASDFE
QTVHSIPFTISKMEALQRPVASDFE

SEQ ID NO: 50147 - protein, 25 aa, synthetic construct
  source 1..25: note = Seed: QTVHSIPLTINKEEALQRPVASDFE
QTVHSIPFTISKMEAVQRPVASDFE

SEQ ID NO: 50148 - protein, 25 aa, synthetic construct
  source 1..25: note = Seed: QTVHSIPLTINKEEALQRPVASDFE
QTVHSIPFTISKNEAIQRPVASDFE

SEQ ID NO: 50149 - protein, 25 aa, synthetic construct
  source 1..25: note = Seed: QTVHSIPLTINKEEALQRPVASDFE
QTVHSIPFTISKNEAVQRPVASDFE

SEQ ID NO: 50150 - protein, 25 aa, synthetic construct
  source 1..25: note = Seed: QTVHSIPLTINKEEALQRPVASDFE
QTVHSIPFTISKWEAFQRPVASDFE

SEQ ID NO: 50151 - protein, 25 aa, synthetic construct
  source 1..25: note = Seed: QTVHSIPLTINKEEALQRPVASDFE
QTVHSIPFTISKWEAIQRPVASDFE

SEQ ID NO: 50152 - protein, 25 aa, synthetic construct
  source 1..25: note = Seed: QTVHSIPLTINKEEALQRPVASDFE
QTVHSIPFTISKWEALQRPVASDFE

SEQ ID NO: 50153 - protein, 25 aa, synthetic construct
  source 1..25: note = Seed: QTVHSIPLTINKEEALQRPVASDFE
QTVHSIPFTISKWEAMQRPVASDFE

SEQ ID NO: 50154 - protein, 25 aa, synthetic construct
  source 1..25: note = Seed: QTVHSIPLTINKEEALQRPVASDFE
QTVHSIPFTISKWEAVQRPVASDFE

SEQ ID NO: 50155 - protein, 25 aa, synthetic construct
  source 1..25: note = Seed: QTVHSIPLTINKEEALQRPVASDFE
QTVHSIPFTISKYEAFQRPVASDFE

SEQ ID NO: 50156 - protein, 25 aa, synthetic construct
  source 1..25: note = Seed: QTVHSIPLTINKEEALQRPVASDFE
QTVHSIPFTISKYEAIQRPVASDFE

SEQ ID NO: 50157 - protein, 25 aa, synthetic construct
  source 1..25: note = Seed: QTVHSIPLTINKEEALQRPVASDFE
QTVHSIPFTISKYEALQRPVASDFE

SEQ ID NO: 50158 - protein, 25 aa, synthetic construct
  source 1..25: note = Seed: QTVHSIPLTINKEEALQRPVASDFE
QTVHSIPFTISKYEAMQRPVASDFE

SEQ ID NO: 50159 - protein, 25 aa, synthetic construct
  source 1..25: note = Seed: QTVHSIPLTINKEEALQRPVASDFE
QTVHSIPFTISKYEAVQRPVASDFE

SEQ ID NO: 50160 - protein, 25 aa, synthetic construct
  source 1..25: note = Seed: QTVHSIPLTINKEEALQRPVASDFE
QTVHSIPFTITKFEAAQRPVASDFE

SEQ ID NO: 50161 - protein, 25 aa, synthetic construct
  source 1..25: note = Seed: QTVHSIPLTINKEEALQRPVASDFE
QTVHSIPFTITKFEACQRPVASDFE

SEQ ID NO: 50162 - protein, 25 aa, synthetic construct
  source 1..25: note = Seed: QTVHSIPLTINKEEALQRPVASDFE
QTVHSIPFTITKFEADQRPVASDFE

SEQ ID NO: 50163 - protein, 25 aa, synthetic construct
  source 1..25: note = Seed: QTVHSIPLTINKEEALQRPVASDFE
QTVHSIPFTITKFEAEQRPVASDFE

SEQ ID NO: 50164 - protein, 25 aa, synthetic construct
  source 1..25: note = Seed: QTVHSIPLTINKEEALQRPVASDFE
QTVHSIPFTITKFEAFQRPVASDFE

SEQ ID NO: 50165 - protein, 25 aa, synthetic construct
  source 1..25: note = Seed: QTVHSIPLTINKEEALQRPVASDFE
QTVHSIPFTITKFEAHQRPVASDFE

SEQ ID NO: 50166 - protein, 25 aa, synthetic construct
  source 1..25: note = Seed: QTVHSIPLTINKEEALQRPVASDFE
QTVHSIPFTITKFEAIQRPVASDFE

SEQ ID NO: 50167 - protein, 25 aa, synthetic construct
  source 1..25: note = Seed: QTVHSIPLTINKEEALQRPVASDFE
QTVHSIPFTITKFEALQRPVASDFE

SEQ ID NO: 50168 - protein, 25 aa, synthetic construct
  source 1..25: note = Seed: QTVHSIPLTINKEEALQRPVASDFE
QTVHSIPFTITKFEAMQRPVASDFE

SEQ ID NO: 50169 - protein, 25 aa, synthetic construct
  source 1..25: note = Seed: QTVHSIPLTINKEEALQRPVASDFE
QTVHSIPFTITKFEANQRPVASDFE

SEQ ID NO: 50170 - protein, 25 aa, synthetic construct
  source 1..25: note = Seed: QTVHSIPLTINKEEALQRPVASDFE
QTVHSIPFTITKFEAPQRPVASDFE

SEQ ID NO: 50171 - protein, 25 aa, synthetic construct
  source 1..25: note = Seed: QTVHSIPLTINKEEALQRPVASDFE
QTVHSIPFTITKFEAQQRPVASDFE

SEQ ID NO: 50172 - protein, 25 aa, synthetic construct
  source 1..25: note = Seed: QTVHSIPLTINKEEALQRPVASDFE
QTVHSIPFTITKFEASQRPVASDFE

SEQ ID NO: 50173 - protein, 25 aa, synthetic construct
  source 1..25: note = Seed: QTVHSIPLTINKEEALQRPVASDFE
QTVHSIPFTITKFEATQRPVASDFE

SEQ ID NO: 50174 - protein, 25 aa, synthetic construct
  source 1..25: note = Seed: QTVHSIPLTINKEEALQRPVASDFE
QTVHSIPFTITKFEAVQRPVASDFE

SEQ ID NO: 50175 - protein, 25 aa, synthetic construct
  source 1..25: note = Seed: QTVHSIPLTINKEEALQRPVASDFE
QTVHSIPFTITKFEAWQRPVASDFE

SEQ ID NO: 50176 - protein, 25 aa, synthetic construct
  source 1..25: note = Seed: QTVHSIPLTINKEEALQRPVASDFE
QTVHSIPFTITKFEAYQRPVASDFE

SEQ ID NO: 50177 - protein, 25 aa, synthetic construct
  source 1..25: note = Seed: QTVHSIPLTINKEEALQRPVASDFE
QTVHSIPFTITKIEAFQRPVASDFE

SEQ ID NO: 50178 - protein, 25 aa, synthetic construct
  source 1..25: note = Seed: QTVHSIPLTINKEEALQRPVASDFE
QTVHSIPFTITKIEAIQRPVASDFE

SEQ ID NO: 50179 - protein, 25 aa, synthetic construct
  source 1..25: note = Seed: QTVHSIPLTINKEEALQRPVASDFE
QTVHSIPFTITKIEALQRPVASDFE

SEQ ID NO: 50180 - protein, 25 aa, synthetic construct
  source 1..25: note = Seed: QTVHSIPLTINKEEALQRPVASDFE
QTVHSIPFTITKIEAMQRPVASDFE

SEQ ID NO: 50181 - protein, 25 aa, synthetic construct
  source 1..25: note = Seed: QTVHSIPLTINKEEALQRPVASDFE
QTVHSIPFTITKIEAVQRPVASDFE

SEQ ID NO: 50182 - protein, 25 aa, synthetic construct
  source 1..25: note = Seed: QTVHSIPLTINKEEALQRPVASDFE
QTVHSIPFTITKLEAFQRPVASDFE

SEQ ID NO: 50183 - protein, 25 aa, synthetic construct
  source 1..25: note = Seed: QTVHSIPLTINKEEALQRPVASDFE
QTVHSIPFTITKLEAIQRPVASDFE

SEQ ID NO: 50184 - protein, 25 aa, synthetic construct
  source 1..25: note = Seed: QTVHSIPLTINKEEALQRPVASDFE
QTVHSIPFTITKLEALQRPVASDFE

SEQ ID NO: 50185 - protein, 25 aa, synthetic construct
  source 1..25: note = Seed: QTVHSIPLTINKEEALQRPVASDFE
QTVHSIPFTITKLEAMQRPVASDFE

SEQ ID NO: 50186 - protein, 25 aa, synthetic construct
  source 1..25: note = Seed: QTVHSIPLTINKEEALQRPVASDFE
QTVHSIPFTITKLEAVQRPVASDFE

SEQ ID NO: 50187 - protein, 25 aa, synthetic construct
  source 1..25: note = Seed: QTVHSIPLTINKEEALQRPVASDFE
QTVHSIPFTITKLEAYQRPVASDFE

SEQ ID NO: 50188 - protein, 25 aa, synthetic construct
  source 1..25: note = Seed: QTVHSIPLTINKEEALQRPVASDFE
QTVHSIPFTITKMEAFQRPVASDFE

SEQ ID NO: 50189 - protein, 25 aa, synthetic construct
  source 1..25: note = Seed: QTVHSIPLTINKEEALQRPVASDFE
QTVHSIPFTITKMEAIQRPVASDFE

SEQ ID NO: 50190 - protein, 25 aa, synthetic construct
  source 1..25: note = Seed: QTVHSIPLTINKEEALQRPVASDFE
QTVHSIPFTITKMEALQRPVASDFE

SEQ ID NO: 50191 - protein, 25 aa, synthetic construct
  source 1..25: note = Seed: QTVHSIPLTINKEEALQRPVASDFE
QTVHSIPFTITKMEAMQRPVASDFE

SEQ ID NO: 50192 - protein, 25 aa, synthetic construct
  source 1..25: note = Seed: QTVHSIPLTINKEEALQRPVASDFE
QTVHSIPFTITKMEAVQRPVASDFE

SEQ ID NO: 50193 - protein, 25 aa, synthetic construct
  source 1..25: note = Seed: QTVHSIPLTINKEEALQRPVASDFE
QTVHSIPFTITKVEAIQRPVASDFE

SEQ ID NO: 50194 - protein, 25 aa, synthetic construct
  source 1..25: note = Seed: QTVHSIPLTINKEEALQRPVASDFE
QTVHSIPFTITKVEALQRPVASDFE

SEQ ID NO: 50195 - protein, 25 aa, synthetic construct
  source 1..25: note = Seed: QTVHSIPLTINKEEALQRPVASDFE
QTVHSIPFTITKWEAFQRPVASDFE

SEQ ID NO: 50196 - protein, 25 aa, synthetic construct
  source 1..25: note = Seed: QTVHSIPLTINKEEALQRPVASDFE
QTVHSIPFTITKWEAIQRPVASDFE

SEQ ID NO: 50197 - protein, 25 aa, synthetic construct
  source 1..25: note = Seed: QTVHSIPLTINKEEALQRPVASDFE
QTVHSIPFTITKWEALQRPVASDFE

SEQ ID NO: 50198 - protein, 25 aa, synthetic construct
  source 1..25: note = Seed: QTVHSIPLTINKEEALQRPVASDFE
QTVHSIPFTITKWEAMQRPVASDFE

SEQ ID NO: 50199 - protein, 25 aa, synthetic construct
  source 1..25: note = Seed: QTVHSIPLTINKEEALQRPVASDFE
QTVHSIPFTITKWEAVQRPVASDFE

SEQ ID NO: 50200 - protein, 25 aa, synthetic construct
  source 1..25: note = Seed: QTVHSIPLTINKEEALQRPVASDFE
QTVHSIPFTITKYEAFQRPVASDFE

SEQ ID NO: 50201 - protein, 25 aa, synthetic construct
  source 1..25: note = Seed: QTVHSIPLTINKEEALQRPVASDFE
QTVHSIPFTITKYEAIQRPVASDFE

SEQ ID NO: 50202 - protein, 25 aa, synthetic construct
  source 1..25: note = Seed: QTVHSIPLTINKEEALQRPVASDFE
QTVHSIPFTITKYEALQRPVASDFE

SEQ ID NO: 50203 - protein, 25 aa, synthetic construct
  source 1..25: note = Seed: QTVHSIPLTINKEEALQRPVASDFE
QTVHSIPFTITKYEAMQRPVASDFE

SEQ ID NO: 50204 - protein, 25 aa, synthetic construct
  source 1..25: note = Seed: QTVHSIPLTINKEEALQRPVASDFE
QTVHSIPFTITKYEAVQRPVASDFE

SEQ ID NO: 50205 - protein, 25 aa, synthetic construct
  source 1..25: note = Seed: QTVHSIPLTINKEEALQRPVASDFE
QTVHSIPFTITKYEAYQRPVASDFE

SEQ ID NO: 50206 - protein, 25 aa, synthetic construct
  source 1..25: note = Seed: QTVHSIPLTINKEEALQRPVASDFE
QTVHSIPFTIVKAEAFQRPVASDFE

SEQ ID NO: 50207 - protein, 25 aa, synthetic construct
  source 1..25: note = Seed: QTVHSIPLTINKEEALQRPVASDFE
QTVHSIPFTIVKAEAIQRPVASDFE

SEQ ID NO: 50208 - protein, 25 aa, synthetic construct
  source 1..25: note = Seed: QTVHSIPLTINKEEALQRPVASDFE
QTVHSIPFTIVKAEALQRPVASDFE

SEQ ID NO: 50209 - protein, 25 aa, synthetic construct
  source 1..25: note = Seed: QTVHSIPLTINKEEALQRPVASDFE
QTVHSIPFTIVKAEAMQRPVASDFE

SEQ ID NO: 50210 - protein, 25 aa, synthetic construct
  source 1..25: note = Seed: QTVHSIPLTINKEEALQRPVASDFE
QTVHSIPFTIVKAEAVQRPVASDFE

SEQ ID NO: 50211 - protein, 25 aa, synthetic construct
  source 1..25: note = Seed: QTVHSIPLTINKEEALQRPVASDFE
QTVHSIPFTIVKAEAYQRPVASDFE

SEQ ID NO: 50212 - protein, 25 aa, synthetic construct
  source 1..25: note = Seed: QTVHSIPLTINKEEALQRPVASDFE
QTVHSIPFTIVKEEAFQRPVASDFE

SEQ ID NO: 50213 - protein, 25 aa, synthetic construct
  source 1..25: note = Seed: QTVHSIPLTINKEEALQRPVASDFE
QTVHSIPFTIVKFEAAQRPVASDFE

SEQ ID NO: 50214 - protein, 25 aa, synthetic construct
  source 1..25: note = Seed: QTVHSIPLTINKEEALQRPVASDFE
QTVHSIPFTIVKFEACQRPVASDFE

SEQ ID NO: 50215 - protein, 25 aa, synthetic construct
  source 1..25: note = Seed: QTVHSIPLTINKEEALQRPVASDFE
QTVHSIPFTIVKFEADQRPVASDFE

SEQ ID NO: 50216 - protein, 25 aa, synthetic construct
  source 1..25: note = Seed: QTVHSIPLTINKEEALQRPVASDFE
QTVHSIPFTIVKFEAEQRPVASDFE

SEQ ID NO: 50217 - protein, 25 aa, synthetic construct
  source 1..25: note = Seed: QTVHSIPLTINKEEALQRPVASDFE
QTVHSIPFTIVKFEAFQRPVASDFE

SEQ ID NO: 50218 - protein, 25 aa, synthetic construct
  source 1..25: note = Seed: QTVHSIPLTINKEEALQRPVASDFE
QTVHSIPFTIVKFEAGQRPVASDFE

SEQ ID NO: 50219 - protein, 25 aa, synthetic construct
  source 1..25: note = Seed: QTVHSIPLTINKEEALQRPVASDFE
QTVHSIPFTIVKFEAHQRPVASDFE

SEQ ID NO: 50220 - protein, 25 aa, synthetic construct
  source 1..25: note = Seed: QTVHSIPLTINKEEALQRPVASDFE
QTVHSIPFTIVKFEAIQRPVASDFE

SEQ ID NO: 50221 - protein, 25 aa, synthetic construct
  source 1..25: note = Seed: QTVHSIPLTINKEEALQRPVASDFE
QTVHSIPFTIVKFEAKQRPVASDFE

SEQ ID NO: 50222 - protein, 25 aa, synthetic construct
  source 1..25: note = Seed: QTVHSIPLTINKEEALQRPVASDFE
QTVHSIPFTIVKFEALQRPVASDFE

SEQ ID NO: 50223 - protein, 25 aa, synthetic construct
  source 1..25: note = Seed: QTVHSIPLTINKEEALQRPVASDFE
QTVHSIPFTIVKFEAMQRPVASDFE

SEQ ID NO: 50224 - protein, 25 aa, synthetic construct
  source 1..25: note = Seed: QTVHSIPLTINKEEALQRPVASDFE
QTVHSIPFTIVKFEANQRPVASDFE

SEQ ID NO: 50225 - protein, 25 aa, synthetic construct
  source 1..25: note = Seed: QTVHSIPLTINKEEALQRPVASDFE
QTVHSIPFTIVKFEAPQRPVASDFE

SEQ ID NO: 50226 - protein, 25 aa, synthetic construct
  source 1..25: note = Seed: QTVHSIPLTINKEEALQRPVASDFE
QTVHSIPFTIVKFEAQQRPVASDFE

SEQ ID NO: 50227 - protein, 25 aa, synthetic construct
  source 1..25: note = Seed: QTVHSIPLTINKEEALQRPVASDFE
QTVHSIPFTIVKFEARQRPVASDFE

SEQ ID NO: 50228 - protein, 25 aa, synthetic construct
  source 1..25: note = Seed: QTVHSIPLTINKEEALQRPVASDFE
QTVHSIPFTIVKFEASQRPVASDFE

SEQ ID NO: 50229 - protein, 25 aa, synthetic construct
  source 1..25: note = Seed: QTVHSIPLTINKEEALQRPVASDFE
QTVHSIPFTIVKFEATQRPVASDFE

SEQ ID NO: 50230 - protein, 25 aa, synthetic construct
  source 1..25: note = Seed: QTVHSIPLTINKEEALQRPVASDFE
QTVHSIPFTIVKFEAVQRPVASDFE

SEQ ID NO: 50231 - protein, 25 aa, synthetic construct
  source 1..25: note = Seed: QTVHSIPLTINKEEALQRPVASDFE
QTVHSIPFTIVKFEAWQRPVASDFE

SEQ ID NO: 50232 - protein, 25 aa, synthetic construct
  source 1..25: note = Seed: QTVHSIPLTINKEEALQRPVASDFE
QTVHSIPFTIVKFEAYQRPVASDFE

SEQ ID NO: 50233 - protein, 25 aa, synthetic construct
  source 1..25: note = Seed: QTVHSIPLTINKEEALQRPVASDFE
QTVHSIPFTIVKHEAFQRPVASDFE

SEQ ID NO: 50234 - protein, 25 aa, synthetic construct
  source 1..25: note = Seed: QTVHSIPLTINKEEALQRPVASDFE
QTVHSIPFTIVKHEAIQRPVASDFE

SEQ ID NO: 50235 - protein, 25 aa, synthetic construct
  source 1..25: note = Seed: QTVHSIPLTINKEEALQRPVASDFE
QTVHSIPFTIVKHEALQRPVASDFE

SEQ ID NO: 50236 - protein, 25 aa, synthetic construct
  source 1..25: note = Seed: QTVHSIPLTINKEEALQRPVASDFE
QTVHSIPFTIVKHEAVQRPVASDFE

SEQ ID NO: 50237 - protein, 25 aa, synthetic construct
  source 1..25: note = Seed: QTVHSIPLTINKEEALQRPVASDFE
QTVHSIPFTIVKIEAAQRPVASDFE

SEQ ID NO: 50238 - protein, 25 aa, synthetic construct
  source 1..25: note = Seed: QTVHSIPLTINKEEALQRPVASDFE
QTVHSIPFTIVKIEADQRPVASDFE

SEQ ID NO: 50239 - protein, 25 aa, synthetic construct
  source 1..25: note = Seed: QTVHSIPLTINKEEALQRPVASDFE
QTVHSIPFTIVKIEAEQRPVASDFE

SEQ ID NO: 50240 - protein, 25 aa, synthetic construct
  source 1..25: note = Seed: QTVHSIPLTINKEEALQRPVASDFE
QTVHSIPFTIVKIEAFQRPVASDFE

SEQ ID NO: 50241 - protein, 25 aa, synthetic construct
  source 1..25: note = Seed: QTVHSIPLTINKEEALQRPVASDFE
QTVHSIPFTIVKIEAIQRPVASDFE

SEQ ID NO: 50242 - protein, 25 aa, synthetic construct
  source 1..25: note = Seed: QTVHSIPLTINKEEALQRPVASDFE
QTVHSIPFTIVKIEALQRPVASDFE

SEQ ID NO: 50243 - protein, 25 aa, synthetic construct
  source 1..25: note = Seed: QTVHSIPLTINKEEALQRPVASDFE
QTVHSIPFTIVKIEAMQRPVASDFE

SEQ ID NO: 50244 - protein, 25 aa, synthetic construct
  source 1..25: note = Seed: QTVHSIPLTINKEEALQRPVASDFE
QTVHSIPFTIVKIEANQRPVASDFE

SEQ ID NO: 50245 - protein, 25 aa, synthetic construct
  source 1..25: note = Seed: QTVHSIPLTINKEEALQRPVASDFE
QTVHSIPFTIVKIEAQQRPVASDFE

SEQ ID NO: 50246 - protein, 25 aa, synthetic construct
  source 1..25: note = Seed: QTVHSIPLTINKEEALQRPVASDFE
QTVHSIPFTIVKIEARQRPVASDFE

SEQ ID NO: 50247 - protein, 25 aa, synthetic construct
  source 1..25: note = Seed: QTVHSIPLTINKEEALQRPVASDFE
QTVHSIPFTIVKIEASQRPVASDFE

SEQ ID NO: 50248 - protein, 25 aa, synthetic construct
  source 1..25: note = Seed: QTVHSIPLTINKEEALQRPVASDFE
QTVHSIPFTIVKIEATQRPVASDFE

SEQ ID NO: 50249 - protein, 25 aa, synthetic construct
  source 1..25: note = Seed: QTVHSIPLTINKEEALQRPVASDFE
QTVHSIPFTIVKIEAVQRPVASDFE

SEQ ID NO: 50250 - protein, 25 aa, synthetic construct
  source 1..25: note = Seed: QTVHSIPLTINKEEALQRPVASDFE
QTVHSIPFTIVKIEAWQRPVASDFE

SEQ ID NO: 50251 - protein, 25 aa, synthetic construct
  source 1..25: note = Seed: QTVHSIPLTINKEEALQRPVASDFE
QTVHSIPFTIVKIEAYQRPVASDFE

SEQ ID NO: 50252 - protein, 25 aa, synthetic construct
  source 1..25: note = Seed: QTVHSIPLTINKEEALQRPVASDFE
QTVHSIPFTIVKLEAAQRPVASDFE

SEQ ID NO: 50253 - protein, 25 aa, synthetic construct
  source 1..25: note = Seed: QTVHSIPLTINKEEALQRPVASDFE
QTVHSIPFTIVKLEADQRPVASDFE

SEQ ID NO: 50254 - protein, 25 aa, synthetic construct
  source 1..25: note = Seed: QTVHSIPLTINKEEALQRPVASDFE
QTVHSIPFTIVKLEAEQRPVASDFE

SEQ ID NO: 50255 - protein, 25 aa, synthetic construct
  source 1..25: note = Seed: QTVHSIPLTINKEEALQRPVASDFE
QTVHSIPFTIVKLEAFQRPVASDFE

SEQ ID NO: 50256 - protein, 25 aa, synthetic construct
  source 1..25: note = Seed: QTVHSIPLTINKEEALQRPVASDFE
QTVHSIPFTIVKLEAGQRPVASDFE

SEQ ID NO: 50257 - protein, 25 aa, synthetic construct
  source 1..25: note = Seed: QTVHSIPLTINKEEALQRPVASDFE
QTVHSIPFTIVKLEAHQRPVASDFE

SEQ ID NO: 50258 - protein, 25 aa, synthetic construct
  source 1..25: note = Seed: QTVHSIPLTINKEEALQRPVASDFE
QTVHSIPFTIVKLEAIQRPVASDFE

SEQ ID NO: 50259 - protein, 25 aa, synthetic construct
  source 1..25: note = Seed: QTVHSIPLTINKEEALQRPVASDFE
QTVHSIPFTIVKLEALQRPVASDFE

SEQ ID NO: 50260 - protein, 25 aa, synthetic construct
  source 1..25: note = Seed: QTVHSIPLTINKEEALQRPVASDFE
QTVHSIPFTIVKLEAMQRPVASDFE

SEQ ID NO: 50261 - protein, 25 aa, synthetic construct
  source 1..25: note = Seed: QTVHSIPLTINKEEALQRPVASDFE
QTVHSIPFTIVKLEANQRPVASDFE

SEQ ID NO: 50262 - protein, 25 aa, synthetic construct
  source 1..25: note = Seed: QTVHSIPLTINKEEALQRPVASDFE
QTVHSIPFTIVKLEAPQRPVASDFE

SEQ ID NO: 50263 - protein, 25 aa, synthetic construct
  source 1..25: note = Seed: QTVHSIPLTINKEEALQRPVASDFE
QTVHSIPFTIVKLEAQQRPVASDFE

SEQ ID NO: 50264 - protein, 25 aa, synthetic construct
  source 1..25: note = Seed: QTVHSIPLTINKEEALQRPVASDFE
QTVHSIPFTIVKLEARQRPVASDFE

SEQ ID NO: 50265 - protein, 25 aa, synthetic construct
  source 1..25: note = Seed: QTVHSIPLTINKEEALQRPVASDFE
QTVHSIPFTIVKLEASQRPVASDFE

SEQ ID NO: 50266 - protein, 25 aa, synthetic construct
  source 1..25: note = Seed: QTVHSIPLTINKEEALQRPVASDFE
QTVHSIPFTIVKLEATQRPVASDFE

SEQ ID NO: 50267 - protein, 25 aa, synthetic construct
  source 1..25: note = Seed: QTVHSIPLTINKEEALQRPVASDFE
QTVHSIPFTIVKLEAVQRPVASDFE

SEQ ID NO: 50268 - protein, 25 aa, synthetic construct
  source 1..25: note = Seed: QTVHSIPLTINKEEALQRPVASDFE
QTVHSIPFTIVKLEAWQRPVASDFE

SEQ ID NO: 50269 - protein, 25 aa, synthetic construct
  source 1..25: note = Seed: QTVHSIPLTINKEEALQRPVASDFE
QTVHSIPFTIVKLEAYQRPVASDFE

SEQ ID NO: 50270 - protein, 25 aa, synthetic construct
  source 1..25: note = Seed: QTVHSIPLTINKEEALQRPVASDFE
QTVHSIPFTIVKMEAAQRPVASDFE

SEQ ID NO: 50271 - protein, 25 aa, synthetic construct
  source 1..25: note = Seed: QTVHSIPLTINKEEALQRPVASDFE
QTVHSIPFTIVKMEAEQRPVASDFE

SEQ ID NO: 50272 - protein, 25 aa, synthetic construct
  source 1..25: note = Seed: QTVHSIPLTINKEEALQRPVASDFE
QTVHSIPFTIVKMEAFQRPVASDFE

SEQ ID NO: 50273 - protein, 25 aa, synthetic construct
  source 1..25: note = Seed: QTVHSIPLTINKEEALQRPVASDFE
QTVHSIPFTIVKMEAIQRPVASDFE

SEQ ID NO: 50274 - protein, 25 aa, synthetic construct
  source 1..25: note = Seed: QTVHSIPLTINKEEALQRPVASDFE
QTVHSIPFTIVKMEALQRPVASDFE

SEQ ID NO: 50275 - protein, 25 aa, synthetic construct
  source 1..25: note = Seed: QTVHSIPLTINKEEALQRPVASDFE
QTVHSIPFTIVKMEAMQRPVASDFE

SEQ ID NO: 50276 - protein, 25 aa, synthetic construct
  source 1..25: note = Seed: QTVHSIPLTINKEEALQRPVASDFE
QTVHSIPFTIVKMEANQRPVASDFE

SEQ ID NO: 50277 - protein, 25 aa, synthetic construct
  source 1..25: note = Seed: QTVHSIPLTINKEEALQRPVASDFE
QTVHSIPFTIVKMEASQRPVASDFE

SEQ ID NO: 50278 - protein, 25 aa, synthetic construct
  source 1..25: note = Seed: QTVHSIPLTINKEEALQRPVASDFE
QTVHSIPFTIVKMEATQRPVASDFE

SEQ ID NO: 50279 - protein, 25 aa, synthetic construct
  source 1..25: note = Seed: QTVHSIPLTINKEEALQRPVASDFE
QTVHSIPFTIVKMEAVQRPVASDFE

SEQ ID NO: 50280 - protein, 25 aa, synthetic construct
  source 1..25: note = Seed: QTVHSIPLTINKEEALQRPVASDFE
QTVHSIPFTIVKMEAYQRPVASDFE

SEQ ID NO: 50281 - protein, 25 aa, synthetic construct
  source 1..25: note = Seed: QTVHSIPLTINKEEALQRPVASDFE
QTVHSIPFTIVKPEAFQRPVASDFE

SEQ ID NO: 50282 - protein, 25 aa, synthetic construct
  source 1..25: note = Seed: QTVHSIPLTINKEEALQRPVASDFE
QTVHSIPFTIVKSEAFQRPVASDFE

SEQ ID NO: 50283 - protein, 25 aa, synthetic construct
  source 1..25: note = Seed: QTVHSIPLTINKEEALQRPVASDFE
QTVHSIPFTIVKSEAIQRPVASDFE

SEQ ID NO: 50284 - protein, 25 aa, synthetic construct
  source 1..25: note = Seed: QTVHSIPLTINKEEALQRPVASDFE
QTVHSIPFTIVKSEALQRPVASDFE

SEQ ID NO: 50285 - protein, 25 aa, synthetic construct
  source 1..25: note = Seed: QTVHSIPLTINKEEALQRPVASDFE
QTVHSIPFTIVKSEAVQRPVASDFE

SEQ ID NO: 50286 - protein, 25 aa, synthetic construct
  source 1..25: note = Seed: QTVHSIPLTINKEEALQRPVASDFE
QTVHSIPFTIVKTEAFQRPVASDFE

SEQ ID NO: 50287 - protein, 25 aa, synthetic construct
  source 1..25: note = Seed: QTVHSIPLTINKEEALQRPVASDFE
QTVHSIPFTIVKTEALQRPVASDFE

SEQ ID NO: 50288 - protein, 25 aa, synthetic construct
  source 1..25: note = Seed: QTVHSIPLTINKEEALQRPVASDFE
QTVHSIPFTIVKVEAFQRPVASDFE

SEQ ID NO: 50289 - protein, 25 aa, synthetic construct
  source 1..25: note = Seed: QTVHSIPLTINKEEALQRPVASDFE
QTVHSIPFTIVKVEAIQRPVASDFE

SEQ ID NO: 50290 - protein, 25 aa, synthetic construct
  source 1..25: note = Seed: QTVHSIPLTINKEEALQRPVASDFE
QTVHSIPFTIVKVEALQRPVASDFE

SEQ ID NO: 50291 - protein, 25 aa, synthetic construct
  source 1..25: note = Seed: QTVHSIPLTINKEEALQRPVASDFE
QTVHSIPFTIVKVEAMQRPVASDFE

SEQ ID NO: 50292 - protein, 25 aa, synthetic construct
  source 1..25: note = Seed: QTVHSIPLTINKEEALQRPVASDFE
QTVHSIPFTIVKVEATQRPVASDFE

SEQ ID NO: 50293 - protein, 25 aa, synthetic construct
  source 1..25: note = Seed: QTVHSIPLTINKEEALQRPVASDFE
QTVHSIPFTIVKVEAVQRPVASDFE

SEQ ID NO: 50294 - protein, 25 aa, synthetic construct
  source 1..25: note = Seed: QTVHSIPLTINKEEALQRPVASDFE
QTVHSIPFTIVKVEAYQRPVASDFE

SEQ ID NO: 50295 - protein, 25 aa, synthetic construct
  source 1..25: note = Seed: QTVHSIPLTINKEEALQRPVASDFE
QTVHSIPFTIVKWEAAQRPVASDFE

SEQ ID NO: 50296 - protein, 25 aa, synthetic construct
  source 1..25: note = Seed: QTVHSIPLTINKEEALQRPVASDFE
QTVHSIPFTIVKWEADQRPVASDFE

SEQ ID NO: 50297 - protein, 25 aa, synthetic construct
  source 1..25: note = Seed: QTVHSIPLTINKEEALQRPVASDFE
QTVHSIPFTIVKWEAEQRPVASDFE

SEQ ID NO: 50298 - protein, 25 aa, synthetic construct
  source 1..25: note = Seed: QTVHSIPLTINKEEALQRPVASDFE
QTVHSIPFTIVKWEAFQRPVASDFE

SEQ ID NO: 50299 - protein, 25 aa, synthetic construct
  source 1..25: note = Seed: QTVHSIPLTINKEEALQRPVASDFE
QTVHSIPFTIVKWEAIQRPVASDFE

SEQ ID NO: 50300 - protein, 25 aa, synthetic construct
  source 1..25: note = Seed: QTVHSIPLTINKEEALQRPVASDFE
QTVHSIPFTIVKWEALQRPVASDFE

SEQ ID NO: 50301 - protein, 25 aa, synthetic construct
  source 1..25: note = Seed: QTVHSIPLTINKEEALQRPVASDFE
QTVHSIPFTIVKWEAMQRPVASDFE

SEQ ID NO: 50302 - protein, 25 aa, synthetic construct
  source 1..25: note = Seed: QTVHSIPLTINKEEALQRPVASDFE
QTVHSIPFTIVKWEANQRPVASDFE

SEQ ID NO: 50303 - protein, 25 aa, synthetic construct
  source 1..25: note = Seed: QTVHSIPLTINKEEALQRPVASDFE
QTVHSIPFTIVKWEAPQRPVASDFE

SEQ ID NO: 50304 - protein, 25 aa, synthetic construct
  source 1..25: note = Seed: QTVHSIPLTINKEEALQRPVASDFE
QTVHSIPFTIVKWEAQQRPVASDFE

SEQ ID NO: 50305 - protein, 25 aa, synthetic construct
  source 1..25: note = Seed: QTVHSIPLTINKEEALQRPVASDFE
QTVHSIPFTIVKWEASQRPVASDFE

SEQ ID NO: 50306 - protein, 25 aa, synthetic construct
  source 1..25: note = Seed: QTVHSIPLTINKEEALQRPVASDFE
QTVHSIPFTIVKWEATQRPVASDFE

SEQ ID NO: 50307 - protein, 25 aa, synthetic construct
  source 1..25: note = Seed: QTVHSIPLTINKEEALQRPVASDFE
QTVHSIPFTIVKWEAVQRPVASDFE

SEQ ID NO: 50308 - protein, 25 aa, synthetic construct
  source 1..25: note = Seed: QTVHSIPLTINKEEALQRPVASDFE
QTVHSIPFTIVKWEAYQRPVASDFE

SEQ ID NO: 50309 - protein, 25 aa, synthetic construct
  source 1..25: note = Seed: QTVHSIPLTINKEEALQRPVASDFE
QTVHSIPFTIVKYEAAQRPVASDFE

SEQ ID NO: 50310 - protein, 25 aa, synthetic construct
  source 1..25: note = Seed: QTVHSIPLTINKEEALQRPVASDFE
QTVHSIPFTIVKYEACQRPVASDFE

SEQ ID NO: 50311 - protein, 25 aa, synthetic construct
  source 1..25: note = Seed: QTVHSIPLTINKEEALQRPVASDFE
QTVHSIPFTIVKYEADQRPVASDFE

SEQ ID NO: 50312 - protein, 25 aa, synthetic construct
  source 1..25: note = Seed: QTVHSIPLTINKEEALQRPVASDFE
QTVHSIPFTIVKYEAEQRPVASDFE

SEQ ID NO: 50313 - protein, 25 aa, synthetic construct
  source 1..25: note = Seed: QTVHSIPLTINKEEALQRPVASDFE
QTVHSIPFTIVKYEAFQRPVASDFE

SEQ ID NO: 50314 - protein, 25 aa, synthetic construct
  source 1..25: note = Seed: QTVHSIPLTINKEEALQRPVASDFE
QTVHSIPFTIVKYEAHQRPVASDFE

SEQ ID NO: 50315 - protein, 25 aa, synthetic construct
  source 1..25: note = Seed: QTVHSIPLTINKEEALQRPVASDFE
QTVHSIPFTIVKYEAIQRPVASDFE

SEQ ID NO: 50316 - protein, 25 aa, synthetic construct
  source 1..25: note = Seed: QTVHSIPLTINKEEALQRPVASDFE
QTVHSIPFTIVKYEALQRPVASDFE

SEQ ID NO: 50317 - protein, 25 aa, synthetic construct
  source 1..25: note = Seed: QTVHSIPLTINKEEALQRPVASDFE
QTVHSIPFTIVKYEAMQRPVASDFE

SEQ ID NO: 50318 - protein, 25 aa, synthetic construct
  source 1..25: note = Seed: QTVHSIPLTINKEEALQRPVASDFE
QTVHSIPFTIVKYEANQRPVASDFE

SEQ ID NO: 50319 - protein, 25 aa, synthetic construct
  source 1..25: note = Seed: QTVHSIPLTINKEEALQRPVASDFE
QTVHSIPFTIVKYEAPQRPVASDFE

SEQ ID NO: 50320 - protein, 25 aa, synthetic construct
  source 1..25: note = Seed: QTVHSIPLTINKEEALQRPVASDFE
QTVHSIPFTIVKYEAQQRPVASDFE

SEQ ID NO: 50321 - protein, 25 aa, synthetic construct
  source 1..25: note = Seed: QTVHSIPLTINKEEALQRPVASDFE
QTVHSIPFTIVKYEARQRPVASDFE

SEQ ID NO: 50322 - protein, 25 aa, synthetic construct
  source 1..25: note = Seed: QTVHSIPLTINKEEALQRPVASDFE
QTVHSIPFTIVKYEASQRPVASDFE

SEQ ID NO: 50323 - protein, 25 aa, synthetic construct
  source 1..25: note = Seed: QTVHSIPLTINKEEALQRPVASDFE
QTVHSIPFTIVKYEATQRPVASDFE

SEQ ID NO: 50324 - protein, 25 aa, synthetic construct
  source 1..25: note = Seed: QTVHSIPLTINKEEALQRPVASDFE
QTVHSIPFTIVKYEAVQRPVASDFE

SEQ ID NO: 50325 - protein, 25 aa, synthetic construct
  source 1..25: note = Seed: QTVHSIPLTINKEEALQRPVASDFE
QTVHSIPFTIVKYEAWQRPVASDFE

SEQ ID NO: 50326 - protein, 25 aa, synthetic construct
  source 1..25: note = Seed: QTVHSIPLTINKEEALQRPVASDFE
QTVHSIPFTIVKYEAYQRPVASDFE

SEQ ID NO: 50327 - protein, 25 aa, synthetic construct
  source 1..25: note = Seed: QTVHSIPLTINKEEALQRPVASDFE
QTVHSIPFTIWKAEAFQRPVASDFE

SEQ ID NO: 50328 - protein, 25 aa, synthetic construct
  source 1..25: note = Seed: QTVHSIPLTINKEEALQRPVASDFE
QTVHSIPFTIWKAEAIQRPVASDFE

SEQ ID NO: 50329 - protein, 25 aa, synthetic construct
  source 1..25: note = Seed: QTVHSIPLTINKEEALQRPVASDFE
QTVHSIPFTIWKDEALQRPVASDFE

SEQ ID NO: 50330 - protein, 25 aa, synthetic construct
  source 1..25: note = Seed: QTVHSIPLTINKEEALQRPVASDFE
QTVHSIPFTIWKFEAAQRPVASDFE

SEQ ID NO: 50331 - protein, 25 aa, synthetic construct
  source 1..25: note = Seed: QTVHSIPLTINKEEALQRPVASDFE
QTVHSIPFTIWKFEAEQRPVASDFE

SEQ ID NO: 50332 - protein, 25 aa, synthetic construct
  source 1..25: note = Seed: QTVHSIPLTINKEEALQRPVASDFE
QTVHSIPFTIWKFEAFQRPVASDFE

SEQ ID NO: 50333 - protein, 25 aa, synthetic construct
  source 1..25: note = Seed: QTVHSIPLTINKEEALQRPVASDFE
QTVHSIPFTIWKFEAIQRPVASDFE

SEQ ID NO: 50334 - protein, 25 aa, synthetic construct
  source 1..25: note = Seed: QTVHSIPLTINKEEALQRPVASDFE
QTVHSIPFTIWKFEALQRPVASDFE

SEQ ID NO: 50335 - protein, 25 aa, synthetic construct
  source 1..25: note = Seed: QTVHSIPLTINKEEALQRPVASDFE
QTVHSIPFTIWKFEAMQRPVASDFE

SEQ ID NO: 50336 - protein, 25 aa, synthetic construct
  source 1..25: note = Seed: QTVHSIPLTINKEEALQRPVASDFE
QTVHSIPFTIWKFEASQRPVASDFE

SEQ ID NO: 50337 - protein, 25 aa, synthetic construct
  source 1..25: note = Seed: QTVHSIPLTINKEEALQRPVASDFE
QTVHSIPFTIWKFEATQRPVASDFE

SEQ ID NO: 50338 - protein, 25 aa, synthetic construct
  source 1..25: note = Seed: QTVHSIPLTINKEEALQRPVASDFE
QTVHSIPFTIWKFEAVQRPVASDFE

SEQ ID NO: 50339 - protein, 25 aa, synthetic construct
  source 1..25: note = Seed: QTVHSIPLTINKEEALQRPVASDFE
QTVHSIPFTIWKFEAWQRPVASDFE

SEQ ID NO: 50340 - protein, 25 aa, synthetic construct
  source 1..25: note = Seed: QTVHSIPLTINKEEALQRPVASDFE
QTVHSIPFTIWKFEAYQRPVASDFE

SEQ ID NO: 50341 - protein, 25 aa, synthetic construct
  source 1..25: note = Seed: QTVHSIPLTINKEEALQRPVASDFE
QTVHSIPFTIWKIEAFQRPVASDFE

SEQ ID NO: 50342 - protein, 25 aa, synthetic construct
  source 1..25: note = Seed: QTVHSIPLTINKEEALQRPVASDFE
QTVHSIPFTIWKIEAIQRPVASDFE

SEQ ID NO: 50343 - protein, 25 aa, synthetic construct
  source 1..25: note = Seed: QTVHSIPLTINKEEALQRPVASDFE
QTVHSIPFTIWKIEALQRPVASDFE

SEQ ID NO: 50344 - protein, 25 aa, synthetic construct
  source 1..25: note = Seed: QTVHSIPLTINKEEALQRPVASDFE
QTVHSIPFTIWKIEAMQRPVASDFE

SEQ ID NO: 50345 - protein, 25 aa, synthetic construct
  source 1..25: note = Seed: QTVHSIPLTINKEEALQRPVASDFE
QTVHSIPFTIWKIEAVQRPVASDFE

SEQ ID NO: 50346 - protein, 25 aa, synthetic construct
  source 1..25: note = Seed: QTVHSIPLTINKEEALQRPVASDFE
QTVHSIPFTIWKIEAYQRPVASDFE

SEQ ID NO: 50347 - protein, 25 aa, synthetic construct
  source 1..25: note = Seed: QTVHSIPLTINKEEALQRPVASDFE
QTVHSIPFTIWKLEAFQRPVASDFE

SEQ ID NO: 50348 - protein, 25 aa, synthetic construct
  source 1..25: note = Seed: QTVHSIPLTINKEEALQRPVASDFE
QTVHSIPFTIWKLEAIQRPVASDFE

SEQ ID NO: 50349 - protein, 25 aa, synthetic construct
  source 1..25: note = Seed: QTVHSIPLTINKEEALQRPVASDFE
QTVHSIPFTIWKLEALQRPVASDFE

SEQ ID NO: 50350 - protein, 25 aa, synthetic construct
  source 1..25: note = Seed: QTVHSIPLTINKEEALQRPVASDFE
QTVHSIPFTIWKLEAMQRPVASDFE

SEQ ID NO: 50351 - protein, 25 aa, synthetic construct
  source 1..25: note = Seed: QTVHSIPLTINKEEALQRPVASDFE
QTVHSIPFTIWKLEAVQRPVASDFE

SEQ ID NO: 50352 - protein, 25 aa, synthetic construct
  source 1..25: note = Seed: QTVHSIPLTINKEEALQRPVASDFE
QTVHSIPFTIWKLEAYQRPVASDFE

SEQ ID NO: 50353 - protein, 25 aa, synthetic construct
  source 1..25: note = Seed: QTVHSIPLTINKEEALQRPVASDFE
QTVHSIPFTIWKMEAFQRPVASDFE

SEQ ID NO: 50354 - protein, 25 aa, synthetic construct
  source 1..25: note = Seed: QTVHSIPLTINKEEALQRPVASDFE
QTVHSIPFTIWKMEAIQRPVASDFE

SEQ ID NO: 50355 - protein, 25 aa, synthetic construct
  source 1..25: note = Seed: QTVHSIPLTINKEEALQRPVASDFE
QTVHSIPFTIWKMEALQRPVASDFE

SEQ ID NO: 50356 - protein, 25 aa, synthetic construct
  source 1..25: note = Seed: QTVHSIPLTINKEEALQRPVASDFE
QTVHSIPFTIWKVEAFQRPVASDFE

SEQ ID NO: 50357 - protein, 25 aa, synthetic construct
  source 1..25: note = Seed: QTVHSIPLTINKEEALQRPVASDFE
QTVHSIPFTIWKVEALQRPVASDFE

SEQ ID NO: 50358 - protein, 25 aa, synthetic construct
  source 1..25: note = Seed: QTVHSIPLTINKEEALQRPVASDFE
QTVHSIPFTIWKWEAFQRPVASDFE

SEQ ID NO: 50359 - protein, 25 aa, synthetic construct
  source 1..25: note = Seed: QTVHSIPLTINKEEALQRPVASDFE
QTVHSIPFTIWKWEAIQRPVASDFE

SEQ ID NO: 50360 - protein, 25 aa, synthetic construct
  source 1..25: note = Seed: QTVHSIPLTINKEEALQRPVASDFE
QTVHSIPFTIWKWEALQRPVASDFE

SEQ ID NO: 50361 - protein, 25 aa, synthetic construct
  source 1..25: note = Seed: QTVHSIPLTINKEEALQRPVASDFE
QTVHSIPFTIWKWEAVQRPVASDFE

SEQ ID NO: 50362 - protein, 25 aa, synthetic construct
  source 1..25: note = Seed: QTVHSIPLTINKEEALQRPVASDFE
QTVHSIPFTIWKYEAFQRPVASDFE

SEQ ID NO: 50363 - protein, 25 aa, synthetic construct
  source 1..25: note = Seed: QTVHSIPLTINKEEALQRPVASDFE
QTVHSIPFTIWKYEAIQRPVASDFE

SEQ ID NO: 50364 - protein, 25 aa, synthetic construct
  source 1..25: note = Seed: QTVHSIPLTINKEEALQRPVASDFE
QTVHSIPFTIWKYEALQRPVASDFE

SEQ ID NO: 50365 - protein, 25 aa, synthetic construct
  source 1..25: note = Seed: QTVHSIPLTINKEEALQRPVASDFE
QTVHSIPFTIWKYEAMQRPVASDFE

SEQ ID NO: 50366 - protein, 25 aa, synthetic construct
  source 1..25: note = Seed: QTVHSIPLTINKEEALQRPVASDFE
QTVHSIPFTIWKYEAVQRPVASDFE

SEQ ID NO: 50367 - protein, 25 aa, synthetic construct
  source 1..25: note = Seed: QTVHSIPLTINKEEALQRPVASDFE
QTVHSIPFTIWKYEAYQRPVASDFE

SEQ ID NO: 50368 - protein, 25 aa, synthetic construct
  source 1..25: note = Seed: QTVHSIPLTINKEEALQRPVASDFE
QTVHSIPFTIYKAEAFQRPVASDFE

SEQ ID NO: 50369 - protein, 25 aa, synthetic construct
  source 1..25: note = Seed: QTVHSIPLTINKEEALQRPVASDFE
QTVHSIPFTIYKAEAIQRPVASDFE

SEQ ID NO: 50370 - protein, 25 aa, synthetic construct
  source 1..25: note = Seed: QTVHSIPLTINKEEALQRPVASDFE
QTVHSIPFTIYKAEALQRPVASDFE

SEQ ID NO: 50371 - protein, 25 aa, synthetic construct
  source 1..25: note = Seed: QTVHSIPLTINKEEALQRPVASDFE
QTVHSIPFTIYKDEAIQRPVASDFE

SEQ ID NO: 50372 - protein, 25 aa, synthetic construct
  source 1..25: note = Seed: QTVHSIPLTINKEEALQRPVASDFE
QTVHSIPFTIYKDEALQRPVASDFE

SEQ ID NO: 50373 - protein, 25 aa, synthetic construct
  source 1..25: note = Seed: QTVHSIPLTINKEEALQRPVASDFE
QTVHSIPFTIYKDEAVQRPVASDFE

SEQ ID NO: 50374 - protein, 25 aa, synthetic construct
  source 1..25: note = Seed: QTVHSIPLTINKEEALQRPVASDFE
QTVHSIPFTIYKFEAAQRPVASDFE

SEQ ID NO: 50375 - protein, 25 aa, synthetic construct
  source 1..25: note = Seed: QTVHSIPLTINKEEALQRPVASDFE
QTVHSIPFTIYKFEADQRPVASDFE

SEQ ID NO: 50376 - protein, 25 aa, synthetic construct
  source 1..25: note = Seed: QTVHSIPLTINKEEALQRPVASDFE
QTVHSIPFTIYKFEAEQRPVASDFE

SEQ ID NO: 50377 - protein, 25 aa, synthetic construct
  source 1..25: note = Seed: QTVHSIPLTINKEEALQRPVASDFE
QTVHSIPFTIYKFEAFQRPVASDFE

SEQ ID NO: 50378 - protein, 25 aa, synthetic construct
  source 1..25: note = Seed: QTVHSIPLTINKEEALQRPVASDFE
QTVHSIPFTIYKFEAHQRPVASDFE

SEQ ID NO: 50379 - protein, 25 aa, synthetic construct
  source 1..25: note = Seed: QTVHSIPLTINKEEALQRPVASDFE
QTVHSIPFTIYKFEAIQRPVASDFE

SEQ ID NO: 50380 - protein, 25 aa, synthetic construct
  source 1..25: note = Seed: QTVHSIPLTINKEEALQRPVASDFE
QTVHSIPFTIYKFEALQRPVASDFE

SEQ ID NO: 50381 - protein, 25 aa, synthetic construct
  source 1..25: note = Seed: QTVHSIPLTINKEEALQRPVASDFE
QTVHSIPFTIYKFEAMQRPVASDFE

SEQ ID NO: 50382 - protein, 25 aa, synthetic construct
  source 1..25: note = Seed: QTVHSIPLTINKEEALQRPVASDFE
QTVHSIPFTIYKFEANQRPVASDFE

SEQ ID NO: 50383 - protein, 25 aa, synthetic construct
  source 1..25: note = Seed: QTVHSIPLTINKEEALQRPVASDFE
QTVHSIPFTIYKFEAPQRPVASDFE

SEQ ID NO: 50384 - protein, 25 aa, synthetic construct
  source 1..25: note = Seed: QTVHSIPLTINKEEALQRPVASDFE
QTVHSIPFTIYKFEAQQRPVASDFE

SEQ ID NO: 50385 - protein, 25 aa, synthetic construct
  source 1..25: note = Seed: QTVHSIPLTINKEEALQRPVASDFE
QTVHSIPFTIYKFEARQRPVASDFE

SEQ ID NO: 50386 - protein, 25 aa, synthetic construct
  source 1..25: note = Seed: QTVHSIPLTINKEEALQRPVASDFE
QTVHSIPFTIYKFEASQRPVASDFE

SEQ ID NO: 50387 - protein, 25 aa, synthetic construct
  source 1..25: note = Seed: QTVHSIPLTINKEEALQRPVASDFE
QTVHSIPFTIYKFEATQRPVASDFE

SEQ ID NO: 50388 - protein, 25 aa, synthetic construct
  source 1..25: note = Seed: QTVHSIPLTINKEEALQRPVASDFE
QTVHSIPFTIYKFEAVQRPVASDFE

SEQ ID NO: 50389 - protein, 25 aa, synthetic construct
  source 1..25: note = Seed: QTVHSIPLTINKEEALQRPVASDFE
QTVHSIPFTIYKFEAWQRPVASDFE

SEQ ID NO: 50390 - protein, 25 aa, synthetic construct
  source 1..25: note = Seed: QTVHSIPLTINKEEALQRPVASDFE
QTVHSIPFTIYKFEAYQRPVASDFE

SEQ ID NO: 50391 - protein, 25 aa, synthetic construct
  source 1..25: note = Seed: QTVHSIPLTINKEEALQRPVASDFE
QTVHSIPFTIYKIEAAQRPVASDFE

SEQ ID NO: 50392 - protein, 25 aa, synthetic construct
  source 1..25: note = Seed: QTVHSIPLTINKEEALQRPVASDFE
QTVHSIPFTIYKIEAFQRPVASDFE

SEQ ID NO: 50393 - protein, 25 aa, synthetic construct
  source 1..25: note = Seed: QTVHSIPLTINKEEALQRPVASDFE
QTVHSIPFTIYKIEAIQRPVASDFE

SEQ ID NO: 50394 - protein, 25 aa, synthetic construct
  source 1..25: note = Seed: QTVHSIPLTINKEEALQRPVASDFE
QTVHSIPFTIYKIEALQRPVASDFE

SEQ ID NO: 50395 - protein, 25 aa, synthetic construct
  source 1..25: note = Seed: QTVHSIPLTINKEEALQRPVASDFE
QTVHSIPFTIYKIEAMQRPVASDFE

SEQ ID NO: 50396 - protein, 25 aa, synthetic construct
  source 1..25: note = Seed: QTVHSIPLTINKEEALQRPVASDFE
QTVHSIPFTIYKIEAVQRPVASDFE

SEQ ID NO: 50397 - protein, 25 aa, synthetic construct
  source 1..25: note = Seed: QTVHSIPLTINKEEALQRPVASDFE
QTVHSIPFTIYKIEAYQRPVASDFE

SEQ ID NO: 50398 - protein, 25 aa, synthetic construct
  source 1..25: note = Seed: QTVHSIPLTINKEEALQRPVASDFE
QTVHSIPFTIYKLEAAQRPVASDFE

SEQ ID NO: 50399 - protein, 25 aa, synthetic construct
  source 1..25: note = Seed: QTVHSIPLTINKEEALQRPVASDFE
QTVHSIPFTIYKLEAEQRPVASDFE

SEQ ID NO: 50400 - protein, 25 aa, synthetic construct
  source 1..25: note = Seed: QTVHSIPLTINKEEALQRPVASDFE
QTVHSIPFTIYKLEAFQRPVASDFE

SEQ ID NO: 50401 - protein, 25 aa, synthetic construct
  source 1..25: note = Seed: QTVHSIPLTINKEEALQRPVASDFE
QTVHSIPFTIYKLEAIQRPVASDFE

SEQ ID NO: 50402 - protein, 25 aa, synthetic construct
  source 1..25: note = Seed: QTVHSIPLTINKEEALQRPVASDFE
QTVHSIPFTIYKLEALQRPVASDFE

SEQ ID NO: 50403 - protein, 25 aa, synthetic construct
  source 1..25: note = Seed: QTVHSIPLTINKEEALQRPVASDFE
QTVHSIPFTIYKLEAMQRPVASDFE

SEQ ID NO: 50404 - protein, 25 aa, synthetic construct
  source 1..25: note = Seed: QTVHSIPLTINKEEALQRPVASDFE
QTVHSIPFTIYKLEARQRPVASDFE

SEQ ID NO: 50405 - protein, 25 aa, synthetic construct
  source 1..25: note = Seed: QTVHSIPLTINKEEALQRPVASDFE
QTVHSIPFTIYKLEATQRPVASDFE

SEQ ID NO: 50406 - protein, 25 aa, synthetic construct
  source 1..25: note = Seed: QTVHSIPLTINKEEALQRPVASDFE
QTVHSIPFTIYKLEAVQRPVASDFE

SEQ ID NO: 50407 - protein, 25 aa, synthetic construct
  source 1..25: note = Seed: QTVHSIPLTINKEEALQRPVASDFE
QTVHSIPFTIYKLEAWQRPVASDFE

SEQ ID NO: 50408 - protein, 25 aa, synthetic construct
  source 1..25: note = Seed: QTVHSIPLTINKEEALQRPVASDFE
QTVHSIPFTIYKLEAYQRPVASDFE

SEQ ID NO: 50409 - protein, 25 aa, synthetic construct
  source 1..25: note = Seed: QTVHSIPLTINKEEALQRPVASDFE
QTVHSIPFTIYKMEAFQRPVASDFE

SEQ ID NO: 50410 - protein, 25 aa, synthetic construct
  source 1..25: note = Seed: QTVHSIPLTINKEEALQRPVASDFE
QTVHSIPFTIYKMEAIQRPVASDFE

SEQ ID NO: 50411 - protein, 25 aa, synthetic construct
  source 1..25: note = Seed: QTVHSIPLTINKEEALQRPVASDFE
QTVHSIPFTIYKMEALQRPVASDFE

SEQ ID NO: 50412 - protein, 25 aa, synthetic construct
  source 1..25: note = Seed: QTVHSIPLTINKEEALQRPVASDFE
QTVHSIPFTIYKMEAMQRPVASDFE

SEQ ID NO: 50413 - protein, 25 aa, synthetic construct
  source 1..25: note = Seed: QTVHSIPLTINKEEALQRPVASDFE
QTVHSIPFTIYKMEAVQRPVASDFE

SEQ ID NO: 50414 - protein, 25 aa, synthetic construct
  source 1..25: note = Seed: QTVHSIPLTINKEEALQRPVASDFE
QTVHSIPFTIYKMEAYQRPVASDFE

SEQ ID NO: 50415 - protein, 25 aa, synthetic construct
  source 1..25: note = Seed: QTVHSIPLTINKEEALQRPVASDFE
QTVHSIPFTIYKSEAFQRPVASDFE

SEQ ID NO: 50416 - protein, 25 aa, synthetic construct
  source 1..25: note = Seed: QTVHSIPLTINKEEALQRPVASDFE
QTVHSIPFTIYKTEAFQRPVASDFE

SEQ ID NO: 50417 - protein, 25 aa, synthetic construct
  source 1..25: note = Seed: QTVHSIPLTINKEEALQRPVASDFE
QTVHSIPFTIYKVEAFQRPVASDFE

SEQ ID NO: 50418 - protein, 25 aa, synthetic construct
  source 1..25: note = Seed: QTVHSIPLTINKEEALQRPVASDFE
QTVHSIPFTIYKVEAIQRPVASDFE

SEQ ID NO: 50419 - protein, 25 aa, synthetic construct
  source 1..25: note = Seed: QTVHSIPLTINKEEALQRPVASDFE
QTVHSIPFTIYKVEALQRPVASDFE

SEQ ID NO: 50420 - protein, 25 aa, synthetic construct
  source 1..25: note = Seed: QTVHSIPLTINKEEALQRPVASDFE
QTVHSIPFTIYKVEAMQRPVASDFE

SEQ ID NO: 50421 - protein, 25 aa, synthetic construct
  source 1..25: note = Seed: QTVHSIPLTINKEEALQRPVASDFE
QTVHSIPFTIYKVEAVQRPVASDFE

SEQ ID NO: 50422 - protein, 25 aa, synthetic construct
  source 1..25: note = Seed: QTVHSIPLTINKEEALQRPVASDFE
QTVHSIPFTIYKVEAYQRPVASDFE

SEQ ID NO: 50423 - protein, 25 aa, synthetic construct
  source 1..25: note = Seed: QTVHSIPLTINKEEALQRPVASDFE
QTVHSIPFTIYKWEAFQRPVASDFE

SEQ ID NO: 50424 - protein, 25 aa, synthetic construct
  source 1..25: note = Seed: QTVHSIPLTINKEEALQRPVASDFE
QTVHSIPFTIYKWEAIQRPVASDFE

SEQ ID NO: 50425 - protein, 25 aa, synthetic construct
  source 1..25: note = Seed: QTVHSIPLTINKEEALQRPVASDFE
QTVHSIPFTIYKWEALQRPVASDFE

SEQ ID NO: 50426 - protein, 25 aa, synthetic construct
  source 1..25: note = Seed: QTVHSIPLTINKEEALQRPVASDFE
QTVHSIPFTIYKWEAMQRPVASDFE

SEQ ID NO: 50427 - protein, 25 aa, synthetic construct
  source 1..25: note = Seed: QTVHSIPLTINKEEALQRPVASDFE
QTVHSIPFTIYKWEAVQRPVASDFE

SEQ ID NO: 50428 - protein, 25 aa, synthetic construct
  source 1..25: note = Seed: QTVHSIPLTINKEEALQRPVASDFE
QTVHSIPFTIYKWEAYQRPVASDFE

SEQ ID NO: 50429 - protein, 25 aa, synthetic construct
  source 1..25: note = Seed: QTVHSIPLTINKEEALQRPVASDFE
QTVHSIPFTIYKYEAFQRPVASDFE

SEQ ID NO: 50430 - protein, 25 aa, synthetic construct
  source 1..25: note = Seed: QTVHSIPLTINKEEALQRPVASDFE
QTVHSIPFTIYKYEAIQRPVASDFE

SEQ ID NO: 50431 - protein, 25 aa, synthetic construct
  source 1..25: note = Seed: QTVHSIPLTINKEEALQRPVASDFE
QTVHSIPFTIYKYEALQRPVASDFE

SEQ ID NO: 50432 - protein, 25 aa, synthetic construct
  source 1..25: note = Seed: QTVHSIPLTINKEEALQRPVASDFE
QTVHSIPFTIYKYEAMQRPVASDFE

SEQ ID NO: 50433 - protein, 25 aa, synthetic construct
  source 1..25: note = Seed: QTVHSIPLTINKEEALQRPVASDFE
QTVHSIPFTIYKYEAVQRPVASDFE

SEQ ID NO: 50434 - protein, 25 aa, synthetic construct
  source 1..25: note = Seed: QTVHSIPLTINKEEALQRPVASDFE
QTVHSIPFTIYKYEAWQRPVASDFE

SEQ ID NO: 50435 - protein, 25 aa, synthetic construct
  source 1..25: note = Seed: QTVHSIPLTINKEEALQRPVASDFE
QTVHSIPFTIYKYEAYQRPVASDFE

SEQ ID NO: 50436 - protein, 25 aa, synthetic construct
  source 1..25: note = Seed: QTVHSIPLTINKEEALQRPVASDFE
QTVHSIPHTIFKFEAIQRPVASDFE

SEQ ID NO: 50437 - protein, 25 aa, synthetic construct
  source 1..25: note = Seed: QTVHSIPLTINKEEALQRPVASDFE
QTVHSIPHTIFKFEALQRPVASDFE

SEQ ID NO: 50438 - protein, 25 aa, synthetic construct
  source 1..25: note = Seed: QTVHSIPLTINKEEALQRPVASDFE
QTVHSIPHTILKFEALQRPVASDFE

SEQ ID NO: 50439 - protein, 25 aa, synthetic construct
  source 1..25: note = Seed: QTVHSIPLTINKEEALQRPVASDFE
QTVHSIPITIAKAEAIQRPVASDFE

SEQ ID NO: 50440 - protein, 25 aa, synthetic construct
  source 1..25: note = Seed: QTVHSIPLTINKEEALQRPVASDFE
QTVHSIPITIAKFEAFQRPVASDFE

SEQ ID NO: 50441 - protein, 25 aa, synthetic construct
  source 1..25: note = Seed: QTVHSIPLTINKEEALQRPVASDFE
QTVHSIPITIAKFEAIQRPVASDFE

SEQ ID NO: 50442 - protein, 25 aa, synthetic construct
  source 1..25: note = Seed: QTVHSIPLTINKEEALQRPVASDFE
QTVHSIPITIAKFEALQRPVASDFE

SEQ ID NO: 50443 - protein, 25 aa, synthetic construct
  source 1..25: note = Seed: QTVHSIPLTINKEEALQRPVASDFE
QTVHSIPITIAKFEAMQRPVASDFE

SEQ ID NO: 50444 - protein, 25 aa, synthetic construct
  source 1..25: note = Seed: QTVHSIPLTINKEEALQRPVASDFE
QTVHSIPITIAKFEAVQRPVASDFE

SEQ ID NO: 50445 - protein, 25 aa, synthetic construct
  source 1..25: note = Seed: QTVHSIPLTINKEEALQRPVASDFE
QTVHSIPITIAKFEAYQRPVASDFE

SEQ ID NO: 50446 - protein, 25 aa, synthetic construct
  source 1..25: note = Seed: QTVHSIPLTINKEEALQRPVASDFE
QTVHSIPITIAKIEAIQRPVASDFE

SEQ ID NO: 50447 - protein, 25 aa, synthetic construct
  source 1..25: note = Seed: QTVHSIPLTINKEEALQRPVASDFE
QTVHSIPITIAKIEAVQRPVASDFE

SEQ ID NO: 50448 - protein, 25 aa, synthetic construct
  source 1..25: note = Seed: QTVHSIPLTINKEEALQRPVASDFE
QTVHSIPITIAKNEAIQRPVASDFE

SEQ ID NO: 50449 - protein, 25 aa, synthetic construct
  source 1..25: note = Seed: QTVHSIPLTINKEEALQRPVASDFE
QTVHSIPITIAKNEAVQRPVASDFE

SEQ ID NO: 50450 - protein, 25 aa, synthetic construct
  source 1..25: note = Seed: QTVHSIPLTINKEEALQRPVASDFE
QTVHSIPITICKFEAFQRPVASDFE

SEQ ID NO: 50451 - protein, 25 aa, synthetic construct
  source 1..25: note = Seed: QTVHSIPLTINKEEALQRPVASDFE
QTVHSIPITICKFEALQRPVASDFE

SEQ ID NO: 50452 - protein, 25 aa, synthetic construct
  source 1..25: note = Seed: QTVHSIPLTINKEEALQRPVASDFE
QTVHSIPITIEKFEAAQRPVASDFE

SEQ ID NO: 50453 - protein, 25 aa, synthetic construct
  source 1..25: note = Seed: QTVHSIPLTINKEEALQRPVASDFE
QTVHSIPITIEKFEAFQRPVASDFE

SEQ ID NO: 50454 - protein, 25 aa, synthetic construct
  source 1..25: note = Seed: QTVHSIPLTINKEEALQRPVASDFE
QTVHSIPITIEKFEAIQRPVASDFE

SEQ ID NO: 50455 - protein, 25 aa, synthetic construct
  source 1..25: note = Seed: QTVHSIPLTINKEEALQRPVASDFE
QTVHSIPITIEKFEALQRPVASDFE

SEQ ID NO: 50456 - protein, 25 aa, synthetic construct
  source 1..25: note = Seed: QTVHSIPLTINKEEALQRPVASDFE
QTVHSIPITIEKFEAMQRPVASDFE

SEQ ID NO: 50457 - protein, 25 aa, synthetic construct
  source 1..25: note = Seed: QTVHSIPLTINKEEALQRPVASDFE
QTVHSIPITIEKFEAVQRPVASDFE

SEQ ID NO: 50458 - protein, 25 aa, synthetic construct
  source 1..25: note = Seed: QTVHSIPLTINKEEALQRPVASDFE
QTVHSIPITIEKFEAYQRPVASDFE

SEQ ID NO: 50459 - protein, 25 aa, synthetic construct
  source 1..25: note = Seed: QTVHSIPLTINKEEALQRPVASDFE
QTVHSIPITIFKAEAAQRPVASDFE

SEQ ID NO: 50460 - protein, 25 aa, synthetic construct
  source 1..25: note = Seed: QTVHSIPLTINKEEALQRPVASDFE
QTVHSIPITIFKAEAFQRPVASDFE

SEQ ID NO: 50461 - protein, 25 aa, synthetic construct
  source 1..25: note = Seed: QTVHSIPLTINKEEALQRPVASDFE
QTVHSIPITIFKAEAIQRPVASDFE

SEQ ID NO: 50462 - protein, 25 aa, synthetic construct
  source 1..25: note = Seed: QTVHSIPLTINKEEALQRPVASDFE
QTVHSIPITIFKAEALQRPVASDFE

SEQ ID NO: 50463 - protein, 25 aa, synthetic construct
  source 1..25: note = Seed: QTVHSIPLTINKEEALQRPVASDFE
QTVHSIPITIFKAEAMQRPVASDFE

SEQ ID NO: 50464 - protein, 25 aa, synthetic construct
  source 1..25: note = Seed: QTVHSIPLTINKEEALQRPVASDFE
QTVHSIPITIFKAEASQRPVASDFE

SEQ ID NO: 50465 - protein, 25 aa, synthetic construct
  source 1..25: note = Seed: QTVHSIPLTINKEEALQRPVASDFE
QTVHSIPITIFKAEAVQRPVASDFE

SEQ ID NO: 50466 - protein, 25 aa, synthetic construct
  source 1..25: note = Seed: QTVHSIPLTINKEEALQRPVASDFE
QTVHSIPITIFKDEAAQRPVASDFE

SEQ ID NO: 50467 - protein, 25 aa, synthetic construct
  source 1..25: note = Seed: QTVHSIPLTINKEEALQRPVASDFE
QTVHSIPITIFKDEAFQRPVASDFE

SEQ ID NO: 50468 - protein, 25 aa, synthetic construct
  source 1..25: note = Seed: QTVHSIPLTINKEEALQRPVASDFE
QTVHSIPITIFKDEAIQRPVASDFE

SEQ ID NO: 50469 - protein, 25 aa, synthetic construct
  source 1..25: note = Seed: QTVHSIPLTINKEEALQRPVASDFE
QTVHSIPITIFKDEALQRPVASDFE

SEQ ID NO: 50470 - protein, 25 aa, synthetic construct
  source 1..25: note = Seed: QTVHSIPLTINKEEALQRPVASDFE
QTVHSIPITIFKDEAMQRPVASDFE

SEQ ID NO: 50471 - protein, 25 aa, synthetic construct
  source 1..25: note = Seed: QTVHSIPLTINKEEALQRPVASDFE
QTVHSIPITIFKDEASQRPVASDFE

SEQ ID NO: 50472 - protein, 25 aa, synthetic construct
  source 1..25: note = Seed: QTVHSIPLTINKEEALQRPVASDFE
QTVHSIPITIFKDEAVQRPVASDFE

SEQ ID NO: 50473 - protein, 25 aa, synthetic construct
  source 1..25: note = Seed: QTVHSIPLTINKEEALQRPVASDFE
QTVHSIPITIFKFEAAQRPVASDFE

SEQ ID NO: 50474 - protein, 25 aa, synthetic construct
  source 1..25: note = Seed: QTVHSIPLTINKEEALQRPVASDFE
QTVHSIPITIFKFEADQRPVASDFE

SEQ ID NO: 50475 - protein, 25 aa, synthetic construct
  source 1..25: note = Seed: QTVHSIPLTINKEEALQRPVASDFE
QTVHSIPITIFKFEAEQRPVASDFE

SEQ ID NO: 50476 - protein, 25 aa, synthetic construct
  source 1..25: note = Seed: QTVHSIPLTINKEEALQRPVASDFE
QTVHSIPITIFKFEAFQRPVASDFE

SEQ ID NO: 50477 - protein, 25 aa, synthetic construct
  source 1..25: note = Seed: QTVHSIPLTINKEEALQRPVASDFE
QTVHSIPITIFKFEAHQRPVASDFE

SEQ ID NO: 50478 - protein, 25 aa, synthetic construct
  source 1..25: note = Seed: QTVHSIPLTINKEEALQRPVASDFE
QTVHSIPITIFKFEAIQRPVASDFE

SEQ ID NO: 50479 - protein, 25 aa, synthetic construct
  source 1..25: note = Seed: QTVHSIPLTINKEEALQRPVASDFE
QTVHSIPITIFKFEALQRPVASDFE

SEQ ID NO: 50480 - protein, 25 aa, synthetic construct
  source 1..25: note = Seed: QTVHSIPLTINKEEALQRPVASDFE
QTVHSIPITIFKFEAMQRPVASDFE

SEQ ID NO: 50481 - protein, 25 aa, synthetic construct
  source 1..25: note = Seed: QTVHSIPLTINKEEALQRPVASDFE
QTVHSIPITIFKFEANQRPVASDFE

SEQ ID NO: 50482 - protein, 25 aa, synthetic construct
  source 1..25: note = Seed: QTVHSIPLTINKEEALQRPVASDFE
QTVHSIPITIFKFEASQRPVASDFE

SEQ ID NO: 50483 - protein, 25 aa, synthetic construct
  source 1..25: note = Seed: QTVHSIPLTINKEEALQRPVASDFE
QTVHSIPITIFKFEATQRPVASDFE

SEQ ID NO: 50484 - protein, 25 aa, synthetic construct
  source 1..25: note = Seed: QTVHSIPLTINKEEALQRPVASDFE
QTVHSIPITIFKFEAVQRPVASDFE

SEQ ID NO: 50485 - protein, 25 aa, synthetic construct
  source 1..25: note = Seed: QTVHSIPLTINKEEALQRPVASDFE
QTVHSIPITIFKFEAWQRPVASDFE

SEQ ID NO: 50486 - protein, 25 aa, synthetic construct
  source 1..25: note = Seed: QTVHSIPLTINKEEALQRPVASDFE
QTVHSIPITIFKFEAYQRPVASDFE

SEQ ID NO: 50487 - protein, 25 aa, synthetic construct
  source 1..25: note = Seed: QTVHSIPLTINKEEALQRPVASDFE
QTVHSIPITIFKHEAFQRPVASDFE

SEQ ID NO: 50488 - protein, 25 aa, synthetic construct
  source 1..25: note = Seed: QTVHSIPLTINKEEALQRPVASDFE
QTVHSIPITIFKHEAIQRPVASDFE

SEQ ID NO: 50489 - protein, 25 aa, synthetic construct
  source 1..25: note = Seed: QTVHSIPLTINKEEALQRPVASDFE
QTVHSIPITIFKHEALQRPVASDFE

SEQ ID NO: 50490 - protein, 25 aa, synthetic construct
  source 1..25: note = Seed: QTVHSIPLTINKEEALQRPVASDFE
QTVHSIPITIFKHEAYQRPVASDFE

SEQ ID NO: 50491 - protein, 25 aa, synthetic construct
  source 1..25: note = Seed: QTVHSIPLTINKEEALQRPVASDFE
QTVHSIPITIFKIEAAQRPVASDFE

SEQ ID NO: 50492 - protein, 25 aa, synthetic construct
  source 1..25: note = Seed: QTVHSIPLTINKEEALQRPVASDFE
QTVHSIPITIFKIEAFQRPVASDFE

SEQ ID NO: 50493 - protein, 25 aa, synthetic construct
  source 1..25: note = Seed: QTVHSIPLTINKEEALQRPVASDFE
QTVHSIPITIFKIEAIQRPVASDFE

SEQ ID NO: 50494 - protein, 25 aa, synthetic construct
  source 1..25: note = Seed: QTVHSIPLTINKEEALQRPVASDFE
QTVHSIPITIFKIEALQRPVASDFE

SEQ ID NO: 50495 - protein, 25 aa, synthetic construct
  source 1..25: note = Seed: QTVHSIPLTINKEEALQRPVASDFE
QTVHSIPITIFKIEAMQRPVASDFE

SEQ ID NO: 50496 - protein, 25 aa, synthetic construct
  source 1..25: note = Seed: QTVHSIPLTINKEEALQRPVASDFE
QTVHSIPITIFKIEARQRPVASDFE

SEQ ID NO: 50497 - protein, 25 aa, synthetic construct
  source 1..25: note = Seed: QTVHSIPLTINKEEALQRPVASDFE
QTVHSIPITIFKIEASQRPVASDFE

SEQ ID NO: 50498 - protein, 25 aa, synthetic construct
  source 1..25: note = Seed: QTVHSIPLTINKEEALQRPVASDFE
QTVHSIPITIFKIEATQRPVASDFE

SEQ ID NO: 50499 - protein, 25 aa, synthetic construct
  source 1..25: note = Seed: QTVHSIPLTINKEEALQRPVASDFE
QTVHSIPITIFKIEAVQRPVASDFE

SEQ ID NO: 50500 - protein, 25 aa, synthetic construct
  source 1..25: note = Seed: QTVHSIPLTINKEEALQRPVASDFE
QTVHSIPITIFKIEAYQRPVASDFE

SEQ ID NO: 50501 - protein, 25 aa, synthetic construct
  source 1..25: note = Seed: QTVHSIPLTINKEEALQRPVASDFE
QTVHSIPITIFKKEAFQRPVASDFE

SEQ ID NO: 50502 - protein, 25 aa, synthetic construct
  source 1..25: note = Seed: QTVHSIPLTINKEEALQRPVASDFE
QTVHSIPITIFKKEAIQRPVASDFE

SEQ ID NO: 50503 - protein, 25 aa, synthetic construct
  source 1..25: note = Seed: QTVHSIPLTINKEEALQRPVASDFE
QTVHSIPITIFKKEALQRPVASDFE

SEQ ID NO: 50504 - protein, 25 aa, synthetic construct
  source 1..25: note = Seed: QTVHSIPLTINKEEALQRPVASDFE
QTVHSIPITIFKKEAMQRPVASDFE

SEQ ID NO: 50505 - protein, 25 aa, synthetic construct
  source 1..25: note = Seed: QTVHSIPLTINKEEALQRPVASDFE
QTVHSIPITIFKKEAVQRPVASDFE

SEQ ID NO: 50506 - protein, 25 aa, synthetic construct
  source 1..25: note = Seed: QTVHSIPLTINKEEALQRPVASDFE
QTVHSIPITIFKLEAAQRPVASDFE

SEQ ID NO: 50507 - protein, 25 aa, synthetic construct
  source 1..25: note = Seed: QTVHSIPLTINKEEALQRPVASDFE
QTVHSIPITIFKLEAFQRPVASDFE

SEQ ID NO: 50508 - protein, 25 aa, synthetic construct
  source 1..25: note = Seed: QTVHSIPLTINKEEALQRPVASDFE
QTVHSIPITIFKLEAIQRPVASDFE

SEQ ID NO: 50509 - protein, 25 aa, synthetic construct
  source 1..25: note = Seed: QTVHSIPLTINKEEALQRPVASDFE
QTVHSIPITIFKLEALQRPVASDFE

SEQ ID NO: 50510 - protein, 25 aa, synthetic construct
  source 1..25: note = Seed: QTVHSIPLTINKEEALQRPVASDFE
QTVHSIPITIFKLEAMQRPVASDFE

SEQ ID NO: 50511 - protein, 25 aa, synthetic construct
  source 1..25: note = Seed: QTVHSIPLTINKEEALQRPVASDFE
QTVHSIPITIFKLEAVQRPVASDFE

SEQ ID NO: 50512 - protein, 25 aa, synthetic construct
  source 1..25: note = Seed: QTVHSIPLTINKEEALQRPVASDFE
QTVHSIPITIFKLEAWQRPVASDFE

SEQ ID NO: 50513 - protein, 25 aa, synthetic construct
  source 1..25: note = Seed: QTVHSIPLTINKEEALQRPVASDFE
QTVHSIPITIFKLEAYQRPVASDFE

SEQ ID NO: 50514 - protein, 25 aa, synthetic construct
  source 1..25: note = Seed: QTVHSIPLTINKEEALQRPVASDFE
QTVHSIPITIFKMEAAQRPVASDFE

SEQ ID NO: 50515 - protein, 25 aa, synthetic construct
  source 1..25: note = Seed: QTVHSIPLTINKEEALQRPVASDFE
QTVHSIPITIFKMEAFQRPVASDFE

SEQ ID NO: 50516 - protein, 25 aa, synthetic construct
  source 1..25: note = Seed: QTVHSIPLTINKEEALQRPVASDFE
QTVHSIPITIFKMEAIQRPVASDFE

SEQ ID NO: 50517 - protein, 25 aa, synthetic construct
  source 1..25: note = Seed: QTVHSIPLTINKEEALQRPVASDFE
QTVHSIPITIFKMEALQRPVASDFE

SEQ ID NO: 50518 - protein, 25 aa, synthetic construct
  source 1..25: note = Seed: QTVHSIPLTINKEEALQRPVASDFE
QTVHSIPITIFKMEAMQRPVASDFE

SEQ ID NO: 50519 - protein, 25 aa, synthetic construct
  source 1..25: note = Seed: QTVHSIPLTINKEEALQRPVASDFE
QTVHSIPITIFKMEAVQRPVASDFE

SEQ ID NO: 50520 - protein, 25 aa, synthetic construct
  source 1..25: note = Seed: QTVHSIPLTINKEEALQRPVASDFE
QTVHSIPITIFKMEAYQRPVASDFE

SEQ ID NO: 50521 - protein, 25 aa, synthetic construct
  source 1..25: note = Seed: QTVHSIPLTINKEEALQRPVASDFE
QTVHSIPITIFKNEAAQRPVASDFE

SEQ ID NO: 50522 - protein, 25 aa, synthetic construct
  source 1..25: note = Seed: QTVHSIPLTINKEEALQRPVASDFE
QTVHSIPITIFKNEAIQRPVASDFE

SEQ ID NO: 50523 - protein, 25 aa, synthetic construct
  source 1..25: note = Seed: QTVHSIPLTINKEEALQRPVASDFE
QTVHSIPITIFKNEALQRPVASDFE

SEQ ID NO: 50524 - protein, 25 aa, synthetic construct
  source 1..25: note = Seed: QTVHSIPLTINKEEALQRPVASDFE
QTVHSIPITIFKNEAVQRPVASDFE

SEQ ID NO: 50525 - protein, 25 aa, synthetic construct
  source 1..25: note = Seed: QTVHSIPLTINKEEALQRPVASDFE
QTVHSIPITIFKREAFQRPVASDFE

SEQ ID NO: 50526 - protein, 25 aa, synthetic construct
  source 1..25: note = Seed: QTVHSIPLTINKEEALQRPVASDFE
QTVHSIPITIFKREAHQRPVASDFE

SEQ ID NO: 50527 - protein, 25 aa, synthetic construct
  source 1..25: note = Seed: QTVHSIPLTINKEEALQRPVASDFE
QTVHSIPITIFKREAIQRPVASDFE

SEQ ID NO: 50528 - protein, 25 aa, synthetic construct
  source 1..25: note = Seed: QTVHSIPLTINKEEALQRPVASDFE
QTVHSIPITIFKREALQRPVASDFE

SEQ ID NO: 50529 - protein, 25 aa, synthetic construct
  source 1..25: note = Seed: QTVHSIPLTINKEEALQRPVASDFE
QTVHSIPITIFKREAMQRPVASDFE

SEQ ID NO: 50530 - protein, 25 aa, synthetic construct
  source 1..25: note = Seed: QTVHSIPLTINKEEALQRPVASDFE
QTVHSIPITIFKREARQRPVASDFE

SEQ ID NO: 50531 - protein, 25 aa, synthetic construct
  source 1..25: note = Seed: QTVHSIPLTINKEEALQRPVASDFE
QTVHSIPITIFKREAVQRPVASDFE

SEQ ID NO: 50532 - protein, 25 aa, synthetic construct
  source 1..25: note = Seed: QTVHSIPLTINKEEALQRPVASDFE
QTVHSIPITIFKREAYQRPVASDFE

SEQ ID NO: 50533 - protein, 25 aa, synthetic construct
  source 1..25: note = Seed: QTVHSIPLTINKEEALQRPVASDFE
QTVHSIPITIFKSEAAQRPVASDFE

SEQ ID NO: 50534 - protein, 25 aa, synthetic construct
  source 1..25: note = Seed: QTVHSIPLTINKEEALQRPVASDFE
QTVHSIPITIFKSEAFQRPVASDFE

SEQ ID NO: 50535 - protein, 25 aa, synthetic construct
  source 1..25: note = Seed: QTVHSIPLTINKEEALQRPVASDFE
QTVHSIPITIFKSEAIQRPVASDFE

SEQ ID NO: 50536 - protein, 25 aa, synthetic construct
  source 1..25: note = Seed: QTVHSIPLTINKEEALQRPVASDFE
QTVHSIPITIFKSEALQRPVASDFE

SEQ ID NO: 50537 - protein, 25 aa, synthetic construct
  source 1..25: note = Seed: QTVHSIPLTINKEEALQRPVASDFE
QTVHSIPITIFKSEAVQRPVASDFE

SEQ ID NO: 50538 - protein, 25 aa, synthetic construct
  source 1..25: note = Seed: QTVHSIPLTINKEEALQRPVASDFE
QTVHSIPITIFKTEAAQRPVASDFE

SEQ ID NO: 50539 - protein, 25 aa, synthetic construct
  source 1..25: note = Seed: QTVHSIPLTINKEEALQRPVASDFE
QTVHSIPITIFKTEAFQRPVASDFE

SEQ ID NO: 50540 - protein, 25 aa, synthetic construct
  source 1..25: note = Seed: QTVHSIPLTINKEEALQRPVASDFE
QTVHSIPITIFKTEAIQRPVASDFE

SEQ ID NO: 50541 - protein, 25 aa, synthetic construct
  source 1..25: note = Seed: QTVHSIPLTINKEEALQRPVASDFE
QTVHSIPITIFKTEAVQRPVASDFE

SEQ ID NO: 50542 - protein, 25 aa, synthetic construct
  source 1..25: note = Seed: QTVHSIPLTINKEEALQRPVASDFE
QTVHSIPITIFKVEAAQRPVASDFE

SEQ ID NO: 50543 - protein, 25 aa, synthetic construct
  source 1..25: note = Seed: QTVHSIPLTINKEEALQRPVASDFE
QTVHSIPITIFKVEAFQRPVASDFE

SEQ ID NO: 50544 - protein, 25 aa, synthetic construct
  source 1..25: note = Seed: QTVHSIPLTINKEEALQRPVASDFE
QTVHSIPITIFKVEAIQRPVASDFE

SEQ ID NO: 50545 - protein, 25 aa, synthetic construct
  source 1..25: note = Seed: QTVHSIPLTINKEEALQRPVASDFE
QTVHSIPITIFKVEALQRPVASDFE

SEQ ID NO: 50546 - protein, 25 aa, synthetic construct
  source 1..25: note = Seed: QTVHSIPLTINKEEALQRPVASDFE
QTVHSIPITIFKVEAMQRPVASDFE

SEQ ID NO: 50547 - protein, 25 aa, synthetic construct
  source 1..25: note = Seed: QTVHSIPLTINKEEALQRPVASDFE
QTVHSIPITIFKVEASQRPVASDFE

SEQ ID NO: 50548 - protein, 25 aa, synthetic construct
  source 1..25: note = Seed: QTVHSIPLTINKEEALQRPVASDFE
QTVHSIPITIFKVEAVQRPVASDFE

SEQ ID NO: 50549 - protein, 25 aa, synthetic construct
  source 1..25: note = Seed: QTVHSIPLTINKEEALQRPVASDFE
QTVHSIPITIFKVEAYQRPVASDFE

SEQ ID NO: 50550 - protein, 25 aa, synthetic construct
  source 1..25: note = Seed: QTVHSIPLTINKEEALQRPVASDFE
QTVHSIPITIFKWEAFQRPVASDFE

SEQ ID NO: 50551 - protein, 25 aa, synthetic construct
  source 1..25: note = Seed: QTVHSIPLTINKEEALQRPVASDFE
QTVHSIPITIFKWEAIQRPVASDFE

SEQ ID NO: 50552 - protein, 25 aa, synthetic construct
  source 1..25: note = Seed: QTVHSIPLTINKEEALQRPVASDFE
QTVHSIPITIFKWEALQRPVASDFE

SEQ ID NO: 50553 - protein, 25 aa, synthetic construct
  source 1..25: note = Seed: QTVHSIPLTINKEEALQRPVASDFE
QTVHSIPITIFKWEAMQRPVASDFE

SEQ ID NO: 50554 - protein, 25 aa, synthetic construct
  source 1..25: note = Seed: QTVHSIPLTINKEEALQRPVASDFE
QTVHSIPITIFKWEAVQRPVASDFE

SEQ ID NO: 50555 - protein, 25 aa, synthetic construct
  source 1..25: note = Seed: QTVHSIPLTINKEEALQRPVASDFE
QTVHSIPITIFKWEAYQRPVASDFE

SEQ ID NO: 50556 - protein, 25 aa, synthetic construct
  source 1..25: note = Seed: QTVHSIPLTINKEEALQRPVASDFE
QTVHSIPITIFKYEAFQRPVASDFE

SEQ ID NO: 50557 - protein, 25 aa, synthetic construct
  source 1..25: note = Seed: QTVHSIPLTINKEEALQRPVASDFE
QTVHSIPITIFKYEAIQRPVASDFE

SEQ ID NO: 50558 - protein, 25 aa, synthetic construct
  source 1..25: note = Seed: QTVHSIPLTINKEEALQRPVASDFE
QTVHSIPITIFKYEALQRPVASDFE

SEQ ID NO: 50559 - protein, 25 aa, synthetic construct
  source 1..25: note = Seed: QTVHSIPLTINKEEALQRPVASDFE
QTVHSIPITIFKYEAMQRPVASDFE

SEQ ID NO: 50560 - protein, 25 aa, synthetic construct
  source 1..25: note = Seed: QTVHSIPLTINKEEALQRPVASDFE
QTVHSIPITIFKYEAVQRPVASDFE

SEQ ID NO: 50561 - protein, 25 aa, synthetic construct
  source 1..25: note = Seed: QTVHSIPLTINKEEALQRPVASDFE
QTVHSIPITIFKYEAWQRPVASDFE

SEQ ID NO: 50562 - protein, 25 aa, synthetic construct
  source 1..25: note = Seed: QTVHSIPLTINKEEALQRPVASDFE
QTVHSIPITIFKYEAYQRPVASDFE

SEQ ID NO: 50563 - protein, 25 aa, synthetic construct
  source 1..25: note = Seed: QTVHSIPLTINKEEALQRPVASDFE
QTVHSIPITIHKFEAFQRPVASDFE

SEQ ID NO: 50564 - protein, 25 aa, synthetic construct
  source 1..25: note = Seed: QTVHSIPLTINKEEALQRPVASDFE
QTVHSIPITIHKFEAIQRPVASDFE

SEQ ID NO: 50565 - protein, 25 aa, synthetic construct
  source 1..25: note = Seed: QTVHSIPLTINKEEALQRPVASDFE
QTVHSIPITIHKFEALQRPVASDFE

SEQ ID NO: 50566 - protein, 25 aa, synthetic construct
  source 1..25: note = Seed: QTVHSIPLTINKEEALQRPVASDFE
QTVHSIPITIHKFEAMQRPVASDFE

SEQ ID NO: 50567 - protein, 25 aa, synthetic construct
  source 1..25: note = Seed: QTVHSIPLTINKEEALQRPVASDFE
QTVHSIPITIHKFEAVQRPVASDFE

SEQ ID NO: 50568 - protein, 25 aa, synthetic construct
  source 1..25: note = Seed: QTVHSIPLTINKEEALQRPVASDFE
QTVHSIPITIHKNEAIQRPVASDFE

SEQ ID NO: 50569 - protein, 25 aa, synthetic construct
  source 1..25: note = Seed: QTVHSIPLTINKEEALQRPVASDFE
QTVHSIPITIHKNEAVQRPVASDFE

SEQ ID NO: 50570 - protein, 25 aa, synthetic construct
  source 1..25: note = Seed: QTVHSIPLTINKEEALQRPVASDFE
QTVHSIPITIHKREAFQRPVASDFE

SEQ ID NO: 50571 - protein, 25 aa, synthetic construct
  source 1..25: note = Seed: QTVHSIPLTINKEEALQRPVASDFE
QTVHSIPITIHKREALQRPVASDFE

SEQ ID NO: 50572 - protein, 25 aa, synthetic construct
  source 1..25: note = Seed: QTVHSIPLTINKEEALQRPVASDFE
QTVHSIPITIIKAEAAQRPVASDFE

SEQ ID NO: 50573 - protein, 25 aa, synthetic construct
  source 1..25: note = Seed: QTVHSIPLTINKEEALQRPVASDFE
QTVHSIPITIIKAEAIQRPVASDFE

SEQ ID NO: 50574 - protein, 25 aa, synthetic construct
  source 1..25: note = Seed: QTVHSIPLTINKEEALQRPVASDFE
QTVHSIPITIIKAEALQRPVASDFE

SEQ ID NO: 50575 - protein, 25 aa, synthetic construct
  source 1..25: note = Seed: QTVHSIPLTINKEEALQRPVASDFE
QTVHSIPITIIKAEAVQRPVASDFE

SEQ ID NO: 50576 - protein, 25 aa, synthetic construct
  source 1..25: note = Seed: QTVHSIPLTINKEEALQRPVASDFE
QTVHSIPITIIKDEAAQRPVASDFE

SEQ ID NO: 50577 - protein, 25 aa, synthetic construct
  source 1..25: note = Seed: QTVHSIPLTINKEEALQRPVASDFE
QTVHSIPITIIKDEAIQRPVASDFE

SEQ ID NO: 50578 - protein, 25 aa, synthetic construct
  source 1..25: note = Seed: QTVHSIPLTINKEEALQRPVASDFE
QTVHSIPITIIKDEALQRPVASDFE

SEQ ID NO: 50579 - protein, 25 aa, synthetic construct
  source 1..25: note = Seed: QTVHSIPLTINKEEALQRPVASDFE
QTVHSIPITIIKDEAVQRPVASDFE

SEQ ID NO: 50580 - protein, 25 aa, synthetic construct
  source 1..25: note = Seed: QTVHSIPLTINKEEALQRPVASDFE
QTVHSIPITIIKFEAAQRPVASDFE

SEQ ID NO: 50581 - protein, 25 aa, synthetic construct
  source 1..25: note = Seed: QTVHSIPLTINKEEALQRPVASDFE
QTVHSIPITIIKFEADQRPVASDFE

SEQ ID NO: 50582 - protein, 25 aa, synthetic construct
  source 1..25: note = Seed: QTVHSIPLTINKEEALQRPVASDFE
QTVHSIPITIIKFEAEQRPVASDFE

SEQ ID NO: 50583 - protein, 25 aa, synthetic construct
  source 1..25: note = Seed: QTVHSIPLTINKEEALQRPVASDFE
QTVHSIPITIIKFEAFQRPVASDFE

SEQ ID NO: 50584 - protein, 25 aa, synthetic construct
  source 1..25: note = Seed: QTVHSIPLTINKEEALQRPVASDFE
QTVHSIPITIIKFEAIQRPVASDFE

SEQ ID NO: 50585 - protein, 25 aa, synthetic construct
  source 1..25: note = Seed: QTVHSIPLTINKEEALQRPVASDFE
QTVHSIPITIIKFEALQRPVASDFE

SEQ ID NO: 50586 - protein, 25 aa, synthetic construct
  source 1..25: note = Seed: QTVHSIPLTINKEEALQRPVASDFE
QTVHSIPITIIKFEAMQRPVASDFE

SEQ ID NO: 50587 - protein, 25 aa, synthetic construct
  source 1..25: note = Seed: QTVHSIPLTINKEEALQRPVASDFE
QTVHSIPITIIKFEANQRPVASDFE

SEQ ID NO: 50588 - protein, 25 aa, synthetic construct
  source 1..25: note = Seed: QTVHSIPLTINKEEALQRPVASDFE
QTVHSIPITIIKFEASQRPVASDFE

SEQ ID NO: 50589 - protein, 25 aa, synthetic construct
  source 1..25: note = Seed: QTVHSIPLTINKEEALQRPVASDFE
QTVHSIPITIIKFEATQRPVASDFE

SEQ ID NO: 50590 - protein, 25 aa, synthetic construct
  source 1..25: note = Seed: QTVHSIPLTINKEEALQRPVASDFE
QTVHSIPITIIKFEAVQRPVASDFE

SEQ ID NO: 50591 - protein, 25 aa, synthetic construct
  source 1..25: note = Seed: QTVHSIPLTINKEEALQRPVASDFE
QTVHSIPITIIKFEAWQRPVASDFE

SEQ ID NO: 50592 - protein, 25 aa, synthetic construct
  source 1..25: note = Seed: QTVHSIPLTINKEEALQRPVASDFE
QTVHSIPITIIKFEAYQRPVASDFE

SEQ ID NO: 50593 - protein, 25 aa, synthetic construct
  source 1..25: note = Seed: QTVHSIPLTINKEEALQRPVASDFE
QTVHSIPITIIKHEAFQRPVASDFE

SEQ ID NO: 50594 - protein, 25 aa, synthetic construct
  source 1..25: note = Seed: QTVHSIPLTINKEEALQRPVASDFE
QTVHSIPITIIKHEAIQRPVASDFE

SEQ ID NO: 50595 - protein, 25 aa, synthetic construct
  source 1..25: note = Seed: QTVHSIPLTINKEEALQRPVASDFE
QTVHSIPITIIKHEALQRPVASDFE

SEQ ID NO: 50596 - protein, 25 aa, synthetic construct
  source 1..25: note = Seed: QTVHSIPLTINKEEALQRPVASDFE
QTVHSIPITIIKHEAMQRPVASDFE

SEQ ID NO: 50597 - protein, 25 aa, synthetic construct
  source 1..25: note = Seed: QTVHSIPLTINKEEALQRPVASDFE
QTVHSIPITIIKHEARQRPVASDFE

SEQ ID NO: 50598 - protein, 25 aa, synthetic construct
  source 1..25: note = Seed: QTVHSIPLTINKEEALQRPVASDFE
QTVHSIPITIIKHEAYQRPVASDFE

SEQ ID NO: 50599 - protein, 25 aa, synthetic construct
  source 1..25: note = Seed: QTVHSIPLTINKEEALQRPVASDFE
QTVHSIPITIIKIEAAQRPVASDFE

SEQ ID NO: 50600 - protein, 25 aa, synthetic construct
  source 1..25: note = Seed: QTVHSIPLTINKEEALQRPVASDFE
QTVHSIPITIIKIEAFQRPVASDFE

SEQ ID NO: 50601 - protein, 25 aa, synthetic construct
  source 1..25: note = Seed: QTVHSIPLTINKEEALQRPVASDFE
QTVHSIPITIIKIEAIQRPVASDFE

SEQ ID NO: 50602 - protein, 25 aa, synthetic construct
  source 1..25: note = Seed: QTVHSIPLTINKEEALQRPVASDFE
QTVHSIPITIIKIEALQRPVASDFE

SEQ ID NO: 50603 - protein, 25 aa, synthetic construct
  source 1..25: note = Seed: QTVHSIPLTINKEEALQRPVASDFE
QTVHSIPITIIKIEAMQRPVASDFE

SEQ ID NO: 50604 - protein, 25 aa, synthetic construct
  source 1..25: note = Seed: QTVHSIPLTINKEEALQRPVASDFE
QTVHSIPITIIKIEAVQRPVASDFE

SEQ ID NO: 50605 - protein, 25 aa, synthetic construct
  source 1..25: note = Seed: QTVHSIPLTINKEEALQRPVASDFE
QTVHSIPITIIKKEAFQRPVASDFE

SEQ ID NO: 50606 - protein, 25 aa, synthetic construct
  source 1..25: note = Seed: QTVHSIPLTINKEEALQRPVASDFE
QTVHSIPITIIKKEAIQRPVASDFE

SEQ ID NO: 50607 - protein, 25 aa, synthetic construct
  source 1..25: note = Seed: QTVHSIPLTINKEEALQRPVASDFE
QTVHSIPITIIKKEALQRPVASDFE

SEQ ID NO: 50608 - protein, 25 aa, synthetic construct
  source 1..25: note = Seed: QTVHSIPLTINKEEALQRPVASDFE
QTVHSIPITIIKKEAMQRPVASDFE

SEQ ID NO: 50609 - protein, 25 aa, synthetic construct
  source 1..25: note = Seed: QTVHSIPLTINKEEALQRPVASDFE
QTVHSIPITIIKKEAVQRPVASDFE

SEQ ID NO: 50610 - protein, 25 aa, synthetic construct
  source 1..25: note = Seed: QTVHSIPLTINKEEALQRPVASDFE
QTVHSIPITIIKKEAYQRPVASDFE

SEQ ID NO: 50611 - protein, 25 aa, synthetic construct
  source 1..25: note = Seed: QTVHSIPLTINKEEALQRPVASDFE
QTVHSIPITIIKLEAFQRPVASDFE

SEQ ID NO: 50612 - protein, 25 aa, synthetic construct
  source 1..25: note = Seed: QTVHSIPLTINKEEALQRPVASDFE
QTVHSIPITIIKLEAIQRPVASDFE

SEQ ID NO: 50613 - protein, 25 aa, synthetic construct
  source 1..25: note = Seed: QTVHSIPLTINKEEALQRPVASDFE
QTVHSIPITIIKLEALQRPVASDFE

SEQ ID NO: 50614 - protein, 25 aa, synthetic construct
  source 1..25: note = Seed: QTVHSIPLTINKEEALQRPVASDFE
QTVHSIPITIIKLEARQRPVASDFE

SEQ ID NO: 50615 - protein, 25 aa, synthetic construct
  source 1..25: note = Seed: QTVHSIPLTINKEEALQRPVASDFE
QTVHSIPITIIKMEAFQRPVASDFE

SEQ ID NO: 50616 - protein, 25 aa, synthetic construct
  source 1..25: note = Seed: QTVHSIPLTINKEEALQRPVASDFE
QTVHSIPITIIKMEARQRPVASDFE

SEQ ID NO: 50617 - protein, 25 aa, synthetic construct
  source 1..25: note = Seed: QTVHSIPLTINKEEALQRPVASDFE
QTVHSIPITIIKNEAFQRPVASDFE

SEQ ID NO: 50618 - protein, 25 aa, synthetic construct
  source 1..25: note = Seed: QTVHSIPLTINKEEALQRPVASDFE
QTVHSIPITIIKNEAIQRPVASDFE

SEQ ID NO: 50619 - protein, 25 aa, synthetic construct
  source 1..25: note = Seed: QTVHSIPLTINKEEALQRPVASDFE
QTVHSIPITIIKNEALQRPVASDFE

SEQ ID NO: 50620 - protein, 25 aa, synthetic construct
  source 1..25: note = Seed: QTVHSIPLTINKEEALQRPVASDFE
QTVHSIPITIIKNEAMQRPVASDFE

SEQ ID NO: 50621 - protein, 25 aa, synthetic construct
  source 1..25: note = Seed: QTVHSIPLTINKEEALQRPVASDFE
QTVHSIPITIIKNEAVQRPVASDFE

SEQ ID NO: 50622 - protein, 25 aa, synthetic construct
  source 1..25: note = Seed: QTVHSIPLTINKEEALQRPVASDFE
QTVHSIPITIIKREAFQRPVASDFE

SEQ ID NO: 50623 - protein, 25 aa, synthetic construct
  source 1..25: note = Seed: QTVHSIPLTINKEEALQRPVASDFE
QTVHSIPITIIKREAIQRPVASDFE

SEQ ID NO: 50624 - protein, 25 aa, synthetic construct
  source 1..25: note = Seed: QTVHSIPLTINKEEALQRPVASDFE
QTVHSIPITIIKREALQRPVASDFE

SEQ ID NO: 50625 - protein, 25 aa, synthetic construct
  source 1..25: note = Seed: QTVHSIPLTINKEEALQRPVASDFE
QTVHSIPITIIKREAMQRPVASDFE

SEQ ID NO: 50626 - protein, 25 aa, synthetic construct
  source 1..25: note = Seed: QTVHSIPLTINKEEALQRPVASDFE
QTVHSIPITIIKREARQRPVASDFE

SEQ ID NO: 50627 - protein, 25 aa, synthetic construct
  source 1..25: note = Seed: QTVHSIPLTINKEEALQRPVASDFE
QTVHSIPITIIKREAVQRPVASDFE

SEQ ID NO: 50628 - protein, 25 aa, synthetic construct
  source 1..25: note = Seed: QTVHSIPLTINKEEALQRPVASDFE
QTVHSIPITIIKREAYQRPVASDFE

SEQ ID NO: 50629 - protein, 25 aa, synthetic construct
  source 1..25: note = Seed: QTVHSIPLTINKEEALQRPVASDFE
QTVHSIPITIIKSEAIQRPVASDFE

SEQ ID NO: 50630 - protein, 25 aa, synthetic construct
  source 1..25: note = Seed: QTVHSIPLTINKEEALQRPVASDFE
QTVHSIPITIIKVEAAQRPVASDFE

SEQ ID NO: 50631 - protein, 25 aa, synthetic construct
  source 1..25: note = Seed: QTVHSIPLTINKEEALQRPVASDFE
QTVHSIPITIIKVEAIQRPVASDFE

SEQ ID NO: 50632 - protein, 25 aa, synthetic construct
  source 1..25: note = Seed: QTVHSIPLTINKEEALQRPVASDFE
QTVHSIPITIIKVEARQRPVASDFE

SEQ ID NO: 50633 - protein, 25 aa, synthetic construct
  source 1..25: note = Seed: QTVHSIPLTINKEEALQRPVASDFE
QTVHSIPITIIKVEAVQRPVASDFE

SEQ ID NO: 50634 - protein, 25 aa, synthetic construct
  source 1..25: note = Seed: QTVHSIPLTINKEEALQRPVASDFE
QTVHSIPITIIKWEAFQRPVASDFE

SEQ ID NO: 50635 - protein, 25 aa, synthetic construct
  source 1..25: note = Seed: QTVHSIPLTINKEEALQRPVASDFE
QTVHSIPITIIKWEALQRPVASDFE

SEQ ID NO: 50636 - protein, 25 aa, synthetic construct
  source 1..25: note = Seed: QTVHSIPLTINKEEALQRPVASDFE
QTVHSIPITIIKYEAFQRPVASDFE

SEQ ID NO: 50637 - protein, 25 aa, synthetic construct
  source 1..25: note = Seed: QTVHSIPLTINKEEALQRPVASDFE
QTVHSIPITIIKYEAIQRPVASDFE

SEQ ID NO: 50638 - protein, 25 aa, synthetic construct
  source 1..25: note = Seed: QTVHSIPLTINKEEALQRPVASDFE
QTVHSIPITIIKYEALQRPVASDFE

SEQ ID NO: 50639 - protein, 25 aa, synthetic construct
  source 1..25: note = Seed: QTVHSIPLTINKEEALQRPVASDFE
QTVHSIPITIIKYEAVQRPVASDFE

SEQ ID NO: 50640 - protein, 25 aa, synthetic construct
  source 1..25: note = Seed: QTVHSIPLTINKEEALQRPVASDFE
QTVHSIPITIKKFEALQRPVASDFE

SEQ ID NO: 50641 - protein, 25 aa, synthetic construct
  source 1..25: note = Seed: QTVHSIPLTINKEEALQRPVASDFE
QTVHSIPITILKAEAFQRPVASDFE

SEQ ID NO: 50642 - protein, 25 aa, synthetic construct
  source 1..25: note = Seed: QTVHSIPLTINKEEALQRPVASDFE
QTVHSIPITILKAEAIQRPVASDFE

SEQ ID NO: 50643 - protein, 25 aa, synthetic construct
  source 1..25: note = Seed: QTVHSIPLTINKEEALQRPVASDFE
QTVHSIPITILKAEAVQRPVASDFE

SEQ ID NO: 50644 - protein, 25 aa, synthetic construct
  source 1..25: note = Seed: QTVHSIPLTINKEEALQRPVASDFE
QTVHSIPITILKFEAAQRPVASDFE

SEQ ID NO: 50645 - protein, 25 aa, synthetic construct
  source 1..25: note = Seed: QTVHSIPLTINKEEALQRPVASDFE
QTVHSIPITILKFEADQRPVASDFE

SEQ ID NO: 50646 - protein, 25 aa, synthetic construct
  source 1..25: note = Seed: QTVHSIPLTINKEEALQRPVASDFE
QTVHSIPITILKFEAEQRPVASDFE

SEQ ID NO: 50647 - protein, 25 aa, synthetic construct
  source 1..25: note = Seed: QTVHSIPLTINKEEALQRPVASDFE
QTVHSIPITILKFEAFQRPVASDFE

SEQ ID NO: 50648 - protein, 25 aa, synthetic construct
  source 1..25: note = Seed: QTVHSIPLTINKEEALQRPVASDFE
QTVHSIPITILKFEAIQRPVASDFE

SEQ ID NO: 50649 - protein, 25 aa, synthetic construct
  source 1..25: note = Seed: QTVHSIPLTINKEEALQRPVASDFE
QTVHSIPITILKFEALQRPVASDFE

SEQ ID NO: 50650 - protein, 25 aa, synthetic construct
  source 1..25: note = Seed: QTVHSIPLTINKEEALQRPVASDFE
QTVHSIPITILKFEAMQRPVASDFE

SEQ ID NO: 50651 - protein, 25 aa, synthetic construct
  source 1..25: note = Seed: QTVHSIPLTINKEEALQRPVASDFE
QTVHSIPITILKFEANQRPVASDFE

SEQ ID NO: 50652 - protein, 25 aa, synthetic construct
  source 1..25: note = Seed: QTVHSIPLTINKEEALQRPVASDFE
QTVHSIPITILKFEASQRPVASDFE

SEQ ID NO: 50653 - protein, 25 aa, synthetic construct
  source 1..25: note = Seed: QTVHSIPLTINKEEALQRPVASDFE
QTVHSIPITILKFEATQRPVASDFE

SEQ ID NO: 50654 - protein, 25 aa, synthetic construct
  source 1..25: note = Seed: QTVHSIPLTINKEEALQRPVASDFE
QTVHSIPITILKFEAVQRPVASDFE

SEQ ID NO: 50655 - protein, 25 aa, synthetic construct
  source 1..25: note = Seed: QTVHSIPLTINKEEALQRPVASDFE
QTVHSIPITILKFEAWQRPVASDFE

SEQ ID NO: 50656 - protein, 25 aa, synthetic construct
  source 1..25: note = Seed: QTVHSIPLTINKEEALQRPVASDFE
QTVHSIPITILKFEAYQRPVASDFE

SEQ ID NO: 50657 - protein, 25 aa, synthetic construct
  source 1..25: note = Seed: QTVHSIPLTINKEEALQRPVASDFE
QTVHSIPITILKHEALQRPVASDFE

SEQ ID NO: 50658 - protein, 25 aa, synthetic construct
  source 1..25: note = Seed: QTVHSIPLTINKEEALQRPVASDFE
QTVHSIPITILKIEAAQRPVASDFE

SEQ ID NO: 50659 - protein, 25 aa, synthetic construct
  source 1..25: note = Seed: QTVHSIPLTINKEEALQRPVASDFE
QTVHSIPITILKIEAFQRPVASDFE

SEQ ID NO: 50660 - protein, 25 aa, synthetic construct
  source 1..25: note = Seed: QTVHSIPLTINKEEALQRPVASDFE
QTVHSIPITILKIEAIQRPVASDFE

SEQ ID NO: 50661 - protein, 25 aa, synthetic construct
  source 1..25: note = Seed: QTVHSIPLTINKEEALQRPVASDFE
QTVHSIPITILKIEALQRPVASDFE

SEQ ID NO: 50662 - protein, 25 aa, synthetic construct
  source 1..25: note = Seed: QTVHSIPLTINKEEALQRPVASDFE
QTVHSIPITILKIEAMQRPVASDFE

SEQ ID NO: 50663 - protein, 25 aa, synthetic construct
  source 1..25: note = Seed: QTVHSIPLTINKEEALQRPVASDFE
QTVHSIPITILKIEAVQRPVASDFE

SEQ ID NO: 50664 - protein, 25 aa, synthetic construct
  source 1..25: note = Seed: QTVHSIPLTINKEEALQRPVASDFE
QTVHSIPITILKLEAFQRPVASDFE

SEQ ID NO: 50665 - protein, 25 aa, synthetic construct
  source 1..25: note = Seed: QTVHSIPLTINKEEALQRPVASDFE
QTVHSIPITILKLEAIQRPVASDFE

SEQ ID NO: 50666 - protein, 25 aa, synthetic construct
  source 1..25: note = Seed: QTVHSIPLTINKEEALQRPVASDFE
QTVHSIPITILKLEALQRPVASDFE

SEQ ID NO: 50667 - protein, 25 aa, synthetic construct
  source 1..25: note = Seed: QTVHSIPLTINKEEALQRPVASDFE
QTVHSIPITILKLEAMQRPVASDFE

SEQ ID NO: 50668 - protein, 25 aa, synthetic construct
  source 1..25: note = Seed: QTVHSIPLTINKEEALQRPVASDFE
QTVHSIPITILKLEAVQRPVASDFE

SEQ ID NO: 50669 - protein, 25 aa, synthetic construct
  source 1..25: note = Seed: QTVHSIPLTINKEEALQRPVASDFE
QTVHSIPITILKMEAFQRPVASDFE

SEQ ID NO: 50670 - protein, 25 aa, synthetic construct
  source 1..25: note = Seed: QTVHSIPLTINKEEALQRPVASDFE
QTVHSIPITILKMEALQRPVASDFE

SEQ ID NO: 50671 - protein, 25 aa, synthetic construct
  source 1..25: note = Seed: QTVHSIPLTINKEEALQRPVASDFE
QTVHSIPITILKREAFQRPVASDFE

SEQ ID NO: 50672 - protein, 25 aa, synthetic construct
  source 1..25: note = Seed: QTVHSIPLTINKEEALQRPVASDFE
QTVHSIPITILKREAIQRPVASDFE

SEQ ID NO: 50673 - protein, 25 aa, synthetic construct
  source 1..25: note = Seed: QTVHSIPLTINKEEALQRPVASDFE
QTVHSIPITILKREALQRPVASDFE

SEQ ID NO: 50674 - protein, 25 aa, synthetic construct
  source 1..25: note = Seed: QTVHSIPLTINKEEALQRPVASDFE
QTVHSIPITILKREAMQRPVASDFE

SEQ ID NO: 50675 - protein, 25 aa, synthetic construct
  source 1..25: note = Seed: QTVHSIPLTINKEEALQRPVASDFE
QTVHSIPITILKREAVQRPVASDFE

SEQ ID NO: 50676 - protein, 25 aa, synthetic construct
  source 1..25: note = Seed: QTVHSIPLTINKEEALQRPVASDFE
QTVHSIPITILKREAYQRPVASDFE

SEQ ID NO: 50677 - protein, 25 aa, synthetic construct
  source 1..25: note = Seed: QTVHSIPLTINKEEALQRPVASDFE
QTVHSIPITILKSEAFQRPVASDFE

SEQ ID NO: 50678 - protein, 25 aa, synthetic construct
  source 1..25: note = Seed: QTVHSIPLTINKEEALQRPVASDFE
QTVHSIPITILKVEAAQRPVASDFE

SEQ ID NO: 50679 - protein, 25 aa, synthetic construct
  source 1..25: note = Seed: QTVHSIPLTINKEEALQRPVASDFE
QTVHSIPITILKVEAFQRPVASDFE

SEQ ID NO: 50680 - protein, 25 aa, synthetic construct
  source 1..25: note = Seed: QTVHSIPLTINKEEALQRPVASDFE
QTVHSIPITILKVEAIQRPVASDFE

SEQ ID NO: 50681 - protein, 25 aa, synthetic construct
  source 1..25: note = Seed: QTVHSIPLTINKEEALQRPVASDFE
QTVHSIPITILKVEAVQRPVASDFE

SEQ ID NO: 50682 - protein, 25 aa, synthetic construct
  source 1..25: note = Seed: QTVHSIPLTINKEEALQRPVASDFE
QTVHSIPITILKWEAFQRPVASDFE

SEQ ID NO: 50683 - protein, 25 aa, synthetic construct
  source 1..25: note = Seed: QTVHSIPLTINKEEALQRPVASDFE
QTVHSIPITILKWEALQRPVASDFE

SEQ ID NO: 50684 - protein, 25 aa, synthetic construct
  source 1..25: note = Seed: QTVHSIPLTINKEEALQRPVASDFE
QTVHSIPITILKYEAFQRPVASDFE

SEQ ID NO: 50685 - protein, 25 aa, synthetic construct
  source 1..25: note = Seed: QTVHSIPLTINKEEALQRPVASDFE
QTVHSIPITILKYEAIQRPVASDFE

SEQ ID NO: 50686 - protein, 25 aa, synthetic construct
  source 1..25: note = Seed: QTVHSIPLTINKEEALQRPVASDFE
QTVHSIPITILKYEALQRPVASDFE

SEQ ID NO: 50687 - protein, 25 aa, synthetic construct
  source 1..25: note = Seed: QTVHSIPLTINKEEALQRPVASDFE
QTVHSIPITILKYEAMQRPVASDFE

SEQ ID NO: 50688 - protein, 25 aa, synthetic construct
  source 1..25: note = Seed: QTVHSIPLTINKEEALQRPVASDFE
QTVHSIPITILKYEAVQRPVASDFE

SEQ ID NO: 50689 - protein, 25 aa, synthetic construct
  source 1..25: note = Seed: QTVHSIPLTINKEEALQRPVASDFE
QTVHSIPITILKYEAYQRPVASDFE

SEQ ID NO: 50690 - protein, 25 aa, synthetic construct
  source 1..25: note = Seed: QTVHSIPLTINKEEALQRPVASDFE
QTVHSIPITIMKAEAAQRPVASDFE

SEQ ID NO: 50691 - protein, 25 aa, synthetic construct
  source 1..25: note = Seed: QTVHSIPLTINKEEALQRPVASDFE
QTVHSIPITIMKAEAIQRPVASDFE

SEQ ID NO: 50692 - protein, 25 aa, synthetic construct
  source 1..25: note = Seed: QTVHSIPLTINKEEALQRPVASDFE
QTVHSIPITIMKAEALQRPVASDFE

SEQ ID NO: 50693 - protein, 25 aa, synthetic construct
  source 1..25: note = Seed: QTVHSIPLTINKEEALQRPVASDFE
QTVHSIPITIMKAEAMQRPVASDFE

SEQ ID NO: 50694 - protein, 25 aa, synthetic construct
  source 1..25: note = Seed: QTVHSIPLTINKEEALQRPVASDFE
QTVHSIPITIMKAEAVQRPVASDFE

SEQ ID NO: 50695 - protein, 25 aa, synthetic construct
  source 1..25: note = Seed: QTVHSIPLTINKEEALQRPVASDFE
QTVHSIPITIMKDEAIQRPVASDFE

SEQ ID NO: 50696 - protein, 25 aa, synthetic construct
  source 1..25: note = Seed: QTVHSIPLTINKEEALQRPVASDFE
QTVHSIPITIMKDEALQRPVASDFE

SEQ ID NO: 50697 - protein, 25 aa, synthetic construct
  source 1..25: note = Seed: QTVHSIPLTINKEEALQRPVASDFE
QTVHSIPITIMKDEAVQRPVASDFE

SEQ ID NO: 50698 - protein, 25 aa, synthetic construct
  source 1..25: note = Seed: QTVHSIPLTINKEEALQRPVASDFE
QTVHSIPITIMKFEAAQRPVASDFE

SEQ ID NO: 50699 - protein, 25 aa, synthetic construct
  source 1..25: note = Seed: QTVHSIPLTINKEEALQRPVASDFE
QTVHSIPITIMKFEAEQRPVASDFE

SEQ ID NO: 50700 - protein, 25 aa, synthetic construct
  source 1..25: note = Seed: QTVHSIPLTINKEEALQRPVASDFE
QTVHSIPITIMKFEAFQRPVASDFE

SEQ ID NO: 50701 - protein, 25 aa, synthetic construct
  source 1..25: note = Seed: QTVHSIPLTINKEEALQRPVASDFE
QTVHSIPITIMKFEAIQRPVASDFE

SEQ ID NO: 50702 - protein, 25 aa, synthetic construct
  source 1..25: note = Seed: QTVHSIPLTINKEEALQRPVASDFE
QTVHSIPITIMKFEALQRPVASDFE

SEQ ID NO: 50703 - protein, 25 aa, synthetic construct
  source 1..25: note = Seed: QTVHSIPLTINKEEALQRPVASDFE
QTVHSIPITIMKFEAMQRPVASDFE

SEQ ID NO: 50704 - protein, 25 aa, synthetic construct
  source 1..25: note = Seed: QTVHSIPLTINKEEALQRPVASDFE
QTVHSIPITIMKFEAVQRPVASDFE

SEQ ID NO: 50705 - protein, 25 aa, synthetic construct
  source 1..25: note = Seed: QTVHSIPLTINKEEALQRPVASDFE
QTVHSIPITIMKFEAYQRPVASDFE

SEQ ID NO: 50706 - protein, 25 aa, synthetic construct
  source 1..25: note = Seed: QTVHSIPLTINKEEALQRPVASDFE
QTVHSIPITIMKHEALQRPVASDFE

SEQ ID NO: 50707 - protein, 25 aa, synthetic construct
  source 1..25: note = Seed: QTVHSIPLTINKEEALQRPVASDFE
QTVHSIPITIMKIEAAQRPVASDFE

SEQ ID NO: 50708 - protein, 25 aa, synthetic construct
  source 1..25: note = Seed: QTVHSIPLTINKEEALQRPVASDFE
QTVHSIPITIMKIEAFQRPVASDFE

SEQ ID NO: 50709 - protein, 25 aa, synthetic construct
  source 1..25: note = Seed: QTVHSIPLTINKEEALQRPVASDFE
QTVHSIPITIMKIEAIQRPVASDFE

SEQ ID NO: 50710 - protein, 25 aa, synthetic construct
  source 1..25: note = Seed: QTVHSIPLTINKEEALQRPVASDFE
QTVHSIPITIMKIEALQRPVASDFE

SEQ ID NO: 50711 - protein, 25 aa, synthetic construct
  source 1..25: note = Seed: QTVHSIPLTINKEEALQRPVASDFE
QTVHSIPITIMKIEAMQRPVASDFE

SEQ ID NO: 50712 - protein, 25 aa, synthetic construct
  source 1..25: note = Seed: QTVHSIPLTINKEEALQRPVASDFE
QTVHSIPITIMKIEASQRPVASDFE

SEQ ID NO: 50713 - protein, 25 aa, synthetic construct
  source 1..25: note = Seed: QTVHSIPLTINKEEALQRPVASDFE
QTVHSIPITIMKIEAVQRPVASDFE

SEQ ID NO: 50714 - protein, 25 aa, synthetic construct
  source 1..25: note = Seed: QTVHSIPLTINKEEALQRPVASDFE
QTVHSIPITIMKIEAYQRPVASDFE

SEQ ID NO: 50715 - protein, 25 aa, synthetic construct
  source 1..25: note = Seed: QTVHSIPLTINKEEALQRPVASDFE
QTVHSIPITIMKKEAIQRPVASDFE

SEQ ID NO: 50716 - protein, 25 aa, synthetic construct
  source 1..25: note = Seed: QTVHSIPLTINKEEALQRPVASDFE
QTVHSIPITIMKKEALQRPVASDFE

SEQ ID NO: 50717 - protein, 25 aa, synthetic construct
  source 1..25: note = Seed: QTVHSIPLTINKEEALQRPVASDFE
QTVHSIPITIMKLEAAQRPVASDFE

SEQ ID NO: 50718 - protein, 25 aa, synthetic construct
  source 1..25: note = Seed: QTVHSIPLTINKEEALQRPVASDFE
QTVHSIPITIMKLEAFQRPVASDFE

SEQ ID NO: 50719 - protein, 25 aa, synthetic construct
  source 1..25: note = Seed: QTVHSIPLTINKEEALQRPVASDFE
QTVHSIPITIMKLEAIQRPVASDFE

SEQ ID NO: 50720 - protein, 25 aa, synthetic construct
  source 1..25: note = Seed: QTVHSIPLTINKEEALQRPVASDFE
QTVHSIPITIMKLEALQRPVASDFE

SEQ ID NO: 50721 - protein, 25 aa, synthetic construct
  source 1..25: note = Seed: QTVHSIPLTINKEEALQRPVASDFE
QTVHSIPITIMKLEAVQRPVASDFE

SEQ ID NO: 50722 - protein, 25 aa, synthetic construct
  source 1..25: note = Seed: QTVHSIPLTINKEEALQRPVASDFE
QTVHSIPITIMKMEAAQRPVASDFE

SEQ ID NO: 50723 - protein, 25 aa, synthetic construct
  source 1..25: note = Seed: QTVHSIPLTINKEEALQRPVASDFE
QTVHSIPITIMKMEAIQRPVASDFE

SEQ ID NO: 50724 - protein, 25 aa, synthetic construct
  source 1..25: note = Seed: QTVHSIPLTINKEEALQRPVASDFE
QTVHSIPITIMKMEALQRPVASDFE

SEQ ID NO: 50725 - protein, 25 aa, synthetic construct
  source 1..25: note = Seed: QTVHSIPLTINKEEALQRPVASDFE
QTVHSIPITIMKMEAVQRPVASDFE

SEQ ID NO: 50726 - protein, 25 aa, synthetic construct
  source 1..25: note = Seed: QTVHSIPLTINKEEALQRPVASDFE
QTVHSIPITIMKNEAIQRPVASDFE

SEQ ID NO: 50727 - protein, 25 aa, synthetic construct
  source 1..25: note = Seed: QTVHSIPLTINKEEALQRPVASDFE
QTVHSIPITIMKNEAVQRPVASDFE

SEQ ID NO: 50728 - protein, 25 aa, synthetic construct
  source 1..25: note = Seed: QTVHSIPLTINKEEALQRPVASDFE
QTVHSIPITIMKREAFQRPVASDFE

SEQ ID NO: 50729 - protein, 25 aa, synthetic construct
  source 1..25: note = Seed: QTVHSIPLTINKEEALQRPVASDFE
QTVHSIPITIMKREAIQRPVASDFE

SEQ ID NO: 50730 - protein, 25 aa, synthetic construct
  source 1..25: note = Seed: QTVHSIPLTINKEEALQRPVASDFE
QTVHSIPITIMKREALQRPVASDFE

SEQ ID NO: 50731 - protein, 25 aa, synthetic construct
  source 1..25: note = Seed: QTVHSIPLTINKEEALQRPVASDFE
QTVHSIPITIMKREAMQRPVASDFE

SEQ ID NO: 50732 - protein, 25 aa, synthetic construct
  source 1..25: note = Seed: QTVHSIPLTINKEEALQRPVASDFE
QTVHSIPITIMKREAVQRPVASDFE

SEQ ID NO: 50733 - protein, 25 aa, synthetic construct
  source 1..25: note = Seed: QTVHSIPLTINKEEALQRPVASDFE
QTVHSIPITIMKREAYQRPVASDFE

SEQ ID NO: 50734 - protein, 25 aa, synthetic construct
  source 1..25: note = Seed: QTVHSIPLTINKEEALQRPVASDFE
QTVHSIPITIMKVEAAQRPVASDFE

SEQ ID NO: 50735 - protein, 25 aa, synthetic construct
  source 1..25: note = Seed: QTVHSIPLTINKEEALQRPVASDFE
QTVHSIPITIMKVEAFQRPVASDFE

SEQ ID NO: 50736 - protein, 25 aa, synthetic construct
  source 1..25: note = Seed: QTVHSIPLTINKEEALQRPVASDFE
QTVHSIPITIMKVEAIQRPVASDFE

SEQ ID NO: 50737 - protein, 25 aa, synthetic construct
  source 1..25: note = Seed: QTVHSIPLTINKEEALQRPVASDFE
QTVHSIPITIMKVEALQRPVASDFE

SEQ ID NO: 50738 - protein, 25 aa, synthetic construct
  source 1..25: note = Seed: QTVHSIPLTINKEEALQRPVASDFE
QTVHSIPITIMKVEAMQRPVASDFE

SEQ ID NO: 50739 - protein, 25 aa, synthetic construct
  source 1..25: note = Seed: QTVHSIPLTINKEEALQRPVASDFE
QTVHSIPITIMKVEAVQRPVASDFE

SEQ ID NO: 50740 - protein, 25 aa, synthetic construct
  source 1..25: note = Seed: QTVHSIPLTINKEEALQRPVASDFE
QTVHSIPITIMKWEAFQRPVASDFE

SEQ ID NO: 50741 - protein, 25 aa, synthetic construct
  source 1..25: note = Seed: QTVHSIPLTINKEEALQRPVASDFE
QTVHSIPITIMKWEALQRPVASDFE

SEQ ID NO: 50742 - protein, 25 aa, synthetic construct
  source 1..25: note = Seed: QTVHSIPLTINKEEALQRPVASDFE
QTVHSIPITIMKYEAFQRPVASDFE

SEQ ID NO: 50743 - protein, 25 aa, synthetic construct
  source 1..25: note = Seed: QTVHSIPLTINKEEALQRPVASDFE
QTVHSIPITIMKYEALQRPVASDFE

SEQ ID NO: 50744 - protein, 25 aa, synthetic construct
  source 1..25: note = Seed: QTVHSIPLTINKEEALQRPVASDFE
QTVHSIPITINKAEAAQRPVASDFE

SEQ ID NO: 50745 - protein, 25 aa, synthetic construct
  source 1..25: note = Seed: QTVHSIPLTINKEEALQRPVASDFE
QTVHSIPITINKAEAFQRPVASDFE

SEQ ID NO: 50746 - protein, 25 aa, synthetic construct
  source 1..25: note = Seed: QTVHSIPLTINKEEALQRPVASDFE
QTVHSIPITINKAEAIQRPVASDFE

SEQ ID NO: 50747 - protein, 25 aa, synthetic construct
  source 1..25: note = Seed: QTVHSIPLTINKEEALQRPVASDFE
QTVHSIPITINKAEALQRPVASDFE

SEQ ID NO: 50748 - protein, 25 aa, synthetic construct
  source 1..25: note = Seed: QTVHSIPLTINKEEALQRPVASDFE
QTVHSIPITINKAEAMQRPVASDFE

SEQ ID NO: 50749 - protein, 25 aa, synthetic construct
  source 1..25: note = Seed: QTVHSIPLTINKEEALQRPVASDFE
QTVHSIPITINKAEASQRPVASDFE

SEQ ID NO: 50750 - protein, 25 aa, synthetic construct
  source 1..25: note = Seed: QTVHSIPLTINKEEALQRPVASDFE
QTVHSIPITINKAEATQRPVASDFE

SEQ ID NO: 50751 - protein, 25 aa, synthetic construct
  source 1..25: note = Seed: QTVHSIPLTINKEEALQRPVASDFE
QTVHSIPITINKAEAVQRPVASDFE

SEQ ID NO: 50752 - protein, 25 aa, synthetic construct
  source 1..25: note = Seed: QTVHSIPLTINKEEALQRPVASDFE
QTVHSIPITINKAEAWQRPVASDFE

SEQ ID NO: 50753 - protein, 25 aa, synthetic construct
  source 1..25: note = Seed: QTVHSIPLTINKEEALQRPVASDFE
QTVHSIPITINKAEAYQRPVASDFE

SEQ ID NO: 50754 - protein, 25 aa, synthetic construct
  source 1..25: note = Seed: QTVHSIPLTINKEEALQRPVASDFE
QTVHSIPITINKFEAFQRPVASDFE

SEQ ID NO: 50755 - protein, 25 aa, synthetic construct
  source 1..25: note = Seed: QTVHSIPLTINKEEALQRPVASDFE
QTVHSIPITINKFEAIQRPVASDFE

SEQ ID NO: 50756 - protein, 25 aa, synthetic construct
  source 1..25: note = Seed: QTVHSIPLTINKEEALQRPVASDFE
QTVHSIPITINKFEALQRPVASDFE

SEQ ID NO: 50757 - protein, 25 aa, synthetic construct
  source 1..25: note = Seed: QTVHSIPLTINKEEALQRPVASDFE
QTVHSIPITINKFEAMQRPVASDFE

SEQ ID NO: 50758 - protein, 25 aa, synthetic construct
  source 1..25: note = Seed: QTVHSIPLTINKEEALQRPVASDFE
QTVHSIPITINKFEAVQRPVASDFE

SEQ ID NO: 50759 - protein, 25 aa, synthetic construct
  source 1..25: note = Seed: QTVHSIPLTINKEEALQRPVASDFE
QTVHSIPITINKGEAAQRPVASDFE

SEQ ID NO: 50760 - protein, 25 aa, synthetic construct
  source 1..25: note = Seed: QTVHSIPLTINKEEALQRPVASDFE
QTVHSIPITINKGEAFQRPVASDFE

SEQ ID NO: 50761 - protein, 25 aa, synthetic construct
  source 1..25: note = Seed: QTVHSIPLTINKEEALQRPVASDFE
QTVHSIPITINKGEAIQRPVASDFE

SEQ ID NO: 50762 - protein, 25 aa, synthetic construct
  source 1..25: note = Seed: QTVHSIPLTINKEEALQRPVASDFE
QTVHSIPITINKGEALQRPVASDFE

SEQ ID NO: 50763 - protein, 25 aa, synthetic construct
  source 1..25: note = Seed: QTVHSIPLTINKEEALQRPVASDFE
QTVHSIPITINKGEAMQRPVASDFE

SEQ ID NO: 50764 - protein, 25 aa, synthetic construct
  source 1..25: note = Seed: QTVHSIPLTINKEEALQRPVASDFE
QTVHSIPITINKGEAVQRPVASDFE

SEQ ID NO: 50765 - protein, 25 aa, synthetic construct
  source 1..25: note = Seed: QTVHSIPLTINKEEALQRPVASDFE
QTVHSIPITINKGEAYQRPVASDFE

SEQ ID NO: 50766 - protein, 25 aa, synthetic construct
  source 1..25: note = Seed: QTVHSIPLTINKEEALQRPVASDFE
QTVHSIPITINKHEAIQRPVASDFE

SEQ ID NO: 50767 - protein, 25 aa, synthetic construct
  source 1..25: note = Seed: QTVHSIPLTINKEEALQRPVASDFE
QTVHSIPITINKHEALQRPVASDFE

SEQ ID NO: 50768 - protein, 25 aa, synthetic construct
  source 1..25: note = Seed: QTVHSIPLTINKEEALQRPVASDFE
QTVHSIPITINKHEAVQRPVASDFE

SEQ ID NO: 50769 - protein, 25 aa, synthetic construct
  source 1..25: note = Seed: QTVHSIPLTINKEEALQRPVASDFE
QTVHSIPITINKIEAAQRPVASDFE

SEQ ID NO: 50770 - protein, 25 aa, synthetic construct
  source 1..25: note = Seed: QTVHSIPLTINKEEALQRPVASDFE
QTVHSIPITINKIEAFQRPVASDFE

SEQ ID NO: 50771 - protein, 25 aa, synthetic construct
  source 1..25: note = Seed: QTVHSIPLTINKEEALQRPVASDFE
QTVHSIPITINKIEAIQRPVASDFE

SEQ ID NO: 50772 - protein, 25 aa, synthetic construct
  source 1..25: note = Seed: QTVHSIPLTINKEEALQRPVASDFE
QTVHSIPITINKIEALQRPVASDFE

SEQ ID NO: 50773 - protein, 25 aa, synthetic construct
  source 1..25: note = Seed: QTVHSIPLTINKEEALQRPVASDFE
QTVHSIPITINKIEAMQRPVASDFE

SEQ ID NO: 50774 - protein, 25 aa, synthetic construct
  source 1..25: note = Seed: QTVHSIPLTINKEEALQRPVASDFE
QTVHSIPITINKIEATQRPVASDFE

SEQ ID NO: 50775 - protein, 25 aa, synthetic construct
  source 1..25: note = Seed: QTVHSIPLTINKEEALQRPVASDFE
QTVHSIPITINKIEAVQRPVASDFE

SEQ ID NO: 50776 - protein, 25 aa, synthetic construct
  source 1..25: note = Seed: QTVHSIPLTINKEEALQRPVASDFE
QTVHSIPITINKIEAYQRPVASDFE

SEQ ID NO: 50777 - protein, 25 aa, synthetic construct
  source 1..25: note = Seed: QTVHSIPLTINKEEALQRPVASDFE
QTVHSIPITINKLEAFQRPVASDFE

SEQ ID NO: 50778 - protein, 25 aa, synthetic construct
  source 1..25: note = Seed: QTVHSIPLTINKEEALQRPVASDFE
QTVHSIPITINKLEAIQRPVASDFE

SEQ ID NO: 50779 - protein, 25 aa, synthetic construct
  source 1..25: note = Seed: QTVHSIPLTINKEEALQRPVASDFE
QTVHSIPITINKLEALQRPVASDFE

SEQ ID NO: 50780 - protein, 25 aa, synthetic construct
  source 1..25: note = Seed: QTVHSIPLTINKEEALQRPVASDFE
QTVHSIPITINKLEAVQRPVASDFE

SEQ ID NO: 50781 - protein, 25 aa, synthetic construct
  source 1..25: note = Seed: QTVHSIPLTINKEEALQRPVASDFE
QTVHSIPITINKMEAFQRPVASDFE

SEQ ID NO: 50782 - protein, 25 aa, synthetic construct
  source 1..25: note = Seed: QTVHSIPLTINKEEALQRPVASDFE
QTVHSIPITINKMEAIQRPVASDFE

SEQ ID NO: 50783 - protein, 25 aa, synthetic construct
  source 1..25: note = Seed: QTVHSIPLTINKEEALQRPVASDFE
QTVHSIPITINKMEALQRPVASDFE

SEQ ID NO: 50784 - protein, 25 aa, synthetic construct
  source 1..25: note = Seed: QTVHSIPLTINKEEALQRPVASDFE
QTVHSIPITINKMEAVQRPVASDFE

SEQ ID NO: 50785 - protein, 25 aa, synthetic construct
  source 1..25: note = Seed: QTVHSIPLTINKEEALQRPVASDFE
QTVHSIPITINKNEAAQRPVASDFE

SEQ ID NO: 50786 - protein, 25 aa, synthetic construct
  source 1..25: note = Seed: QTVHSIPLTINKEEALQRPVASDFE
QTVHSIPITINKNEAFQRPVASDFE

SEQ ID NO: 50787 - protein, 25 aa, synthetic construct
  source 1..25: note = Seed: QTVHSIPLTINKEEALQRPVASDFE
QTVHSIPITINKNEAIQRPVASDFE

SEQ ID NO: 50788 - protein, 25 aa, synthetic construct
  source 1..25: note = Seed: QTVHSIPLTINKEEALQRPVASDFE
QTVHSIPITINKNEALQRPVASDFE

SEQ ID NO: 50789 - protein, 25 aa, synthetic construct
  source 1..25: note = Seed: QTVHSIPLTINKEEALQRPVASDFE
QTVHSIPITINKNEAMQRPVASDFE

SEQ ID NO: 50790 - protein, 25 aa, synthetic construct
  source 1..25: note = Seed: QTVHSIPLTINKEEALQRPVASDFE
QTVHSIPITINKNEASQRPVASDFE

SEQ ID NO: 50791 - protein, 25 aa, synthetic construct
  source 1..25: note = Seed: QTVHSIPLTINKEEALQRPVASDFE
QTVHSIPITINKNEATQRPVASDFE

SEQ ID NO: 50792 - protein, 25 aa, synthetic construct
  source 1..25: note = Seed: QTVHSIPLTINKEEALQRPVASDFE
QTVHSIPITINKNEAVQRPVASDFE

SEQ ID NO: 50793 - protein, 25 aa, synthetic construct
  source 1..25: note = Seed: QTVHSIPLTINKEEALQRPVASDFE
QTVHSIPITINKNEAWQRPVASDFE

SEQ ID NO: 50794 - protein, 25 aa, synthetic construct
  source 1..25: note = Seed: QTVHSIPLTINKEEALQRPVASDFE
QTVHSIPITINKNEAYQRPVASDFE

SEQ ID NO: 50795 - protein, 25 aa, synthetic construct
  source 1..25: note = Seed: QTVHSIPLTINKEEALQRPVASDFE
QTVHSIPITINKPEAFQRPVASDFE

SEQ ID NO: 50796 - protein, 25 aa, synthetic construct
  source 1..25: note = Seed: QTVHSIPLTINKEEALQRPVASDFE
QTVHSIPITINKPEAIQRPVASDFE

SEQ ID NO: 50797 - protein, 25 aa, synthetic construct
  source 1..25: note = Seed: QTVHSIPLTINKEEALQRPVASDFE
QTVHSIPITINKPEALQRPVASDFE

SEQ ID NO: 50798 - protein, 25 aa, synthetic construct
  source 1..25: note = Seed: QTVHSIPLTINKEEALQRPVASDFE
QTVHSIPITINKPEAMQRPVASDFE

SEQ ID NO: 50799 - protein, 25 aa, synthetic construct
  source 1..25: note = Seed: QTVHSIPLTINKEEALQRPVASDFE
QTVHSIPITINKPEAVQRPVASDFE

SEQ ID NO: 50800 - protein, 25 aa, synthetic construct
  source 1..25: note = Seed: QTVHSIPLTINKEEALQRPVASDFE
QTVHSIPITINKPEAYQRPVASDFE

SEQ ID NO: 50801 - protein, 25 aa, synthetic construct
  source 1..25: note = Seed: QTVHSIPLTINKEEALQRPVASDFE
QTVHSIPITINKSEAAQRPVASDFE

SEQ ID NO: 50802 - protein, 25 aa, synthetic construct
  source 1..25: note = Seed: QTVHSIPLTINKEEALQRPVASDFE
QTVHSIPITINKSEAFQRPVASDFE

SEQ ID NO: 50803 - protein, 25 aa, synthetic construct
  source 1..25: note = Seed: QTVHSIPLTINKEEALQRPVASDFE
QTVHSIPITINKSEAIQRPVASDFE

SEQ ID NO: 50804 - protein, 25 aa, synthetic construct
  source 1..25: note = Seed: QTVHSIPLTINKEEALQRPVASDFE
QTVHSIPITINKSEALQRPVASDFE

SEQ ID NO: 50805 - protein, 25 aa, synthetic construct
  source 1..25: note = Seed: QTVHSIPLTINKEEALQRPVASDFE
QTVHSIPITINKSEAMQRPVASDFE

SEQ ID NO: 50806 - protein, 25 aa, synthetic construct
  source 1..25: note = Seed: QTVHSIPLTINKEEALQRPVASDFE
QTVHSIPITINKSEASQRPVASDFE

SEQ ID NO: 50807 - protein, 25 aa, synthetic construct
  source 1..25: note = Seed: QTVHSIPLTINKEEALQRPVASDFE
QTVHSIPITINKSEATQRPVASDFE

SEQ ID NO: 50808 - protein, 25 aa, synthetic construct
  source 1..25: note = Seed: QTVHSIPLTINKEEALQRPVASDFE
QTVHSIPITINKSEAVQRPVASDFE

SEQ ID NO: 50809 - protein, 25 aa, synthetic construct
  source 1..25: note = Seed: QTVHSIPLTINKEEALQRPVASDFE
QTVHSIPITINKSEAWQRPVASDFE

SEQ ID NO: 50810 - protein, 25 aa, synthetic construct
  source 1..25: note = Seed: QTVHSIPLTINKEEALQRPVASDFE
QTVHSIPITINKSEAYQRPVASDFE

SEQ ID NO: 50811 - protein, 25 aa, synthetic construct
  source 1..25: note = Seed: QTVHSIPLTINKEEALQRPVASDFE
QTVHSIPITINKTEAFQRPVASDFE

SEQ ID NO: 50812 - protein, 25 aa, synthetic construct
  source 1..25: note = Seed: QTVHSIPLTINKEEALQRPVASDFE
QTVHSIPITINKTEAIQRPVASDFE

SEQ ID NO: 50813 - protein, 25 aa, synthetic construct
  source 1..25: note = Seed: QTVHSIPLTINKEEALQRPVASDFE
QTVHSIPITINKTEALQRPVASDFE

SEQ ID NO: 50814 - protein, 25 aa, synthetic construct
  source 1..25: note = Seed: QTVHSIPLTINKEEALQRPVASDFE
QTVHSIPITINKTEAMQRPVASDFE

SEQ ID NO: 50815 - protein, 25 aa, synthetic construct
  source 1..25: note = Seed: QTVHSIPLTINKEEALQRPVASDFE
QTVHSIPITINKTEAVQRPVASDFE

SEQ ID NO: 50816 - protein, 25 aa, synthetic construct
  source 1..25: note = Seed: QTVHSIPLTINKEEALQRPVASDFE
QTVHSIPITINKTEAYQRPVASDFE

SEQ ID NO: 50817 - protein, 25 aa, synthetic construct
  source 1..25: note = Seed: QTVHSIPLTINKEEALQRPVASDFE
QTVHSIPITINKVEAAQRPVASDFE

SEQ ID NO: 50818 - protein, 25 aa, synthetic construct
  source 1..25: note = Seed: QTVHSIPLTINKEEALQRPVASDFE
QTVHSIPITINKVEAFQRPVASDFE

SEQ ID NO: 50819 - protein, 25 aa, synthetic construct
  source 1..25: note = Seed: QTVHSIPLTINKEEALQRPVASDFE
QTVHSIPITINKVEAIQRPVASDFE

SEQ ID NO: 50820 - protein, 25 aa, synthetic construct
  source 1..25: note = Seed: QTVHSIPLTINKEEALQRPVASDFE
QTVHSIPITINKVEALQRPVASDFE

SEQ ID NO: 50821 - protein, 25 aa, synthetic construct
  source 1..25: note = Seed: QTVHSIPLTINKEEALQRPVASDFE
QTVHSIPITINKVEAMQRPVASDFE

SEQ ID NO: 50822 - protein, 25 aa, synthetic construct
  source 1..25: note = Seed: QTVHSIPLTINKEEALQRPVASDFE
QTVHSIPITINKVEAVQRPVASDFE

SEQ ID NO: 50823 - protein, 25 aa, synthetic construct
  source 1..25: note = Seed: QTVHSIPLTINKEEALQRPVASDFE
QTVHSIPITINKVEAYQRPVASDFE

SEQ ID NO: 50824 - protein, 25 aa, synthetic construct
  source 1..25: note = Seed: QTVHSIPLTINKEEALQRPVASDFE
QTVHSIPITIQKFEAFQRPVASDFE

SEQ ID NO: 50825 - protein, 25 aa, synthetic construct
  source 1..25: note = Seed: QTVHSIPLTINKEEALQRPVASDFE
QTVHSIPITIQKFEAIQRPVASDFE

SEQ ID NO: 50826 - protein, 25 aa, synthetic construct
  source 1..25: note = Seed: QTVHSIPLTINKEEALQRPVASDFE
QTVHSIPITIQKFEALQRPVASDFE

SEQ ID NO: 50827 - protein, 25 aa, synthetic construct
  source 1..25: note = Seed: QTVHSIPLTINKEEALQRPVASDFE
QTVHSIPITIQKFEAMQRPVASDFE

SEQ ID NO: 50828 - protein, 25 aa, synthetic construct
  source 1..25: note = Seed: QTVHSIPLTINKEEALQRPVASDFE
QTVHSIPITIQKFEAVQRPVASDFE

SEQ ID NO: 50829 - protein, 25 aa, synthetic construct
  source 1..25: note = Seed: QTVHSIPLTINKEEALQRPVASDFE
QTVHSIPITIQKNEAIQRPVASDFE

SEQ ID NO: 50830 - protein, 25 aa, synthetic construct
  source 1..25: note = Seed: QTVHSIPLTINKEEALQRPVASDFE
QTVHSIPITIQKNEAVQRPVASDFE

SEQ ID NO: 50831 - protein, 25 aa, synthetic construct
  source 1..25: note = Seed: QTVHSIPLTINKEEALQRPVASDFE
QTVHSIPITIRKHEAFQRPVASDFE

SEQ ID NO: 50832 - protein, 25 aa, synthetic construct
  source 1..25: note = Seed: QTVHSIPLTINKEEALQRPVASDFE
QTVHSIPITISKAEAIQRPVASDFE

SEQ ID NO: 50833 - protein, 25 aa, synthetic construct
  source 1..25: note = Seed: QTVHSIPLTINKEEALQRPVASDFE
QTVHSIPITISKAEALQRPVASDFE

SEQ ID NO: 50834 - protein, 25 aa, synthetic construct
  source 1..25: note = Seed: QTVHSIPLTINKEEALQRPVASDFE
QTVHSIPITISKAEAVQRPVASDFE

SEQ ID NO: 50835 - protein, 25 aa, synthetic construct
  source 1..25: note = Seed: QTVHSIPLTINKEEALQRPVASDFE
QTVHSIPITISKFEAAQRPVASDFE

SEQ ID NO: 50836 - protein, 25 aa, synthetic construct
  source 1..25: note = Seed: QTVHSIPLTINKEEALQRPVASDFE
QTVHSIPITISKFEAFQRPVASDFE

SEQ ID NO: 50837 - protein, 25 aa, synthetic construct
  source 1..25: note = Seed: QTVHSIPLTINKEEALQRPVASDFE
QTVHSIPITISKFEAIQRPVASDFE

SEQ ID NO: 50838 - protein, 25 aa, synthetic construct
  source 1..25: note = Seed: QTVHSIPLTINKEEALQRPVASDFE
QTVHSIPITISKFEALQRPVASDFE

SEQ ID NO: 50839 - protein, 25 aa, synthetic construct
  source 1..25: note = Seed: QTVHSIPLTINKEEALQRPVASDFE
QTVHSIPITISKFEAMQRPVASDFE

SEQ ID NO: 50840 - protein, 25 aa, synthetic construct
  source 1..25: note = Seed: QTVHSIPLTINKEEALQRPVASDFE
QTVHSIPITISKFEAVQRPVASDFE

SEQ ID NO: 50841 - protein, 25 aa, synthetic construct
  source 1..25: note = Seed: QTVHSIPLTINKEEALQRPVASDFE
QTVHSIPITISKFEAYQRPVASDFE

SEQ ID NO: 50842 - protein, 25 aa, synthetic construct
  source 1..25: note = Seed: QTVHSIPLTINKEEALQRPVASDFE
QTVHSIPITISKGEAIQRPVASDFE

SEQ ID NO: 50843 - protein, 25 aa, synthetic construct
  source 1..25: note = Seed: QTVHSIPLTINKEEALQRPVASDFE
QTVHSIPITISKNEAFQRPVASDFE

SEQ ID NO: 50844 - protein, 25 aa, synthetic construct
  source 1..25: note = Seed: QTVHSIPLTINKEEALQRPVASDFE
QTVHSIPITISKNEAIQRPVASDFE

SEQ ID NO: 50845 - protein, 25 aa, synthetic construct
  source 1..25: note = Seed: QTVHSIPLTINKEEALQRPVASDFE
QTVHSIPITISKNEALQRPVASDFE

SEQ ID NO: 50846 - protein, 25 aa, synthetic construct
  source 1..25: note = Seed: QTVHSIPLTINKEEALQRPVASDFE
QTVHSIPITISKNEAVQRPVASDFE

SEQ ID NO: 50847 - protein, 25 aa, synthetic construct
  source 1..25: note = Seed: QTVHSIPLTINKEEALQRPVASDFE
QTVHSIPITISKSEAIQRPVASDFE

SEQ ID NO: 50848 - protein, 25 aa, synthetic construct
  source 1..25: note = Seed: QTVHSIPLTINKEEALQRPVASDFE
QTVHSIPITISKSEAVQRPVASDFE

SEQ ID NO: 50849 - protein, 25 aa, synthetic construct
  source 1..25: note = Seed: QTVHSIPLTINKEEALQRPVASDFE
QTVHSIPITITKFEAAQRPVASDFE

SEQ ID NO: 50850 - protein, 25 aa, synthetic construct
  source 1..25: note = Seed: QTVHSIPLTINKEEALQRPVASDFE
QTVHSIPITITKFEAFQRPVASDFE

SEQ ID NO: 50851 - protein, 25 aa, synthetic construct
  source 1..25: note = Seed: QTVHSIPLTINKEEALQRPVASDFE
QTVHSIPITITKFEAIQRPVASDFE

SEQ ID NO: 50852 - protein, 25 aa, synthetic construct
  source 1..25: note = Seed: QTVHSIPLTINKEEALQRPVASDFE
QTVHSIPITITKFEALQRPVASDFE

SEQ ID NO: 50853 - protein, 25 aa, synthetic construct
  source 1..25: note = Seed: QTVHSIPLTINKEEALQRPVASDFE
QTVHSIPITITKFEAMQRPVASDFE

SEQ ID NO: 50854 - protein, 25 aa, synthetic construct
  source 1..25: note = Seed: QTVHSIPLTINKEEALQRPVASDFE
QTVHSIPITITKFEATQRPVASDFE

SEQ ID NO: 50855 - protein, 25 aa, synthetic construct
  source 1..25: note = Seed: QTVHSIPLTINKEEALQRPVASDFE
QTVHSIPITITKFEAVQRPVASDFE

SEQ ID NO: 50856 - protein, 25 aa, synthetic construct
  source 1..25: note = Seed: QTVHSIPLTINKEEALQRPVASDFE
QTVHSIPITITKFEAYQRPVASDFE

SEQ ID NO: 50857 - protein, 25 aa, synthetic construct
  source 1..25: note = Seed: QTVHSIPLTINKEEALQRPVASDFE
QTVHSIPITITKLEALQRPVASDFE

SEQ ID NO: 50858 - protein, 25 aa, synthetic construct
  source 1..25: note = Seed: QTVHSIPLTINKEEALQRPVASDFE
QTVHSIPITITKNEAIQRPVASDFE

SEQ ID NO: 50859 - protein, 25 aa, synthetic construct
  source 1..25: note = Seed: QTVHSIPLTINKEEALQRPVASDFE
QTVHSIPITITKNEAVQRPVASDFE

SEQ ID NO: 50860 - protein, 25 aa, synthetic construct
  source 1..25: note = Seed: QTVHSIPLTINKEEALQRPVASDFE
QTVHSIPITITKYEALQRPVASDFE

SEQ ID NO: 50861 - protein, 25 aa, synthetic construct
  source 1..25: note = Seed: QTVHSIPLTINKEEALQRPVASDFE
QTVHSIPITIVKFEAAQRPVASDFE

SEQ ID NO: 50862 - protein, 25 aa, synthetic construct
  source 1..25: note = Seed: QTVHSIPLTINKEEALQRPVASDFE
QTVHSIPITIVKFEAEQRPVASDFE

SEQ ID NO: 50863 - protein, 25 aa, synthetic construct
  source 1..25: note = Seed: QTVHSIPLTINKEEALQRPVASDFE
QTVHSIPITIVKFEAFQRPVASDFE

SEQ ID NO: 50864 - protein, 25 aa, synthetic construct
  source 1..25: note = Seed: QTVHSIPLTINKEEALQRPVASDFE
QTVHSIPITIVKFEAIQRPVASDFE

SEQ ID NO: 50865 - protein, 25 aa, synthetic construct
  source 1..25: note = Seed: QTVHSIPLTINKEEALQRPVASDFE
QTVHSIPITIVKFEALQRPVASDFE

SEQ ID NO: 50866 - protein, 25 aa, synthetic construct
  source 1..25: note = Seed: QTVHSIPLTINKEEALQRPVASDFE
QTVHSIPITIVKFEAMQRPVASDFE

SEQ ID NO: 50867 - protein, 25 aa, synthetic construct
  source 1..25: note = Seed: QTVHSIPLTINKEEALQRPVASDFE
QTVHSIPITIVKFEATQRPVASDFE

SEQ ID NO: 50868 - protein, 25 aa, synthetic construct
  source 1..25: note = Seed: QTVHSIPLTINKEEALQRPVASDFE
QTVHSIPITIVKFEAVQRPVASDFE

SEQ ID NO: 50869 - protein, 25 aa, synthetic construct
  source 1..25: note = Seed: QTVHSIPLTINKEEALQRPVASDFE
QTVHSIPITIVKFEAYQRPVASDFE

SEQ ID NO: 50870 - protein, 25 aa, synthetic construct
  source 1..25: note = Seed: QTVHSIPLTINKEEALQRPVASDFE
QTVHSIPITIVKLEAFQRPVASDFE

SEQ ID NO: 50871 - protein, 25 aa, synthetic construct
  source 1..25: note = Seed: QTVHSIPLTINKEEALQRPVASDFE
QTVHSIPITIVKLEALQRPVASDFE

SEQ ID NO: 50872 - protein, 25 aa, synthetic construct
  source 1..25: note = Seed: QTVHSIPLTINKEEALQRPVASDFE
QTVHSIPITIVKNEAIQRPVASDFE

SEQ ID NO: 50873 - protein, 25 aa, synthetic construct
  source 1..25: note = Seed: QTVHSIPLTINKEEALQRPVASDFE
QTVHSIPITIVKNEAVQRPVASDFE

SEQ ID NO: 50874 - protein, 25 aa, synthetic construct
  source 1..25: note = Seed: QTVHSIPLTINKEEALQRPVASDFE
QTVHSIPITIVKREALQRPVASDFE

SEQ ID NO: 50875 - protein, 25 aa, synthetic construct
  source 1..25: note = Seed: QTVHSIPLTINKEEALQRPVASDFE
QTVHSIPITIVKREAYQRPVASDFE

SEQ ID NO: 50876 - protein, 25 aa, synthetic construct
  source 1..25: note = Seed: QTVHSIPLTINKEEALQRPVASDFE
QTVHSIPITIVKWEAFQRPVASDFE

SEQ ID NO: 50877 - protein, 25 aa, synthetic construct
  source 1..25: note = Seed: QTVHSIPLTINKEEALQRPVASDFE
QTVHSIPITIVKYEAFQRPVASDFE

SEQ ID NO: 50878 - protein, 25 aa, synthetic construct
  source 1..25: note = Seed: QTVHSIPLTINKEEALQRPVASDFE
QTVHSIPITIVKYEAIQRPVASDFE

SEQ ID NO: 50879 - protein, 25 aa, synthetic construct
  source 1..25: note = Seed: QTVHSIPLTINKEEALQRPVASDFE
QTVHSIPITIVKYEALQRPVASDFE

SEQ ID NO: 50880 - protein, 25 aa, synthetic construct
  source 1..25: note = Seed: QTVHSIPLTINKEEALQRPVASDFE
QTVHSIPITIWKAEAFQRPVASDFE

SEQ ID NO: 50881 - protein, 25 aa, synthetic construct
  source 1..25: note = Seed: QTVHSIPLTINKEEALQRPVASDFE
QTVHSIPITIWKAEAIQRPVASDFE

SEQ ID NO: 50882 - protein, 25 aa, synthetic construct
  source 1..25: note = Seed: QTVHSIPLTINKEEALQRPVASDFE
QTVHSIPITIWKAEALQRPVASDFE

SEQ ID NO: 50883 - protein, 25 aa, synthetic construct
  source 1..25: note = Seed: QTVHSIPLTINKEEALQRPVASDFE
QTVHSIPITIWKAEAMQRPVASDFE

SEQ ID NO: 50884 - protein, 25 aa, synthetic construct
  source 1..25: note = Seed: QTVHSIPLTINKEEALQRPVASDFE
QTVHSIPITIWKAEAVQRPVASDFE

SEQ ID NO: 50885 - protein, 25 aa, synthetic construct
  source 1..25: note = Seed: QTVHSIPLTINKEEALQRPVASDFE
QTVHSIPITIWKDEAAQRPVASDFE

SEQ ID NO: 50886 - protein, 25 aa, synthetic construct
  source 1..25: note = Seed: QTVHSIPLTINKEEALQRPVASDFE
QTVHSIPITIWKDEAIQRPVASDFE

SEQ ID NO: 50887 - protein, 25 aa, synthetic construct
  source 1..25: note = Seed: QTVHSIPLTINKEEALQRPVASDFE
QTVHSIPITIWKDEALQRPVASDFE

SEQ ID NO: 50888 - protein, 25 aa, synthetic construct
  source 1..25: note = Seed: QTVHSIPLTINKEEALQRPVASDFE
QTVHSIPITIWKDEAVQRPVASDFE

SEQ ID NO: 50889 - protein, 25 aa, synthetic construct
  source 1..25: note = Seed: QTVHSIPLTINKEEALQRPVASDFE
QTVHSIPITIWKFEAFQRPVASDFE

SEQ ID NO: 50890 - protein, 25 aa, synthetic construct
  source 1..25: note = Seed: QTVHSIPLTINKEEALQRPVASDFE
QTVHSIPITIWKFEAIQRPVASDFE

SEQ ID NO: 50891 - protein, 25 aa, synthetic construct
  source 1..25: note = Seed: QTVHSIPLTINKEEALQRPVASDFE
QTVHSIPITIWKFEALQRPVASDFE

SEQ ID NO: 50892 - protein, 25 aa, synthetic construct
  source 1..25: note = Seed: QTVHSIPLTINKEEALQRPVASDFE
QTVHSIPITIWKFEAMQRPVASDFE

SEQ ID NO: 50893 - protein, 25 aa, synthetic construct
  source 1..25: note = Seed: QTVHSIPLTINKEEALQRPVASDFE
QTVHSIPITIWKFEAVQRPVASDFE

SEQ ID NO: 50894 - protein, 25 aa, synthetic construct
  source 1..25: note = Seed: QTVHSIPLTINKEEALQRPVASDFE
QTVHSIPITIWKHEAFQRPVASDFE

SEQ ID NO: 50895 - protein, 25 aa, synthetic construct
  source 1..25: note = Seed: QTVHSIPLTINKEEALQRPVASDFE
QTVHSIPITIWKHEALQRPVASDFE

SEQ ID NO: 50896 - protein, 25 aa, synthetic construct
  source 1..25: note = Seed: QTVHSIPLTINKEEALQRPVASDFE
QTVHSIPITIWKIEAAQRPVASDFE

SEQ ID NO: 50897 - protein, 25 aa, synthetic construct
  source 1..25: note = Seed: QTVHSIPLTINKEEALQRPVASDFE
QTVHSIPITIWKIEAFQRPVASDFE

SEQ ID NO: 50898 - protein, 25 aa, synthetic construct
  source 1..25: note = Seed: QTVHSIPLTINKEEALQRPVASDFE
QTVHSIPITIWKIEAIQRPVASDFE

SEQ ID NO: 50899 - protein, 25 aa, synthetic construct
  source 1..25: note = Seed: QTVHSIPLTINKEEALQRPVASDFE
QTVHSIPITIWKIEALQRPVASDFE

SEQ ID NO: 50900 - protein, 25 aa, synthetic construct
  source 1..25: note = Seed: QTVHSIPLTINKEEALQRPVASDFE
QTVHSIPITIWKIEAMQRPVASDFE

SEQ ID NO: 50901 - protein, 25 aa, synthetic construct
  source 1..25: note = Seed: QTVHSIPLTINKEEALQRPVASDFE
QTVHSIPITIWKIEAVQRPVASDFE

SEQ ID NO: 50902 - protein, 25 aa, synthetic construct
  source 1..25: note = Seed: QTVHSIPLTINKEEALQRPVASDFE
QTVHSIPITIWKLEAFQRPVASDFE

SEQ ID NO: 50903 - protein, 25 aa, synthetic construct
  source 1..25: note = Seed: QTVHSIPLTINKEEALQRPVASDFE
QTVHSIPITIWKNEAIQRPVASDFE

SEQ ID NO: 50904 - protein, 25 aa, synthetic construct
  source 1..25: note = Seed: QTVHSIPLTINKEEALQRPVASDFE
QTVHSIPITIWKNEALQRPVASDFE

SEQ ID NO: 50905 - protein, 25 aa, synthetic construct
  source 1..25: note = Seed: QTVHSIPLTINKEEALQRPVASDFE
QTVHSIPITIWKREAFQRPVASDFE

SEQ ID NO: 50906 - protein, 25 aa, synthetic construct
  source 1..25: note = Seed: QTVHSIPLTINKEEALQRPVASDFE
QTVHSIPITIWKREAIQRPVASDFE

SEQ ID NO: 50907 - protein, 25 aa, synthetic construct
  source 1..25: note = Seed: QTVHSIPLTINKEEALQRPVASDFE
QTVHSIPITIWKREALQRPVASDFE

SEQ ID NO: 50908 - protein, 25 aa, synthetic construct
  source 1..25: note = Seed: QTVHSIPLTINKEEALQRPVASDFE
QTVHSIPITIWKVEAAQRPVASDFE

SEQ ID NO: 50909 - protein, 25 aa, synthetic construct
  source 1..25: note = Seed: QTVHSIPLTINKEEALQRPVASDFE
QTVHSIPITIWKVEAIQRPVASDFE

SEQ ID NO: 50910 - protein, 25 aa, synthetic construct
  source 1..25: note = Seed: QTVHSIPLTINKEEALQRPVASDFE
QTVHSIPITIWKVEALQRPVASDFE

SEQ ID NO: 50911 - protein, 25 aa, synthetic construct
  source 1..25: note = Seed: QTVHSIPLTINKEEALQRPVASDFE
QTVHSIPITIWKVEAVQRPVASDFE

SEQ ID NO: 50912 - protein, 25 aa, synthetic construct
  source 1..25: note = Seed: QTVHSIPLTINKEEALQRPVASDFE
QTVHSIPITIWKYEAFQRPVASDFE

SEQ ID NO: 50913 - protein, 25 aa, synthetic construct
  source 1..25: note = Seed: QTVHSIPLTINKEEALQRPVASDFE
QTVHSIPITIYKAEAAQRPVASDFE

SEQ ID NO: 50914 - protein, 25 aa, synthetic construct
  source 1..25: note = Seed: QTVHSIPLTINKEEALQRPVASDFE
QTVHSIPITIYKAEAFQRPVASDFE

SEQ ID NO: 50915 - protein, 25 aa, synthetic construct
  source 1..25: note = Seed: QTVHSIPLTINKEEALQRPVASDFE
QTVHSIPITIYKAEAIQRPVASDFE

SEQ ID NO: 50916 - protein, 25 aa, synthetic construct
  source 1..25: note = Seed: QTVHSIPLTINKEEALQRPVASDFE
QTVHSIPITIYKAEALQRPVASDFE

SEQ ID NO: 50917 - protein, 25 aa, synthetic construct
  source 1..25: note = Seed: QTVHSIPLTINKEEALQRPVASDFE
QTVHSIPITIYKAEAMQRPVASDFE

SEQ ID NO: 50918 - protein, 25 aa, synthetic construct
  source 1..25: note = Seed: QTVHSIPLTINKEEALQRPVASDFE
QTVHSIPITIYKAEAVQRPVASDFE

SEQ ID NO: 50919 - protein, 25 aa, synthetic construct
  source 1..25: note = Seed: QTVHSIPLTINKEEALQRPVASDFE
QTVHSIPITIYKDEAAQRPVASDFE

SEQ ID NO: 50920 - protein, 25 aa, synthetic construct
  source 1..25: note = Seed: QTVHSIPLTINKEEALQRPVASDFE
QTVHSIPITIYKDEAFQRPVASDFE

SEQ ID NO: 50921 - protein, 25 aa, synthetic construct
  source 1..25: note = Seed: QTVHSIPLTINKEEALQRPVASDFE
QTVHSIPITIYKDEAIQRPVASDFE

SEQ ID NO: 50922 - protein, 25 aa, synthetic construct
  source 1..25: note = Seed: QTVHSIPLTINKEEALQRPVASDFE
QTVHSIPITIYKDEALQRPVASDFE

SEQ ID NO: 50923 - protein, 25 aa, synthetic construct
  source 1..25: note = Seed: QTVHSIPLTINKEEALQRPVASDFE
QTVHSIPITIYKDEAMQRPVASDFE

SEQ ID NO: 50924 - protein, 25 aa, synthetic construct
  source 1..25: note = Seed: QTVHSIPLTINKEEALQRPVASDFE
QTVHSIPITIYKDEAVQRPVASDFE

SEQ ID NO: 50925 - protein, 25 aa, synthetic construct
  source 1..25: note = Seed: QTVHSIPLTINKEEALQRPVASDFE
QTVHSIPITIYKFEAFQRPVASDFE

SEQ ID NO: 50926 - protein, 25 aa, synthetic construct
  source 1..25: note = Seed: QTVHSIPLTINKEEALQRPVASDFE
QTVHSIPITIYKFEAIQRPVASDFE

SEQ ID NO: 50927 - protein, 25 aa, synthetic construct
  source 1..25: note = Seed: QTVHSIPLTINKEEALQRPVASDFE
QTVHSIPITIYKFEALQRPVASDFE

SEQ ID NO: 50928 - protein, 25 aa, synthetic construct
  source 1..25: note = Seed: QTVHSIPLTINKEEALQRPVASDFE
QTVHSIPITIYKFEAMQRPVASDFE

SEQ ID NO: 50929 - protein, 25 aa, synthetic construct
  source 1..25: note = Seed: QTVHSIPLTINKEEALQRPVASDFE
QTVHSIPITIYKFEAVQRPVASDFE

SEQ ID NO: 50930 - protein, 25 aa, synthetic construct
  source 1..25: note = Seed: QTVHSIPLTINKEEALQRPVASDFE
QTVHSIPITIYKFEAYQRPVASDFE

SEQ ID NO: 50931 - protein, 25 aa, synthetic construct
  source 1..25: note = Seed: QTVHSIPLTINKEEALQRPVASDFE
QTVHSIPITIYKIEAAQRPVASDFE

SEQ ID NO: 50932 - protein, 25 aa, synthetic construct
  source 1..25: note = Seed: QTVHSIPLTINKEEALQRPVASDFE
QTVHSIPITIYKIEAFQRPVASDFE

SEQ ID NO: 50933 - protein, 25 aa, synthetic construct
  source 1..25: note = Seed: QTVHSIPLTINKEEALQRPVASDFE
QTVHSIPITIYKIEAIQRPVASDFE

SEQ ID NO: 50934 - protein, 25 aa, synthetic construct
  source 1..25: note = Seed: QTVHSIPLTINKEEALQRPVASDFE
QTVHSIPITIYKIEALQRPVASDFE

SEQ ID NO: 50935 - protein, 25 aa, synthetic construct
  source 1..25: note = Seed: QTVHSIPLTINKEEALQRPVASDFE
QTVHSIPITIYKIEAMQRPVASDFE

SEQ ID NO: 50936 - protein, 25 aa, synthetic construct
  source 1..25: note = Seed: QTVHSIPLTINKEEALQRPVASDFE
QTVHSIPITIYKIEARQRPVASDFE

SEQ ID NO: 50937 - protein, 25 aa, synthetic construct
  source 1..25: note = Seed: QTVHSIPLTINKEEALQRPVASDFE
QTVHSIPITIYKIEASQRPVASDFE

SEQ ID NO: 50938 - protein, 25 aa, synthetic construct
  source 1..25: note = Seed: QTVHSIPLTINKEEALQRPVASDFE
QTVHSIPITIYKIEAVQRPVASDFE

SEQ ID NO: 50939 - protein, 25 aa, synthetic construct
  source 1..25: note = Seed: QTVHSIPLTINKEEALQRPVASDFE
QTVHSIPITIYKIEAYQRPVASDFE

SEQ ID NO: 50940 - protein, 25 aa, synthetic construct
  source 1..25: note = Seed: QTVHSIPLTINKEEALQRPVASDFE
QTVHSIPITIYKLEAAQRPVASDFE

SEQ ID NO: 50941 - protein, 25 aa, synthetic construct
  source 1..25: note = Seed: QTVHSIPLTINKEEALQRPVASDFE
QTVHSIPITIYKLEAFQRPVASDFE

SEQ ID NO: 50942 - protein, 25 aa, synthetic construct
  source 1..25: note = Seed: QTVHSIPLTINKEEALQRPVASDFE
QTVHSIPITIYKLEAIQRPVASDFE

SEQ ID NO: 50943 - protein, 25 aa, synthetic construct
  source 1..25: note = Seed: QTVHSIPLTINKEEALQRPVASDFE
QTVHSIPITIYKLEAVQRPVASDFE

SEQ ID NO: 50944 - protein, 25 aa, synthetic construct
  source 1..25: note = Seed: QTVHSIPLTINKEEALQRPVASDFE
QTVHSIPITIYKMEAAQRPVASDFE

SEQ ID NO: 50945 - protein, 25 aa, synthetic construct
  source 1..25: note = Seed: QTVHSIPLTINKEEALQRPVASDFE
QTVHSIPITIYKMEAIQRPVASDFE

SEQ ID NO: 50946 - protein, 25 aa, synthetic construct
  source 1..25: note = Seed: QTVHSIPLTINKEEALQRPVASDFE
QTVHSIPITIYKMEAVQRPVASDFE

SEQ ID NO: 50947 - protein, 25 aa, synthetic construct
  source 1..25: note = Seed: QTVHSIPLTINKEEALQRPVASDFE
QTVHSIPITIYKNEAIQRPVASDFE

SEQ ID NO: 50948 - protein, 25 aa, synthetic construct
  source 1..25: note = Seed: QTVHSIPLTINKEEALQRPVASDFE
QTVHSIPITIYKNEALQRPVASDFE

SEQ ID NO: 50949 - protein, 25 aa, synthetic construct
  source 1..25: note = Seed: QTVHSIPLTINKEEALQRPVASDFE
QTVHSIPITIYKNEAVQRPVASDFE

SEQ ID NO: 50950 - protein, 25 aa, synthetic construct
  source 1..25: note = Seed: QTVHSIPLTINKEEALQRPVASDFE
QTVHSIPITIYKSEAIQRPVASDFE

SEQ ID NO: 50951 - protein, 25 aa, synthetic construct
  source 1..25: note = Seed: QTVHSIPLTINKEEALQRPVASDFE
QTVHSIPITIYKVEAAQRPVASDFE

SEQ ID NO: 50952 - protein, 25 aa, synthetic construct
  source 1..25: note = Seed: QTVHSIPLTINKEEALQRPVASDFE
QTVHSIPITIYKVEAFQRPVASDFE

SEQ ID NO: 50953 - protein, 25 aa, synthetic construct
  source 1..25: note = Seed: QTVHSIPLTINKEEALQRPVASDFE
QTVHSIPITIYKVEAIQRPVASDFE

SEQ ID NO: 50954 - protein, 25 aa, synthetic construct
  source 1..25: note = Seed: QTVHSIPLTINKEEALQRPVASDFE
QTVHSIPITIYKVEALQRPVASDFE

SEQ ID NO: 50955 - protein, 25 aa, synthetic construct
  source 1..25: note = Seed: QTVHSIPLTINKEEALQRPVASDFE
QTVHSIPITIYKVEAMQRPVASDFE

SEQ ID NO: 50956 - protein, 25 aa, synthetic construct
  source 1..25: note = Seed: QTVHSIPLTINKEEALQRPVASDFE
QTVHSIPITIYKVEAVQRPVASDFE

SEQ ID NO: 50957 - protein, 25 aa, synthetic construct
  source 1..25: note = Seed: QTVHSIPLTINKEEALQRPVASDFE
QTVHSIPITIYKWEAFQRPVASDFE

SEQ ID NO: 50958 - protein, 25 aa, synthetic construct
  source 1..25: note = Seed: QTVHSIPLTINKEEALQRPVASDFE
QTVHSIPITIYKYEAFQRPVASDFE

SEQ ID NO: 50959 - protein, 25 aa, synthetic construct
  source 1..25: note = Seed: QTVHSIPLTINKEEALQRPVASDFE
QTVHSIPITIYKYEALQRPVASDFE

SEQ ID NO: 50960 - protein, 25 aa, synthetic construct
  source 1..25: note = Seed: QTVHSIPLTINKEEALQRPVASDFE
QTVHSIPKTILKFEALQRPVASDFE

SEQ ID NO: 50961 - protein, 25 aa, synthetic construct
  source 1..25: note = Seed: QTVHSIPLTINKEEALQRPVASDFE
QTVHSIPLTIAKFEAAQRPVASDFE

SEQ ID NO: 50962 - protein, 25 aa, synthetic construct
  source 1..25: note = Seed: QTVHSIPLTINKEEALQRPVASDFE
QTVHSIPLTIAKFEAFQRPVASDFE

SEQ ID NO: 50963 - protein, 25 aa, synthetic construct
  source 1..25: note = Seed: QTVHSIPLTINKEEALQRPVASDFE
QTVHSIPLTIAKFEAIQRPVASDFE

SEQ ID NO: 50964 - protein, 25 aa, synthetic construct
  source 1..25: note = Seed: QTVHSIPLTINKEEALQRPVASDFE
QTVHSIPLTIAKFEALQRPVASDFE

SEQ ID NO: 50965 - protein, 25 aa, synthetic construct
  source 1..25: note = Seed: QTVHSIPLTINKEEALQRPVASDFE
QTVHSIPLTIAKFEAMQRPVASDFE

SEQ ID NO: 50966 - protein, 25 aa, synthetic construct
  source 1..25: note = Seed: QTVHSIPLTINKEEALQRPVASDFE
QTVHSIPLTIAKFEAVQRPVASDFE

SEQ ID NO: 50967 - protein, 25 aa, synthetic construct
  source 1..25: note = Seed: QTVHSIPLTINKEEALQRPVASDFE
QTVHSIPLTIAKFEAYQRPVASDFE

SEQ ID NO: 50968 - protein, 25 aa, synthetic construct
  source 1..25: note = Seed: QTVHSIPLTINKEEALQRPVASDFE
QTVHSIPLTIAKIEAIQRPVASDFE

SEQ ID NO: 50969 - protein, 25 aa, synthetic construct
  source 1..25: note = Seed: QTVHSIPLTINKEEALQRPVASDFE
QTVHSIPLTIAKIEAVQRPVASDFE

SEQ ID NO: 50970 - protein, 25 aa, synthetic construct
  source 1..25: note = Seed: QTVHSIPLTINKEEALQRPVASDFE
QTVHSIPLTIAKNEAIQRPVASDFE

SEQ ID NO: 50971 - protein, 25 aa, synthetic construct
  source 1..25: note = Seed: QTVHSIPLTINKEEALQRPVASDFE
QTVHSIPLTIAKNEAVQRPVASDFE

SEQ ID NO: 50972 - protein, 25 aa, synthetic construct
  source 1..25: note = Seed: QTVHSIPLTINKEEALQRPVASDFE
QTVHSIPLTICKFEAFQRPVASDFE

SEQ ID NO: 50973 - protein, 25 aa, synthetic construct
  source 1..25: note = Seed: QTVHSIPLTINKEEALQRPVASDFE
QTVHSIPLTICKFEALQRPVASDFE

SEQ ID NO: 50974 - protein, 25 aa, synthetic construct
  source 1..25: note = Seed: QTVHSIPLTINKEEALQRPVASDFE
QTVHSIPLTIEKFEAAQRPVASDFE

SEQ ID NO: 50975 - protein, 25 aa, synthetic construct
  source 1..25: note = Seed: QTVHSIPLTINKEEALQRPVASDFE
QTVHSIPLTIEKFEAFQRPVASDFE

SEQ ID NO: 50976 - protein, 25 aa, synthetic construct
  source 1..25: note = Seed: QTVHSIPLTINKEEALQRPVASDFE
QTVHSIPLTIEKFEAIQRPVASDFE

SEQ ID NO: 50977 - protein, 25 aa, synthetic construct
  source 1..25: note = Seed: QTVHSIPLTINKEEALQRPVASDFE
QTVHSIPLTIEKFEALQRPVASDFE

SEQ ID NO: 50978 - protein, 25 aa, synthetic construct
  source 1..25: note = Seed: QTVHSIPLTINKEEALQRPVASDFE
QTVHSIPLTIEKFEAMQRPVASDFE

SEQ ID NO: 50979 - protein, 25 aa, synthetic construct
  source 1..25: note = Seed: QTVHSIPLTINKEEALQRPVASDFE
QTVHSIPLTIEKFEAVQRPVASDFE

SEQ ID NO: 50980 - protein, 25 aa, synthetic construct
  source 1..25: note = Seed: QTVHSIPLTINKEEALQRPVASDFE
QTVHSIPLTIEKFEAYQRPVASDFE

SEQ ID NO: 50981 - protein, 25 aa, synthetic construct
  source 1..25: note = Seed: QTVHSIPLTINKEEALQRPVASDFE
QTVHSIPLTIEKLEALQRPVASDFE

SEQ ID NO: 50982 - protein, 25 aa, synthetic construct
  source 1..25: note = Seed: QTVHSIPLTINKEEALQRPVASDFE
QTVHSIPLTIFKAEAAQRPVASDFE

SEQ ID NO: 50983 - protein, 25 aa, synthetic construct
  source 1..25: note = Seed: QTVHSIPLTINKEEALQRPVASDFE
QTVHSIPLTIFKAEAFQRPVASDFE

SEQ ID NO: 50984 - protein, 25 aa, synthetic construct
  source 1..25: note = Seed: QTVHSIPLTINKEEALQRPVASDFE
QTVHSIPLTIFKAEAIQRPVASDFE

SEQ ID NO: 50985 - protein, 25 aa, synthetic construct
  source 1..25: note = Seed: QTVHSIPLTINKEEALQRPVASDFE
QTVHSIPLTIFKAEALQRPVASDFE

SEQ ID NO: 50986 - protein, 25 aa, synthetic construct
  source 1..25: note = Seed: QTVHSIPLTINKEEALQRPVASDFE
QTVHSIPLTIFKAEAVQRPVASDFE

SEQ ID NO: 50987 - protein, 25 aa, synthetic construct
  source 1..25: note = Seed: QTVHSIPLTINKEEALQRPVASDFE
QTVHSIPLTIFKAEAYQRPVASDFE

SEQ ID NO: 50988 - protein, 25 aa, synthetic construct
  source 1..25: note = Seed: QTVHSIPLTINKEEALQRPVASDFE
QTVHSIPLTIFKDEAAQRPVASDFE

SEQ ID NO: 50989 - protein, 25 aa, synthetic construct
  source 1..25: note = Seed: QTVHSIPLTINKEEALQRPVASDFE
QTVHSIPLTIFKDEAFQRPVASDFE

SEQ ID NO: 50990 - protein, 25 aa, synthetic construct
  source 1..25: note = Seed: QTVHSIPLTINKEEALQRPVASDFE
QTVHSIPLTIFKDEAIQRPVASDFE

SEQ ID NO: 50991 - protein, 25 aa, synthetic construct
  source 1..25: note = Seed: QTVHSIPLTINKEEALQRPVASDFE
QTVHSIPLTIFKDEALQRPVASDFE

SEQ ID NO: 50992 - protein, 25 aa, synthetic construct
  source 1..25: note = Seed: QTVHSIPLTINKEEALQRPVASDFE
QTVHSIPLTIFKDEAMQRPVASDFE

SEQ ID NO: 50993 - protein, 25 aa, synthetic construct
  source 1..25: note = Seed: QTVHSIPLTINKEEALQRPVASDFE
QTVHSIPLTIFKDEASQRPVASDFE

SEQ ID NO: 50994 - protein, 25 aa, synthetic construct
  source 1..25: note = Seed: QTVHSIPLTINKEEALQRPVASDFE
QTVHSIPLTIFKDEAVQRPVASDFE

SEQ ID NO: 50995 - protein, 25 aa, synthetic construct
  source 1..25: note = Seed: QTVHSIPLTINKEEALQRPVASDFE
QTVHSIPLTIFKFEAAQRPVASDFE

SEQ ID NO: 50996 - protein, 25 aa, synthetic construct
  source 1..25: note = Seed: QTVHSIPLTINKEEALQRPVASDFE
QTVHSIPLTIFKFEADQRPVASDFE

SEQ ID NO: 50997 - protein, 25 aa, synthetic construct
  source 1..25: note = Seed: QTVHSIPLTINKEEALQRPVASDFE
QTVHSIPLTIFKFEAEQRPVASDFE

SEQ ID NO: 50998 - protein, 25 aa, synthetic construct
  source 1..25: note = Seed: QTVHSIPLTINKEEALQRPVASDFE
QTVHSIPLTIFKFEAFQRPVASDFE

SEQ ID NO: 50999 - protein, 25 aa, synthetic construct
  source 1..25: note = Seed: QTVHSIPLTINKEEALQRPVASDFE
QTVHSIPLTIFKFEAHQRPVASDFE

SEQ ID NO: 51000 - protein, 25 aa, synthetic construct
  source 1..25: note = Seed: QTVHSIPLTINKEEALQRPVASDFE
QTVHSIPLTIFKFEAIQRPVASDFE

SEQ ID NO: 51001 - protein, 25 aa, synthetic construct
  source 1..25: note = Seed: QTVHSIPLTINKEEALQRPVASDFE
QTVHSIPLTIFKFEALQRPVASDFE

SEQ ID NO: 51002 - protein, 25 aa, synthetic construct
  source 1..25: note = Seed: QTVHSIPLTINKEEALQRPVASDFE
QTVHSIPLTIFKFEAMQRPVASDFE

SEQ ID NO: 51003 - protein, 25 aa, synthetic construct
  source 1..25: note = Seed: QTVHSIPLTINKEEALQRPVASDFE
QTVHSIPLTIFKFEANQRPVASDFE

SEQ ID NO: 51004 - protein, 25 aa, synthetic construct
  source 1..25: note = Seed: QTVHSIPLTINKEEALQRPVASDFE
QTVHSIPLTIFKFEAQQRPVASDFE

SEQ ID NO: 51005 - protein, 25 aa, synthetic construct
  source 1..25: note = Seed: QTVHSIPLTINKEEALQRPVASDFE
QTVHSIPLTIFKFEARQRPVASDFE

SEQ ID NO: 51006 - protein, 25 aa, synthetic construct
  source 1..25: note = Seed: QTVHSIPLTINKEEALQRPVASDFE
QTVHSIPLTIFKFEASQRPVASDFE

SEQ ID NO: 51007 - protein, 25 aa, synthetic construct
  source 1..25: note = Seed: QTVHSIPLTINKEEALQRPVASDFE
QTVHSIPLTIFKFEATQRPVASDFE

SEQ ID NO: 51008 - protein, 25 aa, synthetic construct
  source 1..25: note = Seed: QTVHSIPLTINKEEALQRPVASDFE
QTVHSIPLTIFKFEAVQRPVASDFE

SEQ ID NO: 51009 - protein, 25 aa, synthetic construct
  source 1..25: note = Seed: QTVHSIPLTINKEEALQRPVASDFE
QTVHSIPLTIFKFEAWQRPVASDFE

SEQ ID NO: 51010 - protein, 25 aa, synthetic construct
  source 1..25: note = Seed: QTVHSIPLTINKEEALQRPVASDFE
QTVHSIPLTIFKFEAYQRPVASDFE

SEQ ID NO: 51011 - protein, 25 aa, synthetic construct
  source 1..25: note = Seed: QTVHSIPLTINKEEALQRPVASDFE
QTVHSIPLTIFKHEAFQRPVASDFE

SEQ ID NO: 51012 - protein, 25 aa, synthetic construct
  source 1..25: note = Seed: QTVHSIPLTINKEEALQRPVASDFE
QTVHSIPLTIFKHEALQRPVASDFE

SEQ ID NO: 51013 - protein, 25 aa, synthetic construct
  source 1..25: note = Seed: QTVHSIPLTINKEEALQRPVASDFE
QTVHSIPLTIFKHEAYQRPVASDFE

SEQ ID NO: 51014 - protein, 25 aa, synthetic construct
  source 1..25: note = Seed: QTVHSIPLTINKEEALQRPVASDFE
QTVHSIPLTIFKIEAAQRPVASDFE

SEQ ID NO: 51015 - protein, 25 aa, synthetic construct
  source 1..25: note = Seed: QTVHSIPLTINKEEALQRPVASDFE
QTVHSIPLTIFKIEAFQRPVASDFE

SEQ ID NO: 51016 - protein, 25 aa, synthetic construct
  source 1..25: note = Seed: QTVHSIPLTINKEEALQRPVASDFE
QTVHSIPLTIFKIEAIQRPVASDFE

SEQ ID NO: 51017 - protein, 25 aa, synthetic construct
  source 1..25: note = Seed: QTVHSIPLTINKEEALQRPVASDFE
QTVHSIPLTIFKIEALQRPVASDFE

SEQ ID NO: 51018 - protein, 25 aa, synthetic construct
  source 1..25: note = Seed: QTVHSIPLTINKEEALQRPVASDFE
QTVHSIPLTIFKIEAMQRPVASDFE

SEQ ID NO: 51019 - protein, 25 aa, synthetic construct
  source 1..25: note = Seed: QTVHSIPLTINKEEALQRPVASDFE
QTVHSIPLTIFKIEARQRPVASDFE

SEQ ID NO: 51020 - protein, 25 aa, synthetic construct
  source 1..25: note = Seed: QTVHSIPLTINKEEALQRPVASDFE
QTVHSIPLTIFKIEASQRPVASDFE

SEQ ID NO: 51021 - protein, 25 aa, synthetic construct
  source 1..25: note = Seed: QTVHSIPLTINKEEALQRPVASDFE
QTVHSIPLTIFKIEAVQRPVASDFE

SEQ ID NO: 51022 - protein, 25 aa, synthetic construct
  source 1..25: note = Seed: QTVHSIPLTINKEEALQRPVASDFE
QTVHSIPLTIFKIEAYQRPVASDFE

SEQ ID NO: 51023 - protein, 25 aa, synthetic construct
  source 1..25: note = Seed: QTVHSIPLTINKEEALQRPVASDFE
QTVHSIPLTIFKKEAFQRPVASDFE

SEQ ID NO: 51024 - protein, 25 aa, synthetic construct
  source 1..25: note = Seed: QTVHSIPLTINKEEALQRPVASDFE
QTVHSIPLTIFKKEAIQRPVASDFE

SEQ ID NO: 51025 - protein, 25 aa, synthetic construct
  source 1..25: note = Seed: QTVHSIPLTINKEEALQRPVASDFE
QTVHSIPLTIFKKEALQRPVASDFE

SEQ ID NO: 51026 - protein, 25 aa, synthetic construct
  source 1..25: note = Seed: QTVHSIPLTINKEEALQRPVASDFE
QTVHSIPLTIFKLEAAQRPVASDFE

SEQ ID NO: 51027 - protein, 25 aa, synthetic construct
  source 1..25: note = Seed: QTVHSIPLTINKEEALQRPVASDFE
QTVHSIPLTIFKLEAEQRPVASDFE

SEQ ID NO: 51028 - protein, 25 aa, synthetic construct
  source 1..25: note = Seed: QTVHSIPLTINKEEALQRPVASDFE
QTVHSIPLTIFKLEAFQRPVASDFE

SEQ ID NO: 51029 - protein, 25 aa, synthetic construct
  source 1..25: note = Seed: QTVHSIPLTINKEEALQRPVASDFE
QTVHSIPLTIFKLEAIQRPVASDFE

SEQ ID NO: 51030 - protein, 25 aa, synthetic construct
  source 1..25: note = Seed: QTVHSIPLTINKEEALQRPVASDFE
QTVHSIPLTIFKLEALQRPVASDFE

SEQ ID NO: 51031 - protein, 25 aa, synthetic construct
  source 1..25: note = Seed: QTVHSIPLTINKEEALQRPVASDFE
QTVHSIPLTIFKLEAMQRPVASDFE

SEQ ID NO: 51032 - protein, 25 aa, synthetic construct
  source 1..25: note = Seed: QTVHSIPLTINKEEALQRPVASDFE
QTVHSIPLTIFKLEARQRPVASDFE

SEQ ID NO: 51033 - protein, 25 aa, synthetic construct
  source 1..25: note = Seed: QTVHSIPLTINKEEALQRPVASDFE
QTVHSIPLTIFKLEAVQRPVASDFE

SEQ ID NO: 51034 - protein, 25 aa, synthetic construct
  source 1..25: note = Seed: QTVHSIPLTINKEEALQRPVASDFE
QTVHSIPLTIFKLEAWQRPVASDFE

SEQ ID NO: 51035 - protein, 25 aa, synthetic construct
  source 1..25: note = Seed: QTVHSIPLTINKEEALQRPVASDFE
QTVHSIPLTIFKLEAYQRPVASDFE

SEQ ID NO: 51036 - protein, 25 aa, synthetic construct
  source 1..25: note = Seed: QTVHSIPLTINKEEALQRPVASDFE
QTVHSIPLTIFKMEAAQRPVASDFE

SEQ ID NO: 51037 - protein, 25 aa, synthetic construct
  source 1..25: note = Seed: QTVHSIPLTINKEEALQRPVASDFE
QTVHSIPLTIFKMEAFQRPVASDFE

SEQ ID NO: 51038 - protein, 25 aa, synthetic construct
  source 1..25: note = Seed: QTVHSIPLTINKEEALQRPVASDFE
QTVHSIPLTIFKMEAIQRPVASDFE

SEQ ID NO: 51039 - protein, 25 aa, synthetic construct
  source 1..25: note = Seed: QTVHSIPLTINKEEALQRPVASDFE
QTVHSIPLTIFKMEALQRPVASDFE

SEQ ID NO: 51040 - protein, 25 aa, synthetic construct
  source 1..25: note = Seed: QTVHSIPLTINKEEALQRPVASDFE
QTVHSIPLTIFKMEAMQRPVASDFE

SEQ ID NO: 51041 - protein, 25 aa, synthetic construct
  source 1..25: note = Seed: QTVHSIPLTINKEEALQRPVASDFE
QTVHSIPLTIFKMEAVQRPVASDFE

SEQ ID NO: 51042 - protein, 25 aa, synthetic construct
  source 1..25: note = Seed: QTVHSIPLTINKEEALQRPVASDFE
QTVHSIPLTIFKMEAYQRPVASDFE

SEQ ID NO: 51043 - protein, 25 aa, synthetic construct
  source 1..25: note = Seed: QTVHSIPLTINKEEALQRPVASDFE
QTVHSIPLTIFKNEAAQRPVASDFE

SEQ ID NO: 51044 - protein, 25 aa, synthetic construct
  source 1..25: note = Seed: QTVHSIPLTINKEEALQRPVASDFE
QTVHSIPLTIFKNEAIQRPVASDFE

SEQ ID NO: 51045 - protein, 25 aa, synthetic construct
  source 1..25: note = Seed: QTVHSIPLTINKEEALQRPVASDFE
QTVHSIPLTIFKNEALQRPVASDFE

SEQ ID NO: 51046 - protein, 25 aa, synthetic construct
  source 1..25: note = Seed: QTVHSIPLTINKEEALQRPVASDFE
QTVHSIPLTIFKNEAVQRPVASDFE

SEQ ID NO: 51047 - protein, 25 aa, synthetic construct
  source 1..25: note = Seed: QTVHSIPLTINKEEALQRPVASDFE
QTVHSIPLTIFKQEAFQRPVASDFE

SEQ ID NO: 51048 - protein, 25 aa, synthetic construct
  source 1..25: note = Seed: QTVHSIPLTINKEEALQRPVASDFE
QTVHSIPLTIFKREAFQRPVASDFE

SEQ ID NO: 51049 - protein, 25 aa, synthetic construct
  source 1..25: note = Seed: QTVHSIPLTINKEEALQRPVASDFE
QTVHSIPLTIFKREAIQRPVASDFE

SEQ ID NO: 51050 - protein, 25 aa, synthetic construct
  source 1..25: note = Seed: QTVHSIPLTINKEEALQRPVASDFE
QTVHSIPLTIFKREALQRPVASDFE

SEQ ID NO: 51051 - protein, 25 aa, synthetic construct
  source 1..25: note = Seed: QTVHSIPLTINKEEALQRPVASDFE
QTVHSIPLTIFKREAMQRPVASDFE

SEQ ID NO: 51052 - protein, 25 aa, synthetic construct
  source 1..25: note = Seed: QTVHSIPLTINKEEALQRPVASDFE
QTVHSIPLTIFKREARQRPVASDFE

SEQ ID NO: 51053 - protein, 25 aa, synthetic construct
  source 1..25: note = Seed: QTVHSIPLTINKEEALQRPVASDFE
QTVHSIPLTIFKREAVQRPVASDFE

SEQ ID NO: 51054 - protein, 25 aa, synthetic construct
  source 1..25: note = Seed: QTVHSIPLTINKEEALQRPVASDFE
QTVHSIPLTIFKREAYQRPVASDFE

SEQ ID NO: 51055 - protein, 25 aa, synthetic construct
  source 1..25: note = Seed: QTVHSIPLTINKEEALQRPVASDFE
QTVHSIPLTIFKSEAFQRPVASDFE

SEQ ID NO: 51056 - protein, 25 aa, synthetic construct
  source 1..25: note = Seed: QTVHSIPLTINKEEALQRPVASDFE
QTVHSIPLTIFKSEAIQRPVASDFE

SEQ ID NO: 51057 - protein, 25 aa, synthetic construct
  source 1..25: note = Seed: QTVHSIPLTINKEEALQRPVASDFE
QTVHSIPLTIFKSEALQRPVASDFE

SEQ ID NO: 51058 - protein, 25 aa, synthetic construct
  source 1..25: note = Seed: QTVHSIPLTINKEEALQRPVASDFE
QTVHSIPLTIFKSEAVQRPVASDFE

SEQ ID NO: 51059 - protein, 25 aa, synthetic construct
  source 1..25: note = Seed: QTVHSIPLTINKEEALQRPVASDFE
QTVHSIPLTIFKTEAFQRPVASDFE

SEQ ID NO: 51060 - protein, 25 aa, synthetic construct
  source 1..25: note = Seed: QTVHSIPLTINKEEALQRPVASDFE
QTVHSIPLTIFKTEALQRPVASDFE

SEQ ID NO: 51061 - protein, 25 aa, synthetic construct
  source 1..25: note = Seed: QTVHSIPLTINKEEALQRPVASDFE
QTVHSIPLTIFKVEAAQRPVASDFE

SEQ ID NO: 51062 - protein, 25 aa, synthetic construct
  source 1..25: note = Seed: QTVHSIPLTINKEEALQRPVASDFE
QTVHSIPLTIFKVEAFQRPVASDFE

SEQ ID NO: 51063 - protein, 25 aa, synthetic construct
  source 1..25: note = Seed: QTVHSIPLTINKEEALQRPVASDFE
QTVHSIPLTIFKVEAIQRPVASDFE

SEQ ID NO: 51064 - protein, 25 aa, synthetic construct
  source 1..25: note = Seed: QTVHSIPLTINKEEALQRPVASDFE
QTVHSIPLTIFKVEALQRPVASDFE

SEQ ID NO: 51065 - protein, 25 aa, synthetic construct
  source 1..25: note = Seed: QTVHSIPLTINKEEALQRPVASDFE
QTVHSIPLTIFKVEAMQRPVASDFE

SEQ ID NO: 51066 - protein, 25 aa, synthetic construct
  source 1..25: note = Seed: QTVHSIPLTINKEEALQRPVASDFE
QTVHSIPLTIFKVEAVQRPVASDFE

SEQ ID NO: 51067 - protein, 25 aa, synthetic construct
  source 1..25: note = Seed: QTVHSIPLTINKEEALQRPVASDFE
QTVHSIPLTIFKVEAYQRPVASDFE

SEQ ID NO: 51068 - protein, 25 aa, synthetic construct
  source 1..25: note = Seed: QTVHSIPLTINKEEALQRPVASDFE
QTVHSIPLTIFKWEAFQRPVASDFE

SEQ ID NO: 51069 - protein, 25 aa, synthetic construct
  source 1..25: note = Seed: QTVHSIPLTINKEEALQRPVASDFE
QTVHSIPLTIFKWEAIQRPVASDFE

SEQ ID NO: 51070 - protein, 25 aa, synthetic construct
  source 1..25: note = Seed: QTVHSIPLTINKEEALQRPVASDFE
QTVHSIPLTIFKWEALQRPVASDFE

SEQ ID NO: 51071 - protein, 25 aa, synthetic construct
  source 1..25: note = Seed: QTVHSIPLTINKEEALQRPVASDFE
QTVHSIPLTIFKWEAMQRPVASDFE

SEQ ID NO: 51072 - protein, 25 aa, synthetic construct
  source 1..25: note = Seed: QTVHSIPLTINKEEALQRPVASDFE
QTVHSIPLTIFKWEAVQRPVASDFE

SEQ ID NO: 51073 - protein, 25 aa, synthetic construct
  source 1..25: note = Seed: QTVHSIPLTINKEEALQRPVASDFE
QTVHSIPLTIFKWEAYQRPVASDFE

SEQ ID NO: 51074 - protein, 25 aa, synthetic construct
  source 1..25: note = Seed: QTVHSIPLTINKEEALQRPVASDFE
QTVHSIPLTIFKYEAFQRPVASDFE

SEQ ID NO: 51075 - protein, 25 aa, synthetic construct
  source 1..25: note = Seed: QTVHSIPLTINKEEALQRPVASDFE
QTVHSIPLTIFKYEAIQRPVASDFE

SEQ ID NO: 51076 - protein, 25 aa, synthetic construct
  source 1..25: note = Seed: QTVHSIPLTINKEEALQRPVASDFE
QTVHSIPLTIFKYEALQRPVASDFE

SEQ ID NO: 51077 - protein, 25 aa, synthetic construct
  source 1..25: note = Seed: QTVHSIPLTINKEEALQRPVASDFE
QTVHSIPLTIFKYEAMQRPVASDFE

SEQ ID NO: 51078 - protein, 25 aa, synthetic construct
  source 1..25: note = Seed: QTVHSIPLTINKEEALQRPVASDFE
QTVHSIPLTIFKYEAVQRPVASDFE

SEQ ID NO: 51079 - protein, 25 aa, synthetic construct
  source 1..25: note = Seed: QTVHSIPLTINKEEALQRPVASDFE
QTVHSIPLTIFKYEAWQRPVASDFE

SEQ ID NO: 51080 - protein, 25 aa, synthetic construct
  source 1..25: note = Seed: QTVHSIPLTINKEEALQRPVASDFE
QTVHSIPLTIFKYEAYQRPVASDFE

SEQ ID NO: 51081 - protein, 25 aa, synthetic construct
  source 1..25: note = Seed: QTVHSIPLTINKEEALQRPVASDFE
QTVHSIPLTIHKFEAAQRPVASDFE

SEQ ID NO: 51082 - protein, 25 aa, synthetic construct
  source 1..25: note = Seed: QTVHSIPLTINKEEALQRPVASDFE
QTVHSIPLTIHKFEAFQRPVASDFE

SEQ ID NO: 51083 - protein, 25 aa, synthetic construct
  source 1..25: note = Seed: QTVHSIPLTINKEEALQRPVASDFE
QTVHSIPLTIHKFEAIQRPVASDFE

SEQ ID NO: 51084 - protein, 25 aa, synthetic construct
  source 1..25: note = Seed: QTVHSIPLTINKEEALQRPVASDFE
QTVHSIPLTIHKFEALQRPVASDFE

SEQ ID NO: 51085 - protein, 25 aa, synthetic construct
  source 1..25: note = Seed: QTVHSIPLTINKEEALQRPVASDFE
QTVHSIPLTIHKFEAMQRPVASDFE

SEQ ID NO: 51086 - protein, 25 aa, synthetic construct
  source 1..25: note = Seed: QTVHSIPLTINKEEALQRPVASDFE
QTVHSIPLTIHKFEAVQRPVASDFE

SEQ ID NO: 51087 - protein, 25 aa, synthetic construct
  source 1..25: note = Seed: QTVHSIPLTINKEEALQRPVASDFE
QTVHSIPLTIHKFEAYQRPVASDFE

SEQ ID NO: 51088 - protein, 25 aa, synthetic construct
  source 1..25: note = Seed: QTVHSIPLTINKEEALQRPVASDFE
QTVHSIPLTIHKREAFQRPVASDFE

SEQ ID NO: 51089 - protein, 25 aa, synthetic construct
  source 1..25: note = Seed: QTVHSIPLTINKEEALQRPVASDFE
QTVHSIPLTIIKAEAAQRPVASDFE

SEQ ID NO: 51090 - protein, 25 aa, synthetic construct
  source 1..25: note = Seed: QTVHSIPLTINKEEALQRPVASDFE
QTVHSIPLTIIKAEAFQRPVASDFE

SEQ ID NO: 51091 - protein, 25 aa, synthetic construct
  source 1..25: note = Seed: QTVHSIPLTINKEEALQRPVASDFE
QTVHSIPLTIIKAEAIQRPVASDFE

SEQ ID NO: 51092 - protein, 25 aa, synthetic construct
  source 1..25: note = Seed: QTVHSIPLTINKEEALQRPVASDFE
QTVHSIPLTIIKAEAVQRPVASDFE

SEQ ID NO: 51093 - protein, 25 aa, synthetic construct
  source 1..25: note = Seed: QTVHSIPLTINKEEALQRPVASDFE
QTVHSIPLTIIKDEAIQRPVASDFE

SEQ ID NO: 51094 - protein, 25 aa, synthetic construct
  source 1..25: note = Seed: QTVHSIPLTINKEEALQRPVASDFE
QTVHSIPLTIIKDEAVQRPVASDFE

SEQ ID NO: 51095 - protein, 25 aa, synthetic construct
  source 1..25: note = Seed: QTVHSIPLTINKEEALQRPVASDFE
QTVHSIPLTIIKFEAAQRPVASDFE

SEQ ID NO: 51096 - protein, 25 aa, synthetic construct
  source 1..25: note = Seed: QTVHSIPLTINKEEALQRPVASDFE
QTVHSIPLTIIKFEADQRPVASDFE

SEQ ID NO: 51097 - protein, 25 aa, synthetic construct
  source 1..25: note = Seed: QTVHSIPLTINKEEALQRPVASDFE
QTVHSIPLTIIKFEAEQRPVASDFE

SEQ ID NO: 51098 - protein, 25 aa, synthetic construct
  source 1..25: note = Seed: QTVHSIPLTINKEEALQRPVASDFE
QTVHSIPLTIIKFEAFQRPVASDFE

SEQ ID NO: 51099 - protein, 25 aa, synthetic construct
  source 1..25: note = Seed: QTVHSIPLTINKEEALQRPVASDFE
QTVHSIPLTIIKFEAHQRPVASDFE

SEQ ID NO: 51100 - protein, 25 aa, synthetic construct
  source 1..25: note = Seed: QTVHSIPLTINKEEALQRPVASDFE
QTVHSIPLTIIKFEAIQRPVASDFE

SEQ ID NO: 51101 - protein, 25 aa, synthetic construct
  source 1..25: note = Seed: QTVHSIPLTINKEEALQRPVASDFE
QTVHSIPLTIIKFEALQRPVASDFE

SEQ ID NO: 51102 - protein, 25 aa, synthetic construct
  source 1..25: note = Seed: QTVHSIPLTINKEEALQRPVASDFE
QTVHSIPLTIIKFEAMQRPVASDFE

SEQ ID NO: 51103 - protein, 25 aa, synthetic construct
  source 1..25: note = Seed: QTVHSIPLTINKEEALQRPVASDFE
QTVHSIPLTIIKFEANQRPVASDFE

SEQ ID NO: 51104 - protein, 25 aa, synthetic construct
  source 1..25: note = Seed: QTVHSIPLTINKEEALQRPVASDFE
QTVHSIPLTIIKFEAQQRPVASDFE

SEQ ID NO: 51105 - protein, 25 aa, synthetic construct
  source 1..25: note = Seed: QTVHSIPLTINKEEALQRPVASDFE
QTVHSIPLTIIKFEASQRPVASDFE

SEQ ID NO: 51106 - protein, 25 aa, synthetic construct
  source 1..25: note = Seed: QTVHSIPLTINKEEALQRPVASDFE
QTVHSIPLTIIKFEATQRPVASDFE

SEQ ID NO: 51107 - protein, 25 aa, synthetic construct
  source 1..25: note = Seed: QTVHSIPLTINKEEALQRPVASDFE
QTVHSIPLTIIKFEAVQRPVASDFE

SEQ ID NO: 51108 - protein, 25 aa, synthetic construct
  source 1..25: note = Seed: QTVHSIPLTINKEEALQRPVASDFE
QTVHSIPLTIIKFEAWQRPVASDFE

SEQ ID NO: 51109 - protein, 25 aa, synthetic construct
  source 1..25: note = Seed: QTVHSIPLTINKEEALQRPVASDFE
QTVHSIPLTIIKFEAYQRPVASDFE

SEQ ID NO: 51110 - protein, 25 aa, synthetic construct
  source 1..25: note = Seed: QTVHSIPLTINKEEALQRPVASDFE
QTVHSIPLTIIKHEAFQRPVASDFE

SEQ ID NO: 51111 - protein, 25 aa, synthetic construct
  source 1..25: note = Seed: QTVHSIPLTINKEEALQRPVASDFE
QTVHSIPLTIIKHEARQRPVASDFE

SEQ ID NO: 51112 - protein, 25 aa, synthetic construct
  source 1..25: note = Seed: QTVHSIPLTINKEEALQRPVASDFE
QTVHSIPLTIIKIEAAQRPVASDFE

SEQ ID NO: 51113 - protein, 25 aa, synthetic construct
  source 1..25: note = Seed: QTVHSIPLTINKEEALQRPVASDFE
QTVHSIPLTIIKIEAFQRPVASDFE

SEQ ID NO: 51114 - protein, 25 aa, synthetic construct
  source 1..25: note = Seed: QTVHSIPLTINKEEALQRPVASDFE
QTVHSIPLTIIKIEAIQRPVASDFE

SEQ ID NO: 51115 - protein, 25 aa, synthetic construct
  source 1..25: note = Seed: QTVHSIPLTINKEEALQRPVASDFE
QTVHSIPLTIIKIEALQRPVASDFE

SEQ ID NO: 51116 - protein, 25 aa, synthetic construct
  source 1..25: note = Seed: QTVHSIPLTINKEEALQRPVASDFE
QTVHSIPLTIIKIEAVQRPVASDFE

SEQ ID NO: 51117 - protein, 25 aa, synthetic construct
  source 1..25: note = Seed: QTVHSIPLTINKEEALQRPVASDFE
QTVHSIPLTIIKKEALQRPVASDFE

SEQ ID NO: 51118 - protein, 25 aa, synthetic construct
  source 1..25: note = Seed: QTVHSIPLTINKEEALQRPVASDFE
QTVHSIPLTIIKLEAFQRPVASDFE

SEQ ID NO: 51119 - protein, 25 aa, synthetic construct
  source 1..25: note = Seed: QTVHSIPLTINKEEALQRPVASDFE
QTVHSIPLTIIKLEAIQRPVASDFE

SEQ ID NO: 51120 - protein, 25 aa, synthetic construct
  source 1..25: note = Seed: QTVHSIPLTINKEEALQRPVASDFE
QTVHSIPLTIIKLEALQRPVASDFE

SEQ ID NO: 51121 - protein, 25 aa, synthetic construct
  source 1..25: note = Seed: QTVHSIPLTINKEEALQRPVASDFE
QTVHSIPLTIIKLEAMQRPVASDFE

SEQ ID NO: 51122 - protein, 25 aa, synthetic construct
  source 1..25: note = Seed: QTVHSIPLTINKEEALQRPVASDFE
QTVHSIPLTIIKLEAVQRPVASDFE

SEQ ID NO: 51123 - protein, 25 aa, synthetic construct
  source 1..25: note = Seed: QTVHSIPLTINKEEALQRPVASDFE
QTVHSIPLTIIKLEAYQRPVASDFE

SEQ ID NO: 51124 - protein, 25 aa, synthetic construct
  source 1..25: note = Seed: QTVHSIPLTINKEEALQRPVASDFE
QTVHSIPLTIIKMEAFQRPVASDFE

SEQ ID NO: 51125 - protein, 25 aa, synthetic construct
  source 1..25: note = Seed: QTVHSIPLTINKEEALQRPVASDFE
QTVHSIPLTIIKMEALQRPVASDFE

SEQ ID NO: 51126 - protein, 25 aa, synthetic construct
  source 1..25: note = Seed: QTVHSIPLTINKEEALQRPVASDFE
QTVHSIPLTIIKNEAVQRPVASDFE

SEQ ID NO: 51127 - protein, 25 aa, synthetic construct
  source 1..25: note = Seed: QTVHSIPLTINKEEALQRPVASDFE
QTVHSIPLTIIKREAFQRPVASDFE

SEQ ID NO: 51128 - protein, 25 aa, synthetic construct
  source 1..25: note = Seed: QTVHSIPLTINKEEALQRPVASDFE
QTVHSIPLTIIKREAIQRPVASDFE

SEQ ID NO: 51129 - protein, 25 aa, synthetic construct
  source 1..25: note = Seed: QTVHSIPLTINKEEALQRPVASDFE
QTVHSIPLTIIKREALQRPVASDFE

SEQ ID NO: 51130 - protein, 25 aa, synthetic construct
  source 1..25: note = Seed: QTVHSIPLTINKEEALQRPVASDFE
QTVHSIPLTIIKREAMQRPVASDFE

SEQ ID NO: 51131 - protein, 25 aa, synthetic construct
  source 1..25: note = Seed: QTVHSIPLTINKEEALQRPVASDFE
QTVHSIPLTIIKREARQRPVASDFE

SEQ ID NO: 51132 - protein, 25 aa, synthetic construct
  source 1..25: note = Seed: QTVHSIPLTINKEEALQRPVASDFE
QTVHSIPLTIIKREAVQRPVASDFE

SEQ ID NO: 51133 - protein, 25 aa, synthetic construct
  source 1..25: note = Seed: QTVHSIPLTINKEEALQRPVASDFE
QTVHSIPLTIIKREAYQRPVASDFE

SEQ ID NO: 51134 - protein, 25 aa, synthetic construct
  source 1..25: note = Seed: QTVHSIPLTINKEEALQRPVASDFE
QTVHSIPLTIIKVEAAQRPVASDFE

SEQ ID NO: 51135 - protein, 25 aa, synthetic construct
  source 1..25: note = Seed: QTVHSIPLTINKEEALQRPVASDFE
QTVHSIPLTIIKVEAFQRPVASDFE

SEQ ID NO: 51136 - protein, 25 aa, synthetic construct
  source 1..25: note = Seed: QTVHSIPLTINKEEALQRPVASDFE
QTVHSIPLTIIKVEAIQRPVASDFE

SEQ ID NO: 51137 - protein, 25 aa, synthetic construct
  source 1..25: note = Seed: QTVHSIPLTINKEEALQRPVASDFE
QTVHSIPLTIIKVEARQRPVASDFE

SEQ ID NO: 51138 - protein, 25 aa, synthetic construct
  source 1..25: note = Seed: QTVHSIPLTINKEEALQRPVASDFE
QTVHSIPLTIIKVEAVQRPVASDFE

SEQ ID NO: 51139 - protein, 25 aa, synthetic construct
  source 1..25: note = Seed: QTVHSIPLTINKEEALQRPVASDFE
QTVHSIPLTIIKWEAFQRPVASDFE

SEQ ID NO: 51140 - protein, 25 aa, synthetic construct
  source 1..25: note = Seed: QTVHSIPLTINKEEALQRPVASDFE
QTVHSIPLTIIKWEAIQRPVASDFE

SEQ ID NO: 51141 - protein, 25 aa, synthetic construct
  source 1..25: note = Seed: QTVHSIPLTINKEEALQRPVASDFE
QTVHSIPLTIIKWEALQRPVASDFE

SEQ ID NO: 51142 - protein, 25 aa, synthetic construct
  source 1..25: note = Seed: QTVHSIPLTINKEEALQRPVASDFE
QTVHSIPLTIIKWEAVQRPVASDFE

SEQ ID NO: 51143 - protein, 25 aa, synthetic construct
  source 1..25: note = Seed: QTVHSIPLTINKEEALQRPVASDFE
QTVHSIPLTIIKWEAYQRPVASDFE

SEQ ID NO: 51144 - protein, 25 aa, synthetic construct
  source 1..25: note = Seed: QTVHSIPLTINKEEALQRPVASDFE
QTVHSIPLTIIKYEAFQRPVASDFE

SEQ ID NO: 51145 - protein, 25 aa, synthetic construct
  source 1..25: note = Seed: QTVHSIPLTINKEEALQRPVASDFE
QTVHSIPLTIIKYEAIQRPVASDFE

SEQ ID NO: 51146 - protein, 25 aa, synthetic construct
  source 1..25: note = Seed: QTVHSIPLTINKEEALQRPVASDFE
QTVHSIPLTIIKYEALQRPVASDFE

SEQ ID NO: 51147 - protein, 25 aa, synthetic construct
  source 1..25: note = Seed: QTVHSIPLTINKEEALQRPVASDFE
QTVHSIPLTIIKYEAMQRPVASDFE

SEQ ID NO: 51148 - protein, 25 aa, synthetic construct
  source 1..25: note = Seed: QTVHSIPLTINKEEALQRPVASDFE
QTVHSIPLTIIKYEAVQRPVASDFE

SEQ ID NO: 51149 - protein, 25 aa, synthetic construct
  source 1..25: note = Seed: QTVHSIPLTINKEEALQRPVASDFE
QTVHSIPLTIIKYEAWQRPVASDFE

SEQ ID NO: 51150 - protein, 25 aa, synthetic construct
  source 1..25: note = Seed: QTVHSIPLTINKEEALQRPVASDFE
QTVHSIPLTIIKYEAYQRPVASDFE

SEQ ID NO: 51151 - protein, 25 aa, synthetic construct
  source 1..25: note = Seed: QTVHSIPLTINKEEALQRPVASDFE
QTVHSIPLTIKKFEAIQRPVASDFE

SEQ ID NO: 51152 - protein, 25 aa, synthetic construct
  source 1..25: note = Seed: QTVHSIPLTINKEEALQRPVASDFE
QTVHSIPLTIKKFEALQRPVASDFE

SEQ ID NO: 51153 - protein, 25 aa, synthetic construct
  source 1..25: note = Seed: QTVHSIPLTINKEEALQRPVASDFE
QTVHSIPLTILKAEAFQRPVASDFE

SEQ ID NO: 51154 - protein, 25 aa, synthetic construct
  source 1..25: note = Seed: QTVHSIPLTINKEEALQRPVASDFE
QTVHSIPLTILKAEAIQRPVASDFE

SEQ ID NO: 51155 - protein, 25 aa, synthetic construct
  source 1..25: note = Seed: QTVHSIPLTINKEEALQRPVASDFE
QTVHSIPLTILKAEAVQRPVASDFE

SEQ ID NO: 51156 - protein, 25 aa, synthetic construct
  source 1..25: note = Seed: QTVHSIPLTINKEEALQRPVASDFE
QTVHSIPLTILKFEAAQRPVASDFE

SEQ ID NO: 51157 - protein, 25 aa, synthetic construct
  source 1..25: note = Seed: QTVHSIPLTINKEEALQRPVASDFE
QTVHSIPLTILKFEADQRPVASDFE

SEQ ID NO: 51158 - protein, 25 aa, synthetic construct
  source 1..25: note = Seed: QTVHSIPLTINKEEALQRPVASDFE
QTVHSIPLTILKFEAEQRPVASDFE

SEQ ID NO: 51159 - protein, 25 aa, synthetic construct
  source 1..25: note = Seed: QTVHSIPLTINKEEALQRPVASDFE
QTVHSIPLTILKFEAFQRPVASDFE

SEQ ID NO: 51160 - protein, 25 aa, synthetic construct
  source 1..25: note = Seed: QTVHSIPLTINKEEALQRPVASDFE
QTVHSIPLTILKFEAHQRPVASDFE

SEQ ID NO: 51161 - protein, 25 aa, synthetic construct
  source 1..25: note = Seed: QTVHSIPLTINKEEALQRPVASDFE
QTVHSIPLTILKFEAIQRPVASDFE

SEQ ID NO: 51162 - protein, 25 aa, synthetic construct
  source 1..25: note = Seed: QTVHSIPLTINKEEALQRPVASDFE
QTVHSIPLTILKFEALQRPVASDFE

SEQ ID NO: 51163 - protein, 25 aa, synthetic construct
  source 1..25: note = Seed: QTVHSIPLTINKEEALQRPVASDFE
QTVHSIPLTILKFEAMQRPVASDFE

SEQ ID NO: 51164 - protein, 25 aa, synthetic construct
  source 1..25: note = Seed: QTVHSIPLTINKEEALQRPVASDFE
QTVHSIPLTILKFEANQRPVASDFE

SEQ ID NO: 51165 - protein, 25 aa, synthetic construct
  source 1..25: note = Seed: QTVHSIPLTINKEEALQRPVASDFE
QTVHSIPLTILKFEAQQRPVASDFE

SEQ ID NO: 51166 - protein, 25 aa, synthetic construct
  source 1..25: note = Seed: QTVHSIPLTINKEEALQRPVASDFE
QTVHSIPLTILKFEARQRPVASDFE

SEQ ID NO: 51167 - protein, 25 aa, synthetic construct
  source 1..25: note = Seed: QTVHSIPLTINKEEALQRPVASDFE
QTVHSIPLTILKFEASQRPVASDFE

SEQ ID NO: 51168 - protein, 25 aa, synthetic construct
  source 1..25: note = Seed: QTVHSIPLTINKEEALQRPVASDFE
QTVHSIPLTILKFEATQRPVASDFE

SEQ ID NO: 51169 - protein, 25 aa, synthetic construct
  source 1..25: note = Seed: QTVHSIPLTINKEEALQRPVASDFE
QTVHSIPLTILKFEAVQRPVASDFE

SEQ ID NO: 51170 - protein, 25 aa, synthetic construct
  source 1..25: note = Seed: QTVHSIPLTINKEEALQRPVASDFE
QTVHSIPLTILKFEAWQRPVASDFE

SEQ ID NO: 51171 - protein, 25 aa, synthetic construct
  source 1..25: note = Seed: QTVHSIPLTINKEEALQRPVASDFE
QTVHSIPLTILKFEAYQRPVASDFE

SEQ ID NO: 51172 - protein, 25 aa, synthetic construct
  source 1..25: note = Seed: QTVHSIPLTINKEEALQRPVASDFE
QTVHSIPLTILKIEAAQRPVASDFE

SEQ ID NO: 51173 - protein, 25 aa, synthetic construct
  source 1..25: note = Seed: QTVHSIPLTINKEEALQRPVASDFE
QTVHSIPLTILKIEAFQRPVASDFE

SEQ ID NO: 51174 - protein, 25 aa, synthetic construct
  source 1..25: note = Seed: QTVHSIPLTINKEEALQRPVASDFE
QTVHSIPLTILKIEAIQRPVASDFE

SEQ ID NO: 51175 - protein, 25 aa, synthetic construct
  source 1..25: note = Seed: QTVHSIPLTINKEEALQRPVASDFE
QTVHSIPLTILKIEALQRPVASDFE

SEQ ID NO: 51176 - protein, 25 aa, synthetic construct
  source 1..25: note = Seed: QTVHSIPLTINKEEALQRPVASDFE
QTVHSIPLTILKIEAMQRPVASDFE

SEQ ID NO: 51177 - protein, 25 aa, synthetic construct
  source 1..25: note = Seed: QTVHSIPLTINKEEALQRPVASDFE
QTVHSIPLTILKIEAVQRPVASDFE

SEQ ID NO: 51178 - protein, 25 aa, synthetic construct
  source 1..25: note = Seed: QTVHSIPLTINKEEALQRPVASDFE
QTVHSIPLTILKIEAYQRPVASDFE

SEQ ID NO: 51179 - protein, 25 aa, synthetic construct
  source 1..25: note = Seed: QTVHSIPLTINKEEALQRPVASDFE
QTVHSIPLTILKLEAAQRPVASDFE

SEQ ID NO: 51180 - protein, 25 aa, synthetic construct
  source 1..25: note = Seed: QTVHSIPLTINKEEALQRPVASDFE
QTVHSIPLTILKLEAFQRPVASDFE

SEQ ID NO: 51181 - protein, 25 aa, synthetic construct
  source 1..25: note = Seed: QTVHSIPLTINKEEALQRPVASDFE
QTVHSIPLTILKLEAIQRPVASDFE

SEQ ID NO: 51182 - protein, 25 aa, synthetic construct
  source 1..25: note = Seed: QTVHSIPLTINKEEALQRPVASDFE
QTVHSIPLTILKLEALQRPVASDFE

SEQ ID NO: 51183 - protein, 25 aa, synthetic construct
  source 1..25: note = Seed: QTVHSIPLTINKEEALQRPVASDFE
QTVHSIPLTILKLEAMQRPVASDFE

SEQ ID NO: 51184 - protein, 25 aa, synthetic construct
  source 1..25: note = Seed: QTVHSIPLTINKEEALQRPVASDFE
QTVHSIPLTILKLEAVQRPVASDFE

SEQ ID NO: 51185 - protein, 25 aa, synthetic construct
  source 1..25: note = Seed: QTVHSIPLTINKEEALQRPVASDFE
QTVHSIPLTILKLEAYQRPVASDFE

SEQ ID NO: 51186 - protein, 25 aa, synthetic construct
  source 1..25: note = Seed: QTVHSIPLTINKEEALQRPVASDFE
QTVHSIPLTILKMEAFQRPVASDFE

SEQ ID NO: 51187 - protein, 25 aa, synthetic construct
  source 1..25: note = Seed: QTVHSIPLTINKEEALQRPVASDFE
QTVHSIPLTILKMEALQRPVASDFE

SEQ ID NO: 51188 - protein, 25 aa, synthetic construct
  source 1..25: note = Seed: QTVHSIPLTINKEEALQRPVASDFE
QTVHSIPLTILKREAFQRPVASDFE

SEQ ID NO: 51189 - protein, 25 aa, synthetic construct
  source 1..25: note = Seed: QTVHSIPLTINKEEALQRPVASDFE
QTVHSIPLTILKREAIQRPVASDFE

SEQ ID NO: 51190 - protein, 25 aa, synthetic construct
  source 1..25: note = Seed: QTVHSIPLTINKEEALQRPVASDFE
QTVHSIPLTILKREALQRPVASDFE

SEQ ID NO: 51191 - protein, 25 aa, synthetic construct
  source 1..25: note = Seed: QTVHSIPLTINKEEALQRPVASDFE
QTVHSIPLTILKREAVQRPVASDFE

SEQ ID NO: 51192 - protein, 25 aa, synthetic construct
  source 1..25: note = Seed: QTVHSIPLTINKEEALQRPVASDFE
QTVHSIPLTILKREAYQRPVASDFE

SEQ ID NO: 51193 - protein, 25 aa, synthetic construct
  source 1..25: note = Seed: QTVHSIPLTINKEEALQRPVASDFE
QTVHSIPLTILKVEAFQRPVASDFE

SEQ ID NO: 51194 - protein, 25 aa, synthetic construct
  source 1..25: note = Seed: QTVHSIPLTINKEEALQRPVASDFE
QTVHSIPLTILKVEAIQRPVASDFE

SEQ ID NO: 51195 - protein, 25 aa, synthetic construct
  source 1..25: note = Seed: QTVHSIPLTINKEEALQRPVASDFE
QTVHSIPLTILKVEALQRPVASDFE

SEQ ID NO: 51196 - protein, 25 aa, synthetic construct
  source 1..25: note = Seed: QTVHSIPLTINKEEALQRPVASDFE
QTVHSIPLTILKVEAVQRPVASDFE

SEQ ID NO: 51197 - protein, 25 aa, synthetic construct
  source 1..25: note = Seed: QTVHSIPLTINKEEALQRPVASDFE
QTVHSIPLTILKWEAFQRPVASDFE

SEQ ID NO: 51198 - protein, 25 aa, synthetic construct
  source 1..25: note = Seed: QTVHSIPLTINKEEALQRPVASDFE
QTVHSIPLTILKWEAIQRPVASDFE

SEQ ID NO: 51199 - protein, 25 aa, synthetic construct
  source 1..25: note = Seed: QTVHSIPLTINKEEALQRPVASDFE
QTVHSIPLTILKWEALQRPVASDFE

SEQ ID NO: 51200 - protein, 25 aa, synthetic construct
  source 1..25: note = Seed: QTVHSIPLTINKEEALQRPVASDFE
QTVHSIPLTILKWEAMQRPVASDFE

SEQ ID NO: 51201 - protein, 25 aa, synthetic construct
  source 1..25: note = Seed: QTVHSIPLTINKEEALQRPVASDFE
QTVHSIPLTILKWEAVQRPVASDFE

SEQ ID NO: 51202 - protein, 25 aa, synthetic construct
  source 1..25: note = Seed: QTVHSIPLTINKEEALQRPVASDFE
QTVHSIPLTILKWEAYQRPVASDFE

SEQ ID NO: 51203 - protein, 25 aa, synthetic construct
  source 1..25: note = Seed: QTVHSIPLTINKEEALQRPVASDFE
QTVHSIPLTILKYEAFQRPVASDFE

SEQ ID NO: 51204 - protein, 25 aa, synthetic construct
  source 1..25: note = Seed: QTVHSIPLTINKEEALQRPVASDFE
QTVHSIPLTILKYEAIQRPVASDFE

SEQ ID NO: 51205 - protein, 25 aa, synthetic construct
  source 1..25: note = Seed: QTVHSIPLTINKEEALQRPVASDFE
QTVHSIPLTILKYEALQRPVASDFE

SEQ ID NO: 51206 - protein, 25 aa, synthetic construct
  source 1..25: note = Seed: QTVHSIPLTINKEEALQRPVASDFE
QTVHSIPLTILKYEAMQRPVASDFE

SEQ ID NO: 51207 - protein, 25 aa, synthetic construct
  source 1..25: note = Seed: QTVHSIPLTINKEEALQRPVASDFE
QTVHSIPLTILKYEAVQRPVASDFE

SEQ ID NO: 51208 - protein, 25 aa, synthetic construct
  source 1..25: note = Seed: QTVHSIPLTINKEEALQRPVASDFE
QTVHSIPLTILKYEAWQRPVASDFE

SEQ ID NO: 51209 - protein, 25 aa, synthetic construct
  source 1..25: note = Seed: QTVHSIPLTINKEEALQRPVASDFE
QTVHSIPLTILKYEAYQRPVASDFE

SEQ ID NO: 51210 - protein, 25 aa, synthetic construct
  source 1..25: note = Seed: QTVHSIPLTINKEEALQRPVASDFE
QTVHSIPLTIMKAEAAQRPVASDFE

SEQ ID NO: 51211 - protein, 25 aa, synthetic construct
  source 1..25: note = Seed: QTVHSIPLTINKEEALQRPVASDFE
QTVHSIPLTIMKAEAIQRPVASDFE

SEQ ID NO: 51212 - protein, 25 aa, synthetic construct
  source 1..25: note = Seed: QTVHSIPLTINKEEALQRPVASDFE
QTVHSIPLTIMKAEALQRPVASDFE

SEQ ID NO: 51213 - protein, 25 aa, synthetic construct
  source 1..25: note = Seed: QTVHSIPLTINKEEALQRPVASDFE
QTVHSIPLTIMKAEAVQRPVASDFE

SEQ ID NO: 51214 - protein, 25 aa, synthetic construct
  source 1..25: note = Seed: QTVHSIPLTINKEEALQRPVASDFE
QTVHSIPLTIMKDEAIQRPVASDFE

SEQ ID NO: 51215 - protein, 25 aa, synthetic construct
  source 1..25: note = Seed: QTVHSIPLTINKEEALQRPVASDFE
QTVHSIPLTIMKDEALQRPVASDFE

SEQ ID NO: 51216 - protein, 25 aa, synthetic construct
  source 1..25: note = Seed: QTVHSIPLTINKEEALQRPVASDFE
QTVHSIPLTIMKDEAVQRPVASDFE

SEQ ID NO: 51217 - protein, 25 aa, synthetic construct
  source 1..25: note = Seed: QTVHSIPLTINKEEALQRPVASDFE
QTVHSIPLTIMKFEAAQRPVASDFE

SEQ ID NO: 51218 - protein, 25 aa, synthetic construct
  source 1..25: note = Seed: QTVHSIPLTINKEEALQRPVASDFE
QTVHSIPLTIMKFEAEQRPVASDFE

SEQ ID NO: 51219 - protein, 25 aa, synthetic construct
  source 1..25: note = Seed: QTVHSIPLTINKEEALQRPVASDFE
QTVHSIPLTIMKFEAFQRPVASDFE

SEQ ID NO: 51220 - protein, 25 aa, synthetic construct
  source 1..25: note = Seed: QTVHSIPLTINKEEALQRPVASDFE
QTVHSIPLTIMKFEAIQRPVASDFE

SEQ ID NO: 51221 - protein, 25 aa, synthetic construct
  source 1..25: note = Seed: QTVHSIPLTINKEEALQRPVASDFE
QTVHSIPLTIMKFEALQRPVASDFE

SEQ ID NO: 51222 - protein, 25 aa, synthetic construct
  source 1..25: note = Seed: QTVHSIPLTINKEEALQRPVASDFE
QTVHSIPLTIMKFEAMQRPVASDFE

SEQ ID NO: 51223 - protein, 25 aa, synthetic construct
  source 1..25: note = Seed: QTVHSIPLTINKEEALQRPVASDFE
QTVHSIPLTIMKFEASQRPVASDFE

SEQ ID NO: 51224 - protein, 25 aa, synthetic construct
  source 1..25: note = Seed: QTVHSIPLTINKEEALQRPVASDFE
QTVHSIPLTIMKFEATQRPVASDFE

SEQ ID NO: 51225 - protein, 25 aa, synthetic construct
  source 1..25: note = Seed: QTVHSIPLTINKEEALQRPVASDFE
QTVHSIPLTIMKFEAVQRPVASDFE

SEQ ID NO: 51226 - protein, 25 aa, synthetic construct
  source 1..25: note = Seed: QTVHSIPLTINKEEALQRPVASDFE
QTVHSIPLTIMKFEAYQRPVASDFE

SEQ ID NO: 51227 - protein, 25 aa, synthetic construct
  source 1..25: note = Seed: QTVHSIPLTINKEEALQRPVASDFE
QTVHSIPLTIMKIEAAQRPVASDFE

SEQ ID NO: 51228 - protein, 25 aa, synthetic construct
  source 1..25: note = Seed: QTVHSIPLTINKEEALQRPVASDFE
QTVHSIPLTIMKIEAFQRPVASDFE

SEQ ID NO: 51229 - protein, 25 aa, synthetic construct
  source 1..25: note = Seed: QTVHSIPLTINKEEALQRPVASDFE
QTVHSIPLTIMKIEAIQRPVASDFE

SEQ ID NO: 51230 - protein, 25 aa, synthetic construct
  source 1..25: note = Seed: QTVHSIPLTINKEEALQRPVASDFE
QTVHSIPLTIMKIEALQRPVASDFE

SEQ ID NO: 51231 - protein, 25 aa, synthetic construct
  source 1..25: note = Seed: QTVHSIPLTINKEEALQRPVASDFE
QTVHSIPLTIMKIEAMQRPVASDFE

SEQ ID NO: 51232 - protein, 25 aa, synthetic construct
  source 1..25: note = Seed: QTVHSIPLTINKEEALQRPVASDFE
QTVHSIPLTIMKIEASQRPVASDFE

SEQ ID NO: 51233 - protein, 25 aa, synthetic construct
  source 1..25: note = Seed: QTVHSIPLTINKEEALQRPVASDFE
QTVHSIPLTIMKIEAVQRPVASDFE

SEQ ID NO: 51234 - protein, 25 aa, synthetic construct
  source 1..25: note = Seed: QTVHSIPLTINKEEALQRPVASDFE
QTVHSIPLTIMKLEAAQRPVASDFE

SEQ ID NO: 51235 - protein, 25 aa, synthetic construct
  source 1..25: note = Seed: QTVHSIPLTINKEEALQRPVASDFE
QTVHSIPLTIMKLEAFQRPVASDFE

SEQ ID NO: 51236 - protein, 25 aa, synthetic construct
  source 1..25: note = Seed: QTVHSIPLTINKEEALQRPVASDFE
QTVHSIPLTIMKLEAIQRPVASDFE

SEQ ID NO: 51237 - protein, 25 aa, synthetic construct
  source 1..25: note = Seed: QTVHSIPLTINKEEALQRPVASDFE
QTVHSIPLTIMKLEALQRPVASDFE

SEQ ID NO: 51238 - protein, 25 aa, synthetic construct
  source 1..25: note = Seed: QTVHSIPLTINKEEALQRPVASDFE
QTVHSIPLTIMKLEAMQRPVASDFE

SEQ ID NO: 51239 - protein, 25 aa, synthetic construct
  source 1..25: note = Seed: QTVHSIPLTINKEEALQRPVASDFE
QTVHSIPLTIMKLEAVQRPVASDFE

SEQ ID NO: 51240 - protein, 25 aa, synthetic construct
  source 1..25: note = Seed: QTVHSIPLTINKEEALQRPVASDFE
QTVHSIPLTIMKMEAAQRPVASDFE

SEQ ID NO: 51241 - protein, 25 aa, synthetic construct
  source 1..25: note = Seed: QTVHSIPLTINKEEALQRPVASDFE
QTVHSIPLTIMKMEAFQRPVASDFE

SEQ ID NO: 51242 - protein, 25 aa, synthetic construct
  source 1..25: note = Seed: QTVHSIPLTINKEEALQRPVASDFE
QTVHSIPLTIMKMEAIQRPVASDFE

SEQ ID NO: 51243 - protein, 25 aa, synthetic construct
  source 1..25: note = Seed: QTVHSIPLTINKEEALQRPVASDFE
QTVHSIPLTIMKMEAVQRPVASDFE

SEQ ID NO: 51244 - protein, 25 aa, synthetic construct
  source 1..25: note = Seed: QTVHSIPLTINKEEALQRPVASDFE
QTVHSIPLTIMKREAFQRPVASDFE

SEQ ID NO: 51245 - protein, 25 aa, synthetic construct
  source 1..25: note = Seed: QTVHSIPLTINKEEALQRPVASDFE
QTVHSIPLTIMKREAIQRPVASDFE

SEQ ID NO: 51246 - protein, 25 aa, synthetic construct
  source 1..25: note = Seed: QTVHSIPLTINKEEALQRPVASDFE
QTVHSIPLTIMKREALQRPVASDFE

SEQ ID NO: 51247 - protein, 25 aa, synthetic construct
  source 1..25: note = Seed: QTVHSIPLTINKEEALQRPVASDFE
QTVHSIPLTIMKREAVQRPVASDFE

SEQ ID NO: 51248 - protein, 25 aa, synthetic construct
  source 1..25: note = Seed: QTVHSIPLTINKEEALQRPVASDFE
QTVHSIPLTIMKREAYQRPVASDFE

SEQ ID NO: 51249 - protein, 25 aa, synthetic construct
  source 1..25: note = Seed: QTVHSIPLTINKEEALQRPVASDFE
QTVHSIPLTIMKVEAAQRPVASDFE

SEQ ID NO: 51250 - protein, 25 aa, synthetic construct
  source 1..25: note = Seed: QTVHSIPLTINKEEALQRPVASDFE
QTVHSIPLTIMKVEAIQRPVASDFE

SEQ ID NO: 51251 - protein, 25 aa, synthetic construct
  source 1..25: note = Seed: QTVHSIPLTINKEEALQRPVASDFE
QTVHSIPLTIMKVEALQRPVASDFE

SEQ ID NO: 51252 - protein, 25 aa, synthetic construct
  source 1..25: note = Seed: QTVHSIPLTINKEEALQRPVASDFE
QTVHSIPLTIMKVEAMQRPVASDFE

SEQ ID NO: 51253 - protein, 25 aa, synthetic construct
  source 1..25: note = Seed: QTVHSIPLTINKEEALQRPVASDFE
QTVHSIPLTIMKVEAVQRPVASDFE

SEQ ID NO: 51254 - protein, 25 aa, synthetic construct
  source 1..25: note = Seed: QTVHSIPLTINKEEALQRPVASDFE
QTVHSIPLTIMKWEAFQRPVASDFE

SEQ ID NO: 51255 - protein, 25 aa, synthetic construct
  source 1..25: note = Seed: QTVHSIPLTINKEEALQRPVASDFE
QTVHSIPLTIMKWEALQRPVASDFE

SEQ ID NO: 51256 - protein, 25 aa, synthetic construct
  source 1..25: note = Seed: QTVHSIPLTINKEEALQRPVASDFE
QTVHSIPLTIMKYEAFQRPVASDFE

SEQ ID NO: 51257 - protein, 25 aa, synthetic construct
  source 1..25: note = Seed: QTVHSIPLTINKEEALQRPVASDFE
QTVHSIPLTIMKYEAIQRPVASDFE

SEQ ID NO: 51258 - protein, 25 aa, synthetic construct
  source 1..25: note = Seed: QTVHSIPLTINKEEALQRPVASDFE
QTVHSIPLTIMKYEALQRPVASDFE

SEQ ID NO: 51259 - protein, 25 aa, synthetic construct
  source 1..25: note = Seed: QTVHSIPLTINKEEALQRPVASDFE
QTVHSIPLTINKAEAAQRPVASDFE

SEQ ID NO: 51260 - protein, 25 aa, synthetic construct
  source 1..25: note = Seed: QTVHSIPLTINKEEALQRPVASDFE
QTVHSIPLTINKAEAFQRPVASDFE

SEQ ID NO: 51261 - protein, 25 aa, synthetic construct
  source 1..25: note = Seed: QTVHSIPLTINKEEALQRPVASDFE
QTVHSIPLTINKAEAIQRPVASDFE

SEQ ID NO: 51262 - protein, 25 aa, synthetic construct
  source 1..25: note = Seed: QTVHSIPLTINKEEALQRPVASDFE
QTVHSIPLTINKAEAMQRPVASDFE

SEQ ID NO: 51263 - protein, 25 aa, synthetic construct
  source 1..25: note = Seed: QTVHSIPLTINKEEALQRPVASDFE
QTVHSIPLTINKAEAVQRPVASDFE

SEQ ID NO: 51264 - protein, 25 aa, synthetic construct
  source 1..25: note = Seed: QTVHSIPLTINKEEALQRPVASDFE
QTVHSIPLTINKAEAYQRPVASDFE

SEQ ID NO: 51265 - protein, 25 aa, synthetic construct
  source 1..25: note = Seed: QTVHSIPLTINKEEALQRPVASDFE
QTVHSIPLTINKFEAFQRPVASDFE

SEQ ID NO: 51266 - protein, 25 aa, synthetic construct
  source 1..25: note = Seed: QTVHSIPLTINKEEALQRPVASDFE
QTVHSIPLTINKFEAIQRPVASDFE

SEQ ID NO: 51267 - protein, 25 aa, synthetic construct
  source 1..25: note = Seed: QTVHSIPLTINKEEALQRPVASDFE
QTVHSIPLTINKFEAMQRPVASDFE

SEQ ID NO: 51268 - protein, 25 aa, synthetic construct
  source 1..25: note = Seed: QTVHSIPLTINKEEALQRPVASDFE
QTVHSIPLTINKFEAVQRPVASDFE

SEQ ID NO: 51269 - protein, 25 aa, synthetic construct
  source 1..25: note = Seed: QTVHSIPLTINKEEALQRPVASDFE
QTVHSIPLTINKGEAFQRPVASDFE

SEQ ID NO: 51270 - protein, 25 aa, synthetic construct
  source 1..25: note = Seed: QTVHSIPLTINKEEALQRPVASDFE
QTVHSIPLTINKGEAIQRPVASDFE

SEQ ID NO: 51271 - protein, 25 aa, synthetic construct
  source 1..25: note = Seed: QTVHSIPLTINKEEALQRPVASDFE
QTVHSIPLTINKGEAMQRPVASDFE

SEQ ID NO: 51272 - protein, 25 aa, synthetic construct
  source 1..25: note = Seed: QTVHSIPLTINKEEALQRPVASDFE
QTVHSIPLTINKGEAVQRPVASDFE

SEQ ID NO: 51273 - protein, 25 aa, synthetic construct
  source 1..25: note = Seed: QTVHSIPLTINKEEALQRPVASDFE
QTVHSIPLTINKGEAYQRPVASDFE

SEQ ID NO: 51274 - protein, 25 aa, synthetic construct
  source 1..25: note = Seed: QTVHSIPLTINKEEALQRPVASDFE
QTVHSIPLTINKHEAIQRPVASDFE

SEQ ID NO: 51275 - protein, 25 aa, synthetic construct
  source 1..25: note = Seed: QTVHSIPLTINKEEALQRPVASDFE
QTVHSIPLTINKIEAFQRPVASDFE

SEQ ID NO: 51276 - protein, 25 aa, synthetic construct
  source 1..25: note = Seed: QTVHSIPLTINKEEALQRPVASDFE
QTVHSIPLTINKIEAIQRPVASDFE

SEQ ID NO: 51277 - protein, 25 aa, synthetic construct
  source 1..25: note = Seed: QTVHSIPLTINKEEALQRPVASDFE
QTVHSIPLTINKIEAMQRPVASDFE

SEQ ID NO: 51278 - protein, 25 aa, synthetic construct
  source 1..25: note = Seed: QTVHSIPLTINKEEALQRPVASDFE
QTVHSIPLTINKIEAVQRPVASDFE

SEQ ID NO: 51279 - protein, 25 aa, synthetic construct
  source 1..25: note = Seed: QTVHSIPLTINKEEALQRPVASDFE
QTVHSIPLTINKIEAYQRPVASDFE

SEQ ID NO: 51280 - protein, 25 aa, synthetic construct
  source 1..25: note = Seed: QTVHSIPLTINKEEALQRPVASDFE
QTVHSIPLTINKLEAIQRPVASDFE

SEQ ID NO: 51281 - protein, 25 aa, synthetic construct
  source 1..25: note = Seed: QTVHSIPLTINKEEALQRPVASDFE
QTVHSIPLTINKLEAVQRPVASDFE

SEQ ID NO: 51282 - protein, 25 aa, synthetic construct
  source 1..25: note = Seed: QTVHSIPLTINKEEALQRPVASDFE
QTVHSIPLTINKMEAIQRPVASDFE

SEQ ID NO: 51283 - protein, 25 aa, synthetic construct
  source 1..25: note = Seed: QTVHSIPLTINKEEALQRPVASDFE
QTVHSIPLTINKMEAVQRPVASDFE

SEQ ID NO: 51284 - protein, 25 aa, synthetic construct
  source 1..25: note = Seed: QTVHSIPLTINKEEALQRPVASDFE
QTVHSIPLTINKNEAAQRPVASDFE

SEQ ID NO: 51285 - protein, 25 aa, synthetic construct
  source 1..25: note = Seed: QTVHSIPLTINKEEALQRPVASDFE
QTVHSIPLTINKNEAFQRPVASDFE

SEQ ID NO: 51286 - protein, 25 aa, synthetic construct
  source 1..25: note = Seed: QTVHSIPLTINKEEALQRPVASDFE
QTVHSIPLTINKNEAIQRPVASDFE

SEQ ID NO: 51287 - protein, 25 aa, synthetic construct
  source 1..25: note = Seed: QTVHSIPLTINKEEALQRPVASDFE
QTVHSIPLTINKNEAMQRPVASDFE

SEQ ID NO: 51288 - protein, 25 aa, synthetic construct
  source 1..25: note = Seed: QTVHSIPLTINKEEALQRPVASDFE
QTVHSIPLTINKNEAVQRPVASDFE

SEQ ID NO: 51289 - protein, 25 aa, synthetic construct
  source 1..25: note = Seed: QTVHSIPLTINKEEALQRPVASDFE
QTVHSIPLTINKNEAWQRPVASDFE

SEQ ID NO: 51290 - protein, 25 aa, synthetic construct
  source 1..25: note = Seed: QTVHSIPLTINKEEALQRPVASDFE
QTVHSIPLTINKNEAYQRPVASDFE

SEQ ID NO: 51291 - protein, 25 aa, synthetic construct
  source 1..25: note = Seed: QTVHSIPLTINKEEALQRPVASDFE
QTVHSIPLTINKPEAFQRPVASDFE

SEQ ID NO: 51292 - protein, 25 aa, synthetic construct
  source 1..25: note = Seed: QTVHSIPLTINKEEALQRPVASDFE
QTVHSIPLTINKPEAIQRPVASDFE

SEQ ID NO: 51293 - protein, 25 aa, synthetic construct
  source 1..25: note = Seed: QTVHSIPLTINKEEALQRPVASDFE
QTVHSIPLTINKPEAMQRPVASDFE

SEQ ID NO: 51294 - protein, 25 aa, synthetic construct
  source 1..25: note = Seed: QTVHSIPLTINKEEALQRPVASDFE
QTVHSIPLTINKPEAVQRPVASDFE

SEQ ID NO: 51295 - protein, 25 aa, synthetic construct
  source 1..25: note = Seed: QTVHSIPLTINKEEALQRPVASDFE
QTVHSIPLTINKPEAYQRPVASDFE

SEQ ID NO: 51296 - protein, 25 aa, synthetic construct
  source 1..25: note = Seed: QTVHSIPLTINKEEALQRPVASDFE
QTVHSIPLTINKSEAAQRPVASDFE

SEQ ID NO: 51297 - protein, 25 aa, synthetic construct
  source 1..25: note = Seed: QTVHSIPLTINKEEALQRPVASDFE
QTVHSIPLTINKSEAFQRPVASDFE

SEQ ID NO: 51298 - protein, 25 aa, synthetic construct
  source 1..25: note = Seed: QTVHSIPLTINKEEALQRPVASDFE
QTVHSIPLTINKSEAIQRPVASDFE

SEQ ID NO: 51299 - protein, 25 aa, synthetic construct
  source 1..25: note = Seed: QTVHSIPLTINKEEALQRPVASDFE
QTVHSIPLTINKSEAMQRPVASDFE

SEQ ID NO: 51300 - protein, 25 aa, synthetic construct
  source 1..25: note = Seed: QTVHSIPLTINKEEALQRPVASDFE
QTVHSIPLTINKSEAVQRPVASDFE

SEQ ID NO: 51301 - protein, 25 aa, synthetic construct
  source 1..25: note = Seed: QTVHSIPLTINKEEALQRPVASDFE
QTVHSIPLTINKSEAYQRPVASDFE

SEQ ID NO: 51302 - protein, 25 aa, synthetic construct
  source 1..25: note = Seed: QTVHSIPLTINKEEALQRPVASDFE
QTVHSIPLTINKTEAFQRPVASDFE

SEQ ID NO: 51303 - protein, 25 aa, synthetic construct
  source 1..25: note = Seed: QTVHSIPLTINKEEALQRPVASDFE
QTVHSIPLTINKTEAIQRPVASDFE

SEQ ID NO: 51304 - protein, 25 aa, synthetic construct
  source 1..25: note = Seed: QTVHSIPLTINKEEALQRPVASDFE
QTVHSIPLTINKTEAMQRPVASDFE

SEQ ID NO: 51305 - protein, 25 aa, synthetic construct
  source 1..25: note = Seed: QTVHSIPLTINKEEALQRPVASDFE
QTVHSIPLTINKTEAVQRPVASDFE

SEQ ID NO: 51306 - protein, 25 aa, synthetic construct
  source 1..25: note = Seed: QTVHSIPLTINKEEALQRPVASDFE
QTVHSIPLTINKTEAYQRPVASDFE

SEQ ID NO: 51307 - protein, 25 aa, synthetic construct
  source 1..25: note = Seed: QTVHSIPLTINKEEALQRPVASDFE
QTVHSIPLTINKVEAFQRPVASDFE

SEQ ID NO: 51308 - protein, 25 aa, synthetic construct
  source 1..25: note = Seed: QTVHSIPLTINKEEALQRPVASDFE
QTVHSIPLTINKVEAIQRPVASDFE

SEQ ID NO: 51309 - protein, 25 aa, synthetic construct
  source 1..25: note = Seed: QTVHSIPLTINKEEALQRPVASDFE
QTVHSIPLTINKVEAMQRPVASDFE

SEQ ID NO: 51310 - protein, 25 aa, synthetic construct
  source 1..25: note = Seed: QTVHSIPLTINKEEALQRPVASDFE
QTVHSIPLTINKVEAVQRPVASDFE

SEQ ID NO: 51311 - protein, 25 aa, synthetic construct
  source 1..25: note = Seed: QTVHSIPLTINKEEALQRPVASDFE
QTVHSIPLTINKVEAYQRPVASDFE

SEQ ID NO: 51312 - protein, 25 aa, synthetic construct
  source 1..25: note = Seed: QTVHSIPLTINKEEALQRPVASDFE
QTVHSIPLTIQKFEAFQRPVASDFE

SEQ ID NO: 51313 - protein, 25 aa, synthetic construct
  source 1..25: note = Seed: QTVHSIPLTINKEEALQRPVASDFE
QTVHSIPLTIQKFEAIQRPVASDFE

SEQ ID NO: 51314 - protein, 25 aa, synthetic construct
  source 1..25: note = Seed: QTVHSIPLTINKEEALQRPVASDFE
QTVHSIPLTIQKFEALQRPVASDFE

SEQ ID NO: 51315 - protein, 25 aa, synthetic construct
  source 1..25: note = Seed: QTVHSIPLTINKEEALQRPVASDFE
QTVHSIPLTIQKFEAMQRPVASDFE

SEQ ID NO: 51316 - protein, 25 aa, synthetic construct
  source 1..25: note = Seed: QTVHSIPLTINKEEALQRPVASDFE
QTVHSIPLTIQKFEAVQRPVASDFE

SEQ ID NO: 51317 - protein, 25 aa, synthetic construct
  source 1..25: note = Seed: QTVHSIPLTINKEEALQRPVASDFE
QTVHSIPLTIQKFEAYQRPVASDFE

SEQ ID NO: 51318 - protein, 25 aa, synthetic construct
  source 1..25: note = Seed: QTVHSIPLTINKEEALQRPVASDFE
QTVHSIPLTISKAEAIQRPVASDFE

SEQ ID NO: 51319 - protein, 25 aa, synthetic construct
  source 1..25: note = Seed: QTVHSIPLTINKEEALQRPVASDFE
QTVHSIPLTISKFEAAQRPVASDFE

SEQ ID NO: 51320 - protein, 25 aa, synthetic construct
  source 1..25: note = Seed: QTVHSIPLTINKEEALQRPVASDFE
QTVHSIPLTISKFEAFQRPVASDFE

SEQ ID NO: 51321 - protein, 25 aa, synthetic construct
  source 1..25: note = Seed: QTVHSIPLTINKEEALQRPVASDFE
QTVHSIPLTISKFEAIQRPVASDFE

SEQ ID NO: 51322 - protein, 25 aa, synthetic construct
  source 1..25: note = Seed: QTVHSIPLTINKEEALQRPVASDFE
QTVHSIPLTISKFEALQRPVASDFE

SEQ ID NO: 51323 - protein, 25 aa, synthetic construct
  source 1..25: note = Seed: QTVHSIPLTINKEEALQRPVASDFE
QTVHSIPLTISKFEAMQRPVASDFE

SEQ ID NO: 51324 - protein, 25 aa, synthetic construct
  source 1..25: note = Seed: QTVHSIPLTINKEEALQRPVASDFE
QTVHSIPLTISKFEATQRPVASDFE

SEQ ID NO: 51325 - protein, 25 aa, synthetic construct
  source 1..25: note = Seed: QTVHSIPLTINKEEALQRPVASDFE
QTVHSIPLTISKFEAVQRPVASDFE

SEQ ID NO: 51326 - protein, 25 aa, synthetic construct
  source 1..25: note = Seed: QTVHSIPLTINKEEALQRPVASDFE
QTVHSIPLTISKFEAYQRPVASDFE

SEQ ID NO: 51327 - protein, 25 aa, synthetic construct
  source 1..25: note = Seed: QTVHSIPLTINKEEALQRPVASDFE
QTVHSIPLTISKLEALQRPVASDFE

SEQ ID NO: 51328 - protein, 25 aa, synthetic construct
  source 1..25: note = Seed: QTVHSIPLTINKEEALQRPVASDFE
QTVHSIPLTISKNEAIQRPVASDFE

SEQ ID NO: 51329 - protein, 25 aa, synthetic construct
  source 1..25: note = Seed: QTVHSIPLTINKEEALQRPVASDFE
QTVHSIPLTISKNEAVQRPVASDFE

SEQ ID NO: 51330 - protein, 25 aa, synthetic construct
  source 1..25: note = Seed: QTVHSIPLTINKEEALQRPVASDFE
QTVHSIPLTISKYEALQRPVASDFE

SEQ ID NO: 51331 - protein, 25 aa, synthetic construct
  source 1..25: note = Seed: QTVHSIPLTINKEEALQRPVASDFE
QTVHSIPLTITKFEAAQRPVASDFE

SEQ ID NO: 51332 - protein, 25 aa, synthetic construct
  source 1..25: note = Seed: QTVHSIPLTINKEEALQRPVASDFE
QTVHSIPLTITKFEAFQRPVASDFE

SEQ ID NO: 51333 - protein, 25 aa, synthetic construct
  source 1..25: note = Seed: QTVHSIPLTINKEEALQRPVASDFE
QTVHSIPLTITKFEAIQRPVASDFE

SEQ ID NO: 51334 - protein, 25 aa, synthetic construct
  source 1..25: note = Seed: QTVHSIPLTINKEEALQRPVASDFE
QTVHSIPLTITKFEALQRPVASDFE

SEQ ID NO: 51335 - protein, 25 aa, synthetic construct
  source 1..25: note = Seed: QTVHSIPLTINKEEALQRPVASDFE
QTVHSIPLTITKFEAMQRPVASDFE

SEQ ID NO: 51336 - protein, 25 aa, synthetic construct
  source 1..25: note = Seed: QTVHSIPLTINKEEALQRPVASDFE
QTVHSIPLTITKFEASQRPVASDFE

SEQ ID NO: 51337 - protein, 25 aa, synthetic construct
  source 1..25: note = Seed: QTVHSIPLTINKEEALQRPVASDFE
QTVHSIPLTITKFEATQRPVASDFE

SEQ ID NO: 51338 - protein, 25 aa, synthetic construct
  source 1..25: note = Seed: QTVHSIPLTINKEEALQRPVASDFE
QTVHSIPLTITKFEAVQRPVASDFE

SEQ ID NO: 51339 - protein, 25 aa, synthetic construct
  source 1..25: note = Seed: QTVHSIPLTINKEEALQRPVASDFE
QTVHSIPLTITKFEAYQRPVASDFE

SEQ ID NO: 51340 - protein, 25 aa, synthetic construct
  source 1..25: note = Seed: QTVHSIPLTINKEEALQRPVASDFE
QTVHSIPLTITKLEAFQRPVASDFE

SEQ ID NO: 51341 - protein, 25 aa, synthetic construct
  source 1..25: note = Seed: QTVHSIPLTINKEEALQRPVASDFE
QTVHSIPLTITKLEALQRPVASDFE

SEQ ID NO: 51342 - protein, 25 aa, synthetic construct
  source 1..25: note = Seed: QTVHSIPLTINKEEALQRPVASDFE
QTVHSIPLTITKWEALQRPVASDFE

SEQ ID NO: 51343 - protein, 25 aa, synthetic construct
  source 1..25: note = Seed: QTVHSIPLTINKEEALQRPVASDFE
QTVHSIPLTITKYEAIQRPVASDFE

SEQ ID NO: 51344 - protein, 25 aa, synthetic construct
  source 1..25: note = Seed: QTVHSIPLTINKEEALQRPVASDFE
QTVHSIPLTITKYEALQRPVASDFE

SEQ ID NO: 51345 - protein, 25 aa, synthetic construct
  source 1..25: note = Seed: QTVHSIPLTINKEEALQRPVASDFE
QTVHSIPLTIVKFEAAQRPVASDFE

SEQ ID NO: 51346 - protein, 25 aa, synthetic construct
  source 1..25: note = Seed: QTVHSIPLTINKEEALQRPVASDFE
QTVHSIPLTIVKFEADQRPVASDFE

SEQ ID NO: 51347 - protein, 25 aa, synthetic construct
  source 1..25: note = Seed: QTVHSIPLTINKEEALQRPVASDFE
QTVHSIPLTIVKFEAEQRPVASDFE

SEQ ID NO: 51348 - protein, 25 aa, synthetic construct
  source 1..25: note = Seed: QTVHSIPLTINKEEALQRPVASDFE
QTVHSIPLTIVKFEAFQRPVASDFE

SEQ ID NO: 51349 - protein, 25 aa, synthetic construct
  source 1..25: note = Seed: QTVHSIPLTINKEEALQRPVASDFE
QTVHSIPLTIVKFEAIQRPVASDFE

SEQ ID NO: 51350 - protein, 25 aa, synthetic construct
  source 1..25: note = Seed: QTVHSIPLTINKEEALQRPVASDFE
QTVHSIPLTIVKFEALQRPVASDFE

SEQ ID NO: 51351 - protein, 25 aa, synthetic construct
  source 1..25: note = Seed: QTVHSIPLTINKEEALQRPVASDFE
QTVHSIPLTIVKFEAMQRPVASDFE

SEQ ID NO: 51352 - protein, 25 aa, synthetic construct
  source 1..25: note = Seed: QTVHSIPLTINKEEALQRPVASDFE
QTVHSIPLTIVKFEANQRPVASDFE

SEQ ID NO: 51353 - protein, 25 aa, synthetic construct
  source 1..25: note = Seed: QTVHSIPLTINKEEALQRPVASDFE
QTVHSIPLTIVKFEASQRPVASDFE

SEQ ID NO: 51354 - protein, 25 aa, synthetic construct
  source 1..25: note = Seed: QTVHSIPLTINKEEALQRPVASDFE
QTVHSIPLTIVKFEATQRPVASDFE

SEQ ID NO: 51355 - protein, 25 aa, synthetic construct
  source 1..25: note = Seed: QTVHSIPLTINKEEALQRPVASDFE
QTVHSIPLTIVKFEAVQRPVASDFE

SEQ ID NO: 51356 - protein, 25 aa, synthetic construct
  source 1..25: note = Seed: QTVHSIPLTINKEEALQRPVASDFE
QTVHSIPLTIVKFEAWQRPVASDFE

SEQ ID NO: 51357 - protein, 25 aa, synthetic construct
  source 1..25: note = Seed: QTVHSIPLTINKEEALQRPVASDFE
QTVHSIPLTIVKFEAYQRPVASDFE

SEQ ID NO: 51358 - protein, 25 aa, synthetic construct
  source 1..25: note = Seed: QTVHSIPLTINKEEALQRPVASDFE
QTVHSIPLTIVKIEAFQRPVASDFE

SEQ ID NO: 51359 - protein, 25 aa, synthetic construct
  source 1..25: note = Seed: QTVHSIPLTINKEEALQRPVASDFE
QTVHSIPLTIVKIEALQRPVASDFE

SEQ ID NO: 51360 - protein, 25 aa, synthetic construct
  source 1..25: note = Seed: QTVHSIPLTINKEEALQRPVASDFE
QTVHSIPLTIVKLEAFQRPVASDFE

SEQ ID NO: 51361 - protein, 25 aa, synthetic construct
  source 1..25: note = Seed: QTVHSIPLTINKEEALQRPVASDFE
QTVHSIPLTIVKLEAIQRPVASDFE

SEQ ID NO: 51362 - protein, 25 aa, synthetic construct
  source 1..25: note = Seed: QTVHSIPLTINKEEALQRPVASDFE
QTVHSIPLTIVKLEALQRPVASDFE

SEQ ID NO: 51363 - protein, 25 aa, synthetic construct
  source 1..25: note = Seed: QTVHSIPLTINKEEALQRPVASDFE
QTVHSIPLTIVKLEAVQRPVASDFE

SEQ ID NO: 51364 - protein, 25 aa, synthetic construct
  source 1..25: note = Seed: QTVHSIPLTINKEEALQRPVASDFE
QTVHSIPLTIVKMEAFQRPVASDFE

SEQ ID NO: 51365 - protein, 25 aa, synthetic construct
  source 1..25: note = Seed: QTVHSIPLTINKEEALQRPVASDFE
QTVHSIPLTIVKREAYQRPVASDFE

SEQ ID NO: 51366 - protein, 25 aa, synthetic construct
  source 1..25: note = Seed: QTVHSIPLTINKEEALQRPVASDFE
QTVHSIPLTIVKWEAFQRPVASDFE

SEQ ID NO: 51367 - protein, 25 aa, synthetic construct
  source 1..25: note = Seed: QTVHSIPLTINKEEALQRPVASDFE
QTVHSIPLTIVKWEAIQRPVASDFE

SEQ ID NO: 51368 - protein, 25 aa, synthetic construct
  source 1..25: note = Seed: QTVHSIPLTINKEEALQRPVASDFE
QTVHSIPLTIVKWEALQRPVASDFE

SEQ ID NO: 51369 - protein, 25 aa, synthetic construct
  source 1..25: note = Seed: QTVHSIPLTINKEEALQRPVASDFE
QTVHSIPLTIVKYEAFQRPVASDFE

SEQ ID NO: 51370 - protein, 25 aa, synthetic construct
  source 1..25: note = Seed: QTVHSIPLTINKEEALQRPVASDFE
QTVHSIPLTIVKYEAIQRPVASDFE

SEQ ID NO: 51371 - protein, 25 aa, synthetic construct
  source 1..25: note = Seed: QTVHSIPLTINKEEALQRPVASDFE
QTVHSIPLTIVKYEALQRPVASDFE

SEQ ID NO: 51372 - protein, 25 aa, synthetic construct
  source 1..25: note = Seed: QTVHSIPLTINKEEALQRPVASDFE
QTVHSIPLTIVKYEAMQRPVASDFE

SEQ ID NO: 51373 - protein, 25 aa, synthetic construct
  source 1..25: note = Seed: QTVHSIPLTINKEEALQRPVASDFE
QTVHSIPLTIVKYEAVQRPVASDFE

SEQ ID NO: 51374 - protein, 25 aa, synthetic construct
  source 1..25: note = Seed: QTVHSIPLTINKEEALQRPVASDFE
QTVHSIPLTIWKAEAIQRPVASDFE

SEQ ID NO: 51375 - protein, 25 aa, synthetic construct
  source 1..25: note = Seed: QTVHSIPLTINKEEALQRPVASDFE
QTVHSIPLTIWKAEALQRPVASDFE

SEQ ID NO: 51376 - protein, 25 aa, synthetic construct
  source 1..25: note = Seed: QTVHSIPLTINKEEALQRPVASDFE
QTVHSIPLTIWKAEAVQRPVASDFE

SEQ ID NO: 51377 - protein, 25 aa, synthetic construct
  source 1..25: note = Seed: QTVHSIPLTINKEEALQRPVASDFE
QTVHSIPLTIWKDEAIQRPVASDFE

SEQ ID NO: 51378 - protein, 25 aa, synthetic construct
  source 1..25: note = Seed: QTVHSIPLTINKEEALQRPVASDFE
QTVHSIPLTIWKDEALQRPVASDFE

SEQ ID NO: 51379 - protein, 25 aa, synthetic construct
  source 1..25: note = Seed: QTVHSIPLTINKEEALQRPVASDFE
QTVHSIPLTIWKDEAVQRPVASDFE

SEQ ID NO: 51380 - protein, 25 aa, synthetic construct
  source 1..25: note = Seed: QTVHSIPLTINKEEALQRPVASDFE
QTVHSIPLTIWKFEAFQRPVASDFE

SEQ ID NO: 51381 - protein, 25 aa, synthetic construct
  source 1..25: note = Seed: QTVHSIPLTINKEEALQRPVASDFE
QTVHSIPLTIWKFEAIQRPVASDFE

SEQ ID NO: 51382 - protein, 25 aa, synthetic construct
  source 1..25: note = Seed: QTVHSIPLTINKEEALQRPVASDFE
QTVHSIPLTIWKFEALQRPVASDFE

SEQ ID NO: 51383 - protein, 25 aa, synthetic construct
  source 1..25: note = Seed: QTVHSIPLTINKEEALQRPVASDFE
QTVHSIPLTIWKFEAMQRPVASDFE

SEQ ID NO: 51384 - protein, 25 aa, synthetic construct
  source 1..25: note = Seed: QTVHSIPLTINKEEALQRPVASDFE
QTVHSIPLTIWKFEAVQRPVASDFE

SEQ ID NO: 51385 - protein, 25 aa, synthetic construct
  source 1..25: note = Seed: QTVHSIPLTINKEEALQRPVASDFE
QTVHSIPLTIWKFEAYQRPVASDFE

SEQ ID NO: 51386 - protein, 25 aa, synthetic construct
  source 1..25: note = Seed: QTVHSIPLTINKEEALQRPVASDFE
QTVHSIPLTIWKIEAAQRPVASDFE

SEQ ID NO: 51387 - protein, 25 aa, synthetic construct
  source 1..25: note = Seed: QTVHSIPLTINKEEALQRPVASDFE
QTVHSIPLTIWKIEAFQRPVASDFE

SEQ ID NO: 51388 - protein, 25 aa, synthetic construct
  source 1..25: note = Seed: QTVHSIPLTINKEEALQRPVASDFE
QTVHSIPLTIWKIEAIQRPVASDFE

SEQ ID NO: 51389 - protein, 25 aa, synthetic construct
  source 1..25: note = Seed: QTVHSIPLTINKEEALQRPVASDFE
QTVHSIPLTIWKIEALQRPVASDFE

SEQ ID NO: 51390 - protein, 25 aa, synthetic construct
  source 1..25: note = Seed: QTVHSIPLTINKEEALQRPVASDFE
QTVHSIPLTIWKIEAMQRPVASDFE

SEQ ID NO: 51391 - protein, 25 aa, synthetic construct
  source 1..25: note = Seed: QTVHSIPLTINKEEALQRPVASDFE
QTVHSIPLTIWKIEAVQRPVASDFE

SEQ ID NO: 51392 - protein, 25 aa, synthetic construct
  source 1..25: note = Seed: QTVHSIPLTINKEEALQRPVASDFE
QTVHSIPLTIWKLEAFQRPVASDFE

SEQ ID NO: 51393 - protein, 25 aa, synthetic construct
  source 1..25: note = Seed: QTVHSIPLTINKEEALQRPVASDFE
QTVHSIPLTIWKLEALQRPVASDFE

SEQ ID NO: 51394 - protein, 25 aa, synthetic construct
  source 1..25: note = Seed: QTVHSIPLTINKEEALQRPVASDFE
QTVHSIPLTIWKREAFQRPVASDFE

SEQ ID NO: 51395 - protein, 25 aa, synthetic construct
  source 1..25: note = Seed: QTVHSIPLTINKEEALQRPVASDFE
QTVHSIPLTIWKREALQRPVASDFE

SEQ ID NO: 51396 - protein, 25 aa, synthetic construct
  source 1..25: note = Seed: QTVHSIPLTINKEEALQRPVASDFE
QTVHSIPLTIWKVEAAQRPVASDFE

SEQ ID NO: 51397 - protein, 25 aa, synthetic construct
  source 1..25: note = Seed: QTVHSIPLTINKEEALQRPVASDFE
QTVHSIPLTIWKVEAIQRPVASDFE

SEQ ID NO: 51398 - protein, 25 aa, synthetic construct
  source 1..25: note = Seed: QTVHSIPLTINKEEALQRPVASDFE
QTVHSIPLTIWKVEALQRPVASDFE

SEQ ID NO: 51399 - protein, 25 aa, synthetic construct
  source 1..25: note = Seed: QTVHSIPLTINKEEALQRPVASDFE
QTVHSIPLTIWKVEAVQRPVASDFE

SEQ ID NO: 51400 - protein, 25 aa, synthetic construct
  source 1..25: note = Seed: QTVHSIPLTINKEEALQRPVASDFE
QTVHSIPLTIWKWEAFQRPVASDFE

SEQ ID NO: 51401 - protein, 25 aa, synthetic construct
  source 1..25: note = Seed: QTVHSIPLTINKEEALQRPVASDFE
QTVHSIPLTIWKYEAFQRPVASDFE

SEQ ID NO: 51402 - protein, 25 aa, synthetic construct
  source 1..25: note = Seed: QTVHSIPLTINKEEALQRPVASDFE
QTVHSIPLTIWKYEALQRPVASDFE

SEQ ID NO: 51403 - protein, 25 aa, synthetic construct
  source 1..25: note = Seed: QTVHSIPLTINKEEALQRPVASDFE
QTVHSIPLTIYKAEAAQRPVASDFE

SEQ ID NO: 51404 - protein, 25 aa, synthetic construct
  source 1..25: note = Seed: QTVHSIPLTINKEEALQRPVASDFE
QTVHSIPLTIYKAEAIQRPVASDFE

SEQ ID NO: 51405 - protein, 25 aa, synthetic construct
  source 1..25: note = Seed: QTVHSIPLTINKEEALQRPVASDFE
QTVHSIPLTIYKAEALQRPVASDFE

SEQ ID NO: 51406 - protein, 25 aa, synthetic construct
  source 1..25: note = Seed: QTVHSIPLTINKEEALQRPVASDFE
QTVHSIPLTIYKAEAMQRPVASDFE

SEQ ID NO: 51407 - protein, 25 aa, synthetic construct
  source 1..25: note = Seed: QTVHSIPLTINKEEALQRPVASDFE
QTVHSIPLTIYKAEAVQRPVASDFE

SEQ ID NO: 51408 - protein, 25 aa, synthetic construct
  source 1..25: note = Seed: QTVHSIPLTINKEEALQRPVASDFE
QTVHSIPLTIYKDEAAQRPVASDFE

SEQ ID NO: 51409 - protein, 25 aa, synthetic construct
  source 1..25: note = Seed: QTVHSIPLTINKEEALQRPVASDFE
QTVHSIPLTIYKDEAFQRPVASDFE

SEQ ID NO: 51410 - protein, 25 aa, synthetic construct
  source 1..25: note = Seed: QTVHSIPLTINKEEALQRPVASDFE
QTVHSIPLTIYKDEAIQRPVASDFE

SEQ ID NO: 51411 - protein, 25 aa, synthetic construct
  source 1..25: note = Seed: QTVHSIPLTINKEEALQRPVASDFE
QTVHSIPLTIYKDEALQRPVASDFE

SEQ ID NO: 51412 - protein, 25 aa, synthetic construct
  source 1..25: note = Seed: QTVHSIPLTINKEEALQRPVASDFE
QTVHSIPLTIYKDEAMQRPVASDFE

SEQ ID NO: 51413 - protein, 25 aa, synthetic construct
  source 1..25: note = Seed: QTVHSIPLTINKEEALQRPVASDFE
QTVHSIPLTIYKDEAVQRPVASDFE

SEQ ID NO: 51414 - protein, 25 aa, synthetic construct
  source 1..25: note = Seed: QTVHSIPLTINKEEALQRPVASDFE
QTVHSIPLTIYKFEAAQRPVASDFE

SEQ ID NO: 51415 - protein, 25 aa, synthetic construct
  source 1..25: note = Seed: QTVHSIPLTINKEEALQRPVASDFE
QTVHSIPLTIYKFEAFQRPVASDFE

SEQ ID NO: 51416 - protein, 25 aa, synthetic construct
  source 1..25: note = Seed: QTVHSIPLTINKEEALQRPVASDFE
QTVHSIPLTIYKFEAIQRPVASDFE

SEQ ID NO: 51417 - protein, 25 aa, synthetic construct
  source 1..25: note = Seed: QTVHSIPLTINKEEALQRPVASDFE
QTVHSIPLTIYKFEALQRPVASDFE

SEQ ID NO: 51418 - protein, 25 aa, synthetic construct
  source 1..25: note = Seed: QTVHSIPLTINKEEALQRPVASDFE
QTVHSIPLTIYKFEAMQRPVASDFE

SEQ ID NO: 51419 - protein, 25 aa, synthetic construct
  source 1..25: note = Seed: QTVHSIPLTINKEEALQRPVASDFE
QTVHSIPLTIYKFEAVQRPVASDFE

SEQ ID NO: 51420 - protein, 25 aa, synthetic construct
  source 1..25: note = Seed: QTVHSIPLTINKEEALQRPVASDFE
QTVHSIPLTIYKFEAYQRPVASDFE

SEQ ID NO: 51421 - protein, 25 aa, synthetic construct
  source 1..25: note = Seed: QTVHSIPLTINKEEALQRPVASDFE
QTVHSIPLTIYKIEAAQRPVASDFE

SEQ ID NO: 51422 - protein, 25 aa, synthetic construct
  source 1..25: note = Seed: QTVHSIPLTINKEEALQRPVASDFE
QTVHSIPLTIYKIEAFQRPVASDFE

SEQ ID NO: 51423 - protein, 25 aa, synthetic construct
  source 1..25: note = Seed: QTVHSIPLTINKEEALQRPVASDFE
QTVHSIPLTIYKIEAIQRPVASDFE

SEQ ID NO: 51424 - protein, 25 aa, synthetic construct
  source 1..25: note = Seed: QTVHSIPLTINKEEALQRPVASDFE
QTVHSIPLTIYKIEALQRPVASDFE

SEQ ID NO: 51425 - protein, 25 aa, synthetic construct
  source 1..25: note = Seed: QTVHSIPLTINKEEALQRPVASDFE
QTVHSIPLTIYKIEAMQRPVASDFE

SEQ ID NO: 51426 - protein, 25 aa, synthetic construct
  source 1..25: note = Seed: QTVHSIPLTINKEEALQRPVASDFE
QTVHSIPLTIYKIEARQRPVASDFE

SEQ ID NO: 51427 - protein, 25 aa, synthetic construct
  source 1..25: note = Seed: QTVHSIPLTINKEEALQRPVASDFE
QTVHSIPLTIYKIEASQRPVASDFE

SEQ ID NO: 51428 - protein, 25 aa, synthetic construct
  source 1..25: note = Seed: QTVHSIPLTINKEEALQRPVASDFE
QTVHSIPLTIYKIEAVQRPVASDFE

SEQ ID NO: 51429 - protein, 25 aa, synthetic construct
  source 1..25: note = Seed: QTVHSIPLTINKEEALQRPVASDFE
QTVHSIPLTIYKIEAYQRPVASDFE

SEQ ID NO: 51430 - protein, 25 aa, synthetic construct
  source 1..25: note = Seed: QTVHSIPLTINKEEALQRPVASDFE
QTVHSIPLTIYKLEAAQRPVASDFE

SEQ ID NO: 51431 - protein, 25 aa, synthetic construct
  source 1..25: note = Seed: QTVHSIPLTINKEEALQRPVASDFE
QTVHSIPLTIYKLEAFQRPVASDFE

SEQ ID NO: 51432 - protein, 25 aa, synthetic construct
  source 1..25: note = Seed: QTVHSIPLTINKEEALQRPVASDFE
QTVHSIPLTIYKLEAIQRPVASDFE

SEQ ID NO: 51433 - protein, 25 aa, synthetic construct
  source 1..25: note = Seed: QTVHSIPLTINKEEALQRPVASDFE
QTVHSIPLTIYKLEALQRPVASDFE

SEQ ID NO: 51434 - protein, 25 aa, synthetic construct
  source 1..25: note = Seed: QTVHSIPLTINKEEALQRPVASDFE
QTVHSIPLTIYKLEAVQRPVASDFE

SEQ ID NO: 51435 - protein, 25 aa, synthetic construct
  source 1..25: note = Seed: QTVHSIPLTINKEEALQRPVASDFE
QTVHSIPLTIYKMEAIQRPVASDFE

SEQ ID NO: 51436 - protein, 25 aa, synthetic construct
  source 1..25: note = Seed: QTVHSIPLTINKEEALQRPVASDFE
QTVHSIPLTIYKNEAIQRPVASDFE

SEQ ID NO: 51437 - protein, 25 aa, synthetic construct
  source 1..25: note = Seed: QTVHSIPLTINKEEALQRPVASDFE
QTVHSIPLTIYKNEALQRPVASDFE

SEQ ID NO: 51438 - protein, 25 aa, synthetic construct
  source 1..25: note = Seed: QTVHSIPLTINKEEALQRPVASDFE
QTVHSIPLTIYKNEAVQRPVASDFE

SEQ ID NO: 51439 - protein, 25 aa, synthetic construct
  source 1..25: note = Seed: QTVHSIPLTINKEEALQRPVASDFE
QTVHSIPLTIYKVEAAQRPVASDFE

SEQ ID NO: 51440 - protein, 25 aa, synthetic construct
  source 1..25: note = Seed: QTVHSIPLTINKEEALQRPVASDFE
QTVHSIPLTIYKVEAFQRPVASDFE

SEQ ID NO: 51441 - protein, 25 aa, synthetic construct
  source 1..25: note = Seed: QTVHSIPLTINKEEALQRPVASDFE
QTVHSIPLTIYKVEAIQRPVASDFE

SEQ ID NO: 51442 - protein, 25 aa, synthetic construct
  source 1..25: note = Seed: QTVHSIPLTINKEEALQRPVASDFE
QTVHSIPLTIYKVEALQRPVASDFE

SEQ ID NO: 51443 - protein, 25 aa, synthetic construct
  source 1..25: note = Seed: QTVHSIPLTINKEEALQRPVASDFE
QTVHSIPLTIYKVEAMQRPVASDFE

SEQ ID NO: 51444 - protein, 25 aa, synthetic construct
  source 1..25: note = Seed: QTVHSIPLTINKEEALQRPVASDFE
QTVHSIPLTIYKVEAVQRPVASDFE

SEQ ID NO: 51445 - protein, 25 aa, synthetic construct
  source 1..25: note = Seed: QTVHSIPLTINKEEALQRPVASDFE
QTVHSIPLTIYKWEAFQRPVASDFE

SEQ ID NO: 51446 - protein, 25 aa, synthetic construct
  source 1..25: note = Seed: QTVHSIPLTINKEEALQRPVASDFE
QTVHSIPLTIYKYEAFQRPVASDFE

SEQ ID NO: 51447 - protein, 25 aa, synthetic construct
  source 1..25: note = Seed: QTVHSIPLTINKEEALQRPVASDFE
QTVHSIPLTIYKYEAIQRPVASDFE

SEQ ID NO: 51448 - protein, 25 aa, synthetic construct
  source 1..25: note = Seed: QTVHSIPLTINKEEALQRPVASDFE
QTVHSIPLTIYKYEALQRPVASDFE

SEQ ID NO: 51449 - protein, 25 aa, synthetic construct
  source 1..25: note = Seed: QTVHSIPLTINKEEALQRPVASDFE
QTVHSIPMTIAKFEAFQRPVASDFE

SEQ ID NO: 51450 - protein, 25 aa, synthetic construct
  source 1..25: note = Seed: QTVHSIPLTINKEEALQRPVASDFE
QTVHSIPMTIAKFEAIQRPVASDFE

SEQ ID NO: 51451 - protein, 25 aa, synthetic construct
  source 1..25: note = Seed: QTVHSIPLTINKEEALQRPVASDFE
QTVHSIPMTIAKFEALQRPVASDFE

SEQ ID NO: 51452 - protein, 25 aa, synthetic construct
  source 1..25: note = Seed: QTVHSIPLTINKEEALQRPVASDFE
QTVHSIPMTIAKFEAMQRPVASDFE

SEQ ID NO: 51453 - protein, 25 aa, synthetic construct
  source 1..25: note = Seed: QTVHSIPLTINKEEALQRPVASDFE
QTVHSIPMTIAKFEAVQRPVASDFE

SEQ ID NO: 51454 - protein, 25 aa, synthetic construct
  source 1..25: note = Seed: QTVHSIPLTINKEEALQRPVASDFE
QTVHSIPMTIEKFEAFQRPVASDFE

SEQ ID NO: 51455 - protein, 25 aa, synthetic construct
  source 1..25: note = Seed: QTVHSIPLTINKEEALQRPVASDFE
QTVHSIPMTIEKFEAIQRPVASDFE

SEQ ID NO: 51456 - protein, 25 aa, synthetic construct
  source 1..25: note = Seed: QTVHSIPLTINKEEALQRPVASDFE
QTVHSIPMTIEKFEALQRPVASDFE

SEQ ID NO: 51457 - protein, 25 aa, synthetic construct
  source 1..25: note = Seed: QTVHSIPLTINKEEALQRPVASDFE
QTVHSIPMTIEKFEAVQRPVASDFE

SEQ ID NO: 51458 - protein, 25 aa, synthetic construct
  source 1..25: note = Seed: QTVHSIPLTINKEEALQRPVASDFE
QTVHSIPMTIFKAEAAQRPVASDFE

SEQ ID NO: 51459 - protein, 25 aa, synthetic construct
  source 1..25: note = Seed: QTVHSIPLTINKEEALQRPVASDFE
QTVHSIPMTIFKAEAFQRPVASDFE

SEQ ID NO: 51460 - protein, 25 aa, synthetic construct
  source 1..25: note = Seed: QTVHSIPLTINKEEALQRPVASDFE
QTVHSIPMTIFKAEAIQRPVASDFE

SEQ ID NO: 51461 - protein, 25 aa, synthetic construct
  source 1..25: note = Seed: QTVHSIPLTINKEEALQRPVASDFE
QTVHSIPMTIFKAEALQRPVASDFE

SEQ ID NO: 51462 - protein, 25 aa, synthetic construct
  source 1..25: note = Seed: QTVHSIPLTINKEEALQRPVASDFE
QTVHSIPMTIFKAEAVQRPVASDFE

SEQ ID NO: 51463 - protein, 25 aa, synthetic construct
  source 1..25: note = Seed: QTVHSIPLTINKEEALQRPVASDFE
QTVHSIPMTIFKDEAAQRPVASDFE

SEQ ID NO: 51464 - protein, 25 aa, synthetic construct
  source 1..25: note = Seed: QTVHSIPLTINKEEALQRPVASDFE
QTVHSIPMTIFKDEAIQRPVASDFE

SEQ ID NO: 51465 - protein, 25 aa, synthetic construct
  source 1..25: note = Seed: QTVHSIPLTINKEEALQRPVASDFE
QTVHSIPMTIFKDEALQRPVASDFE

SEQ ID NO: 51466 - protein, 25 aa, synthetic construct
  source 1..25: note = Seed: QTVHSIPLTINKEEALQRPVASDFE
QTVHSIPMTIFKDEAVQRPVASDFE

SEQ ID NO: 51467 - protein, 25 aa, synthetic construct
  source 1..25: note = Seed: QTVHSIPLTINKEEALQRPVASDFE
QTVHSIPMTIFKFEAAQRPVASDFE

SEQ ID NO: 51468 - protein, 25 aa, synthetic construct
  source 1..25: note = Seed: QTVHSIPLTINKEEALQRPVASDFE
QTVHSIPMTIFKFEAFQRPVASDFE

SEQ ID NO: 51469 - protein, 25 aa, synthetic construct
  source 1..25: note = Seed: QTVHSIPLTINKEEALQRPVASDFE
QTVHSIPMTIFKFEAIQRPVASDFE

SEQ ID NO: 51470 - protein, 25 aa, synthetic construct
  source 1..25: note = Seed: QTVHSIPLTINKEEALQRPVASDFE
QTVHSIPMTIFKFEALQRPVASDFE

SEQ ID NO: 51471 - protein, 25 aa, synthetic construct
  source 1..25: note = Seed: QTVHSIPLTINKEEALQRPVASDFE
QTVHSIPMTIFKFEAMQRPVASDFE

SEQ ID NO: 51472 - protein, 25 aa, synthetic construct
  source 1..25: note = Seed: QTVHSIPLTINKEEALQRPVASDFE
QTVHSIPMTIFKFEATQRPVASDFE

SEQ ID NO: 51473 - protein, 25 aa, synthetic construct
  source 1..25: note = Seed: QTVHSIPLTINKEEALQRPVASDFE
QTVHSIPMTIFKFEAVQRPVASDFE

SEQ ID NO: 51474 - protein, 25 aa, synthetic construct
  source 1..25: note = Seed: QTVHSIPLTINKEEALQRPVASDFE
QTVHSIPMTIFKFEAWQRPVASDFE

SEQ ID NO: 51475 - protein, 25 aa, synthetic construct
  source 1..25: note = Seed: QTVHSIPLTINKEEALQRPVASDFE
QTVHSIPMTIFKFEAYQRPVASDFE

SEQ ID NO: 51476 - protein, 25 aa, synthetic construct
  source 1..25: note = Seed: QTVHSIPLTINKEEALQRPVASDFE
QTVHSIPMTIFKHEALQRPVASDFE

SEQ ID NO: 51477 - protein, 25 aa, synthetic construct
  source 1..25: note = Seed: QTVHSIPLTINKEEALQRPVASDFE
QTVHSIPMTIFKIEAAQRPVASDFE

SEQ ID NO: 51478 - protein, 25 aa, synthetic construct
  source 1..25: note = Seed: QTVHSIPLTINKEEALQRPVASDFE
QTVHSIPMTIFKIEAFQRPVASDFE

SEQ ID NO: 51479 - protein, 25 aa, synthetic construct
  source 1..25: note = Seed: QTVHSIPLTINKEEALQRPVASDFE
QTVHSIPMTIFKIEAIQRPVASDFE

SEQ ID NO: 51480 - protein, 25 aa, synthetic construct
  source 1..25: note = Seed: QTVHSIPLTINKEEALQRPVASDFE
QTVHSIPMTIFKIEALQRPVASDFE

SEQ ID NO: 51481 - protein, 25 aa, synthetic construct
  source 1..25: note = Seed: QTVHSIPLTINKEEALQRPVASDFE
QTVHSIPMTIFKIEAMQRPVASDFE

SEQ ID NO: 51482 - protein, 25 aa, synthetic construct
  source 1..25: note = Seed: QTVHSIPLTINKEEALQRPVASDFE
QTVHSIPMTIFKIEASQRPVASDFE

SEQ ID NO: 51483 - protein, 25 aa, synthetic construct
  source 1..25: note = Seed: QTVHSIPLTINKEEALQRPVASDFE
QTVHSIPMTIFKIEAVQRPVASDFE

SEQ ID NO: 51484 - protein, 25 aa, synthetic construct
  source 1..25: note = Seed: QTVHSIPLTINKEEALQRPVASDFE
QTVHSIPMTIFKIEAYQRPVASDFE

SEQ ID NO: 51485 - protein, 25 aa, synthetic construct
  source 1..25: note = Seed: QTVHSIPLTINKEEALQRPVASDFE
QTVHSIPMTIFKLEAAQRPVASDFE

SEQ ID NO: 51486 - protein, 25 aa, synthetic construct
  source 1..25: note = Seed: QTVHSIPLTINKEEALQRPVASDFE
QTVHSIPMTIFKLEAFQRPVASDFE

SEQ ID NO: 51487 - protein, 25 aa, synthetic construct
  source 1..25: note = Seed: QTVHSIPLTINKEEALQRPVASDFE
QTVHSIPMTIFKLEAIQRPVASDFE

SEQ ID NO: 51488 - protein, 25 aa, synthetic construct
  source 1..25: note = Seed: QTVHSIPLTINKEEALQRPVASDFE
QTVHSIPMTIFKLEALQRPVASDFE

SEQ ID NO: 51489 - protein, 25 aa, synthetic construct
  source 1..25: note = Seed: QTVHSIPLTINKEEALQRPVASDFE
QTVHSIPMTIFKLEAMQRPVASDFE

SEQ ID NO: 51490 - protein, 25 aa, synthetic construct
  source 1..25: note = Seed: QTVHSIPLTINKEEALQRPVASDFE
QTVHSIPMTIFKLEAVQRPVASDFE

SEQ ID NO: 51491 - protein, 25 aa, synthetic construct
  source 1..25: note = Seed: QTVHSIPLTINKEEALQRPVASDFE
QTVHSIPMTIFKLEAYQRPVASDFE

SEQ ID NO: 51492 - protein, 25 aa, synthetic construct
  source 1..25: note = Seed: QTVHSIPLTINKEEALQRPVASDFE
QTVHSIPMTIFKMEAAQRPVASDFE

SEQ ID NO: 51493 - protein, 25 aa, synthetic construct
  source 1..25: note = Seed: QTVHSIPLTINKEEALQRPVASDFE
QTVHSIPMTIFKMEAFQRPVASDFE

SEQ ID NO: 51494 - protein, 25 aa, synthetic construct
  source 1..25: note = Seed: QTVHSIPLTINKEEALQRPVASDFE
QTVHSIPMTIFKMEAIQRPVASDFE

SEQ ID NO: 51495 - protein, 25 aa, synthetic construct
  source 1..25: note = Seed: QTVHSIPLTINKEEALQRPVASDFE
QTVHSIPMTIFKMEALQRPVASDFE

SEQ ID NO: 51496 - protein, 25 aa, synthetic construct
  source 1..25: note = Seed: QTVHSIPLTINKEEALQRPVASDFE
QTVHSIPMTIFKMEAVQRPVASDFE

SEQ ID NO: 51497 - protein, 25 aa, synthetic construct
  source 1..25: note = Seed: QTVHSIPLTINKEEALQRPVASDFE
QTVHSIPMTIFKREAFQRPVASDFE

SEQ ID NO: 51498 - protein, 25 aa, synthetic construct
  source 1..25: note = Seed: QTVHSIPLTINKEEALQRPVASDFE
QTVHSIPMTIFKREALQRPVASDFE

SEQ ID NO: 51499 - protein, 25 aa, synthetic construct
  source 1..25: note = Seed: QTVHSIPLTINKEEALQRPVASDFE
QTVHSIPMTIFKREAYQRPVASDFE

SEQ ID NO: 51500 - protein, 25 aa, synthetic construct
  source 1..25: note = Seed: QTVHSIPLTINKEEALQRPVASDFE
QTVHSIPMTIFKVEAAQRPVASDFE

SEQ ID NO: 51501 - protein, 25 aa, synthetic construct
  source 1..25: note = Seed: QTVHSIPLTINKEEALQRPVASDFE
QTVHSIPMTIFKVEAFQRPVASDFE

SEQ ID NO: 51502 - protein, 25 aa, synthetic construct
  source 1..25: note = Seed: QTVHSIPLTINKEEALQRPVASDFE
QTVHSIPMTIFKVEAIQRPVASDFE

SEQ ID NO: 51503 - protein, 25 aa, synthetic construct
  source 1..25: note = Seed: QTVHSIPLTINKEEALQRPVASDFE
QTVHSIPMTIFKVEALQRPVASDFE

SEQ ID NO: 51504 - protein, 25 aa, synthetic construct
  source 1..25: note = Seed: QTVHSIPLTINKEEALQRPVASDFE
QTVHSIPMTIFKVEAMQRPVASDFE

SEQ ID NO: 51505 - protein, 25 aa, synthetic construct
  source 1..25: note = Seed: QTVHSIPLTINKEEALQRPVASDFE
QTVHSIPMTIFKVEAVQRPVASDFE

SEQ ID NO: 51506 - protein, 25 aa, synthetic construct
  source 1..25: note = Seed: QTVHSIPLTINKEEALQRPVASDFE
QTVHSIPMTIFKWEAFQRPVASDFE

SEQ ID NO: 51507 - protein, 25 aa, synthetic construct
  source 1..25: note = Seed: QTVHSIPLTINKEEALQRPVASDFE
QTVHSIPMTIFKWEAIQRPVASDFE

SEQ ID NO: 51508 - protein, 25 aa, synthetic construct
  source 1..25: note = Seed: QTVHSIPLTINKEEALQRPVASDFE
QTVHSIPMTIFKWEALQRPVASDFE

SEQ ID NO: 51509 - protein, 25 aa, synthetic construct
  source 1..25: note = Seed: QTVHSIPLTINKEEALQRPVASDFE
QTVHSIPMTIFKYEAFQRPVASDFE

SEQ ID NO: 51510 - protein, 25 aa, synthetic construct
  source 1..25: note = Seed: QTVHSIPLTINKEEALQRPVASDFE
QTVHSIPMTIFKYEAIQRPVASDFE

SEQ ID NO: 51511 - protein, 25 aa, synthetic construct
  source 1..25: note = Seed: QTVHSIPLTINKEEALQRPVASDFE
QTVHSIPMTIFKYEALQRPVASDFE

SEQ ID NO: 51512 - protein, 25 aa, synthetic construct
  source 1..25: note = Seed: QTVHSIPLTINKEEALQRPVASDFE
QTVHSIPMTIFKYEAMQRPVASDFE

SEQ ID NO: 51513 - protein, 25 aa, synthetic construct
  source 1..25: note = Seed: QTVHSIPLTINKEEALQRPVASDFE
QTVHSIPMTIFKYEAVQRPVASDFE

SEQ ID NO: 51514 - protein, 25 aa, synthetic construct
  source 1..25: note = Seed: QTVHSIPLTINKEEALQRPVASDFE
QTVHSIPMTIFKYEAWQRPVASDFE

SEQ ID NO: 51515 - protein, 25 aa, synthetic construct
  source 1..25: note = Seed: QTVHSIPLTINKEEALQRPVASDFE
QTVHSIPMTIFKYEAYQRPVASDFE

SEQ ID NO: 51516 - protein, 25 aa, synthetic construct
  source 1..25: note = Seed: QTVHSIPLTINKEEALQRPVASDFE
QTVHSIPMTIHKFEAFQRPVASDFE

SEQ ID NO: 51517 - protein, 25 aa, synthetic construct
  source 1..25: note = Seed: QTVHSIPLTINKEEALQRPVASDFE
QTVHSIPMTIHKFEAIQRPVASDFE

SEQ ID NO: 51518 - protein, 25 aa, synthetic construct
  source 1..25: note = Seed: QTVHSIPLTINKEEALQRPVASDFE
QTVHSIPMTIHKFEALQRPVASDFE

SEQ ID NO: 51519 - protein, 25 aa, synthetic construct
  source 1..25: note = Seed: QTVHSIPLTINKEEALQRPVASDFE
QTVHSIPMTIHKFEAMQRPVASDFE

SEQ ID NO: 51520 - protein, 25 aa, synthetic construct
  source 1..25: note = Seed: QTVHSIPLTINKEEALQRPVASDFE
QTVHSIPMTIHKFEAVQRPVASDFE

SEQ ID NO: 51521 - protein, 25 aa, synthetic construct
  source 1..25: note = Seed: QTVHSIPLTINKEEALQRPVASDFE
QTVHSIPMTIIKFEAAQRPVASDFE

SEQ ID NO: 51522 - protein, 25 aa, synthetic construct
  source 1..25: note = Seed: QTVHSIPLTINKEEALQRPVASDFE
QTVHSIPMTIIKFEAEQRPVASDFE

SEQ ID NO: 51523 - protein, 25 aa, synthetic construct
  source 1..25: note = Seed: QTVHSIPLTINKEEALQRPVASDFE
QTVHSIPMTIIKFEAFQRPVASDFE

SEQ ID NO: 51524 - protein, 25 aa, synthetic construct
  source 1..25: note = Seed: QTVHSIPLTINKEEALQRPVASDFE
QTVHSIPMTIIKFEAIQRPVASDFE

SEQ ID NO: 51525 - protein, 25 aa, synthetic construct
  source 1..25: note = Seed: QTVHSIPLTINKEEALQRPVASDFE
QTVHSIPMTIIKFEALQRPVASDFE

SEQ ID NO: 51526 - protein, 25 aa, synthetic construct
  source 1..25: note = Seed: QTVHSIPLTINKEEALQRPVASDFE
QTVHSIPMTIIKFEAMQRPVASDFE

SEQ ID NO: 51527 - protein, 25 aa, synthetic construct
  source 1..25: note = Seed: QTVHSIPLTINKEEALQRPVASDFE
QTVHSIPMTIIKFEAVQRPVASDFE

SEQ ID NO: 51528 - protein, 25 aa, synthetic construct
  source 1..25: note = Seed: QTVHSIPLTINKEEALQRPVASDFE
QTVHSIPMTIIKFEAWQRPVASDFE

SEQ ID NO: 51529 - protein, 25 aa, synthetic construct
  source 1..25: note = Seed: QTVHSIPLTINKEEALQRPVASDFE
QTVHSIPMTIIKFEAYQRPVASDFE

SEQ ID NO: 51530 - protein, 25 aa, synthetic construct
  source 1..25: note = Seed: QTVHSIPLTINKEEALQRPVASDFE
QTVHSIPMTIIKIEAAQRPVASDFE

SEQ ID NO: 51531 - protein, 25 aa, synthetic construct
  source 1..25: note = Seed: QTVHSIPLTINKEEALQRPVASDFE
QTVHSIPMTIIKIEAFQRPVASDFE

SEQ ID NO: 51532 - protein, 25 aa, synthetic construct
  source 1..25: note = Seed: QTVHSIPLTINKEEALQRPVASDFE
QTVHSIPMTIIKIEAIQRPVASDFE

SEQ ID NO: 51533 - protein, 25 aa, synthetic construct
  source 1..25: note = Seed: QTVHSIPLTINKEEALQRPVASDFE
QTVHSIPMTIIKIEAVQRPVASDFE

SEQ ID NO: 51534 - protein, 25 aa, synthetic construct
  source 1..25: note = Seed: QTVHSIPLTINKEEALQRPVASDFE
QTVHSIPMTIIKLEAFQRPVASDFE

SEQ ID NO: 51535 - protein, 25 aa, synthetic construct
  source 1..25: note = Seed: QTVHSIPLTINKEEALQRPVASDFE
QTVHSIPMTIIKLEAIQRPVASDFE

SEQ ID NO: 51536 - protein, 25 aa, synthetic construct
  source 1..25: note = Seed: QTVHSIPLTINKEEALQRPVASDFE
QTVHSIPMTIIKLEALQRPVASDFE

SEQ ID NO: 51537 - protein, 25 aa, synthetic construct
  source 1..25: note = Seed: QTVHSIPLTINKEEALQRPVASDFE
QTVHSIPMTIIKREAFQRPVASDFE

SEQ ID NO: 51538 - protein, 25 aa, synthetic construct
  source 1..25: note = Seed: QTVHSIPLTINKEEALQRPVASDFE
QTVHSIPMTIIKREAIQRPVASDFE

SEQ ID NO: 51539 - protein, 25 aa, synthetic construct
  source 1..25: note = Seed: QTVHSIPLTINKEEALQRPVASDFE
QTVHSIPMTIIKREALQRPVASDFE

SEQ ID NO: 51540 - protein, 25 aa, synthetic construct
  source 1..25: note = Seed: QTVHSIPLTINKEEALQRPVASDFE
QTVHSIPMTIIKREAYQRPVASDFE

SEQ ID NO: 51541 - protein, 25 aa, synthetic construct
  source 1..25: note = Seed: QTVHSIPLTINKEEALQRPVASDFE
QTVHSIPMTIIKVEAVQRPVASDFE

SEQ ID NO: 51542 - protein, 25 aa, synthetic construct
  source 1..25: note = Seed: QTVHSIPLTINKEEALQRPVASDFE
QTVHSIPMTIIKWEALQRPVASDFE

SEQ ID NO: 51543 - protein, 25 aa, synthetic construct
  source 1..25: note = Seed: QTVHSIPLTINKEEALQRPVASDFE
QTVHSIPMTIIKYEAFQRPVASDFE

SEQ ID NO: 51544 - protein, 25 aa, synthetic construct
  source 1..25: note = Seed: QTVHSIPLTINKEEALQRPVASDFE
QTVHSIPMTIIKYEAIQRPVASDFE

SEQ ID NO: 51545 - protein, 25 aa, synthetic construct
  source 1..25: note = Seed: QTVHSIPLTINKEEALQRPVASDFE
QTVHSIPMTIIKYEALQRPVASDFE

SEQ ID NO: 51546 - protein, 25 aa, synthetic construct
  source 1..25: note = Seed: QTVHSIPLTINKEEALQRPVASDFE
QTVHSIPMTILKFEAAQRPVASDFE

SEQ ID NO: 51547 - protein, 25 aa, synthetic construct
  source 1..25: note = Seed: QTVHSIPLTINKEEALQRPVASDFE
QTVHSIPMTILKFEAEQRPVASDFE

SEQ ID NO: 51548 - protein, 25 aa, synthetic construct
  source 1..25: note = Seed: QTVHSIPLTINKEEALQRPVASDFE
QTVHSIPMTILKFEAFQRPVASDFE

SEQ ID NO: 51549 - protein, 25 aa, synthetic construct
  source 1..25: note = Seed: QTVHSIPLTINKEEALQRPVASDFE
QTVHSIPMTILKFEAIQRPVASDFE

SEQ ID NO: 51550 - protein, 25 aa, synthetic construct
  source 1..25: note = Seed: QTVHSIPLTINKEEALQRPVASDFE
QTVHSIPMTILKFEALQRPVASDFE

SEQ ID NO: 51551 - protein, 25 aa, synthetic construct
  source 1..25: note = Seed: QTVHSIPLTINKEEALQRPVASDFE
QTVHSIPMTILKFEAMQRPVASDFE

SEQ ID NO: 51552 - protein, 25 aa, synthetic construct
  source 1..25: note = Seed: QTVHSIPLTINKEEALQRPVASDFE
QTVHSIPMTILKFEATQRPVASDFE

SEQ ID NO: 51553 - protein, 25 aa, synthetic construct
  source 1..25: note = Seed: QTVHSIPLTINKEEALQRPVASDFE
QTVHSIPMTILKFEAVQRPVASDFE

SEQ ID NO: 51554 - protein, 25 aa, synthetic construct
  source 1..25: note = Seed: QTVHSIPLTINKEEALQRPVASDFE
QTVHSIPMTILKFEAWQRPVASDFE

SEQ ID NO: 51555 - protein, 25 aa, synthetic construct
  source 1..25: note = Seed: QTVHSIPLTINKEEALQRPVASDFE
QTVHSIPMTILKFEAYQRPVASDFE

SEQ ID NO: 51556 - protein, 25 aa, synthetic construct
  source 1..25: note = Seed: QTVHSIPLTINKEEALQRPVASDFE
QTVHSIPMTILKIEAAQRPVASDFE

SEQ ID NO: 51557 - protein, 25 aa, synthetic construct
  source 1..25: note = Seed: QTVHSIPLTINKEEALQRPVASDFE
QTVHSIPMTILKIEAFQRPVASDFE

SEQ ID NO: 51558 - protein, 25 aa, synthetic construct
  source 1..25: note = Seed: QTVHSIPLTINKEEALQRPVASDFE
QTVHSIPMTILKIEAIQRPVASDFE

SEQ ID NO: 51559 - protein, 25 aa, synthetic construct
  source 1..25: note = Seed: QTVHSIPLTINKEEALQRPVASDFE
QTVHSIPMTILKIEALQRPVASDFE

SEQ ID NO: 51560 - protein, 25 aa, synthetic construct
  source 1..25: note = Seed: QTVHSIPLTINKEEALQRPVASDFE
QTVHSIPMTILKIEAVQRPVASDFE

SEQ ID NO: 51561 - protein, 25 aa, synthetic construct
  source 1..25: note = Seed: QTVHSIPLTINKEEALQRPVASDFE
QTVHSIPMTILKLEAFQRPVASDFE

SEQ ID NO: 51562 - protein, 25 aa, synthetic construct
  source 1..25: note = Seed: QTVHSIPLTINKEEALQRPVASDFE
QTVHSIPMTILKLEAIQRPVASDFE

SEQ ID NO: 51563 - protein, 25 aa, synthetic construct
  source 1..25: note = Seed: QTVHSIPLTINKEEALQRPVASDFE
QTVHSIPMTILKLEALQRPVASDFE

SEQ ID NO: 51564 - protein, 25 aa, synthetic construct
  source 1..25: note = Seed: QTVHSIPLTINKEEALQRPVASDFE
QTVHSIPMTILKMEAFQRPVASDFE

SEQ ID NO: 51565 - protein, 25 aa, synthetic construct
  source 1..25: note = Seed: QTVHSIPLTINKEEALQRPVASDFE
QTVHSIPMTILKREAIQRPVASDFE

SEQ ID NO: 51566 - protein, 25 aa, synthetic construct
  source 1..25: note = Seed: QTVHSIPLTINKEEALQRPVASDFE
QTVHSIPMTILKREALQRPVASDFE

SEQ ID NO: 51567 - protein, 25 aa, synthetic construct
  source 1..25: note = Seed: QTVHSIPLTINKEEALQRPVASDFE
QTVHSIPMTILKVEAVQRPVASDFE

SEQ ID NO: 51568 - protein, 25 aa, synthetic construct
  source 1..25: note = Seed: QTVHSIPLTINKEEALQRPVASDFE
QTVHSIPMTILKWEALQRPVASDFE

SEQ ID NO: 51569 - protein, 25 aa, synthetic construct
  source 1..25: note = Seed: QTVHSIPLTINKEEALQRPVASDFE
QTVHSIPMTILKYEAFQRPVASDFE

SEQ ID NO: 51570 - protein, 25 aa, synthetic construct
  source 1..25: note = Seed: QTVHSIPLTINKEEALQRPVASDFE
QTVHSIPMTILKYEAIQRPVASDFE

SEQ ID NO: 51571 - protein, 25 aa, synthetic construct
  source 1..25: note = Seed: QTVHSIPLTINKEEALQRPVASDFE
QTVHSIPMTILKYEALQRPVASDFE

SEQ ID NO: 51572 - protein, 25 aa, synthetic construct
  source 1..25: note = Seed: QTVHSIPLTINKEEALQRPVASDFE
QTVHSIPMTIMKAEAIQRPVASDFE

SEQ ID NO: 51573 - protein, 25 aa, synthetic construct
  source 1..25: note = Seed: QTVHSIPLTINKEEALQRPVASDFE
QTVHSIPMTIMKAEALQRPVASDFE

SEQ ID NO: 51574 - protein, 25 aa, synthetic construct
  source 1..25: note = Seed: QTVHSIPLTINKEEALQRPVASDFE
QTVHSIPMTIMKAEAVQRPVASDFE

SEQ ID NO: 51575 - protein, 25 aa, synthetic construct
  source 1..25: note = Seed: QTVHSIPLTINKEEALQRPVASDFE
QTVHSIPMTIMKFEAFQRPVASDFE

SEQ ID NO: 51576 - protein, 25 aa, synthetic construct
  source 1..25: note = Seed: QTVHSIPLTINKEEALQRPVASDFE
QTVHSIPMTIMKFEAIQRPVASDFE

SEQ ID NO: 51577 - protein, 25 aa, synthetic construct
  source 1..25: note = Seed: QTVHSIPLTINKEEALQRPVASDFE
QTVHSIPMTIMKFEALQRPVASDFE

SEQ ID NO: 51578 - protein, 25 aa, synthetic construct
  source 1..25: note = Seed: QTVHSIPLTINKEEALQRPVASDFE
QTVHSIPMTIMKFEAMQRPVASDFE

SEQ ID NO: 51579 - protein, 25 aa, synthetic construct
  source 1..25: note = Seed: QTVHSIPLTINKEEALQRPVASDFE
QTVHSIPMTIMKFEAVQRPVASDFE

SEQ ID NO: 51580 - protein, 25 aa, synthetic construct
  source 1..25: note = Seed: QTVHSIPLTINKEEALQRPVASDFE
QTVHSIPMTIMKFEAYQRPVASDFE

SEQ ID NO: 51581 - protein, 25 aa, synthetic construct
  source 1..25: note = Seed: QTVHSIPLTINKEEALQRPVASDFE
QTVHSIPMTIMKIEAAQRPVASDFE

SEQ ID NO: 51582 - protein, 25 aa, synthetic construct
  source 1..25: note = Seed: QTVHSIPLTINKEEALQRPVASDFE
QTVHSIPMTIMKIEAFQRPVASDFE

SEQ ID NO: 51583 - protein, 25 aa, synthetic construct
  source 1..25: note = Seed: QTVHSIPLTINKEEALQRPVASDFE
QTVHSIPMTIMKIEAIQRPVASDFE

SEQ ID NO: 51584 - protein, 25 aa, synthetic construct
  source 1..25: note = Seed: QTVHSIPLTINKEEALQRPVASDFE
QTVHSIPMTIMKIEALQRPVASDFE

SEQ ID NO: 51585 - protein, 25 aa, synthetic construct
  source 1..25: note = Seed: QTVHSIPLTINKEEALQRPVASDFE
QTVHSIPMTIMKIEAMQRPVASDFE

SEQ ID NO: 51586 - protein, 25 aa, synthetic construct
  source 1..25: note = Seed: QTVHSIPLTINKEEALQRPVASDFE
QTVHSIPMTIMKIEAVQRPVASDFE

SEQ ID NO: 51587 - protein, 25 aa, synthetic construct
  source 1..25: note = Seed: QTVHSIPLTINKEEALQRPVASDFE
QTVHSIPMTIMKLEAFQRPVASDFE

SEQ ID NO: 51588 - protein, 25 aa, synthetic construct
  source 1..25: note = Seed: QTVHSIPLTINKEEALQRPVASDFE
QTVHSIPMTIMKLEAIQRPVASDFE

SEQ ID NO: 51589 - protein, 25 aa, synthetic construct
  source 1..25: note = Seed: QTVHSIPLTINKEEALQRPVASDFE
QTVHSIPMTIMKLEALQRPVASDFE

SEQ ID NO: 51590 - protein, 25 aa, synthetic construct
  source 1..25: note = Seed: QTVHSIPLTINKEEALQRPVASDFE
QTVHSIPMTIMKLEAVQRPVASDFE

SEQ ID NO: 51591 - protein, 25 aa, synthetic construct
  source 1..25: note = Seed: QTVHSIPLTINKEEALQRPVASDFE
QTVHSIPMTIMKMEAIQRPVASDFE

SEQ ID NO: 51592 - protein, 25 aa, synthetic construct
  source 1..25: note = Seed: QTVHSIPLTINKEEALQRPVASDFE
QTVHSIPMTIMKMEAVQRPVASDFE

SEQ ID NO: 51593 - protein, 25 aa, synthetic construct
  source 1..25: note = Seed: QTVHSIPLTINKEEALQRPVASDFE
QTVHSIPMTIMKVEAIQRPVASDFE

SEQ ID NO: 51594 - protein, 25 aa, synthetic construct
  source 1..25: note = Seed: QTVHSIPLTINKEEALQRPVASDFE
QTVHSIPMTIMKVEALQRPVASDFE

SEQ ID NO: 51595 - protein, 25 aa, synthetic construct
  source 1..25: note = Seed: QTVHSIPLTINKEEALQRPVASDFE
QTVHSIPMTIMKVEAVQRPVASDFE

SEQ ID NO: 51596 - protein, 25 aa, synthetic construct
  source 1..25: note = Seed: QTVHSIPLTINKEEALQRPVASDFE
QTVHSIPMTIMKYEAFQRPVASDFE

SEQ ID NO: 51597 - protein, 25 aa, synthetic construct
  source 1..25: note = Seed: QTVHSIPLTINKEEALQRPVASDFE
QTVHSIPMTINKAEAFQRPVASDFE

SEQ ID NO: 51598 - protein, 25 aa, synthetic construct
  source 1..25: note = Seed: QTVHSIPLTINKEEALQRPVASDFE
QTVHSIPMTINKAEAIQRPVASDFE

SEQ ID NO: 51599 - protein, 25 aa, synthetic construct
  source 1..25: note = Seed: QTVHSIPLTINKEEALQRPVASDFE
QTVHSIPMTINKAEALQRPVASDFE

SEQ ID NO: 51600 - protein, 25 aa, synthetic construct
  source 1..25: note = Seed: QTVHSIPLTINKEEALQRPVASDFE
QTVHSIPMTINKAEAVQRPVASDFE

SEQ ID NO: 51601 - protein, 25 aa, synthetic construct
  source 1..25: note = Seed: QTVHSIPLTINKEEALQRPVASDFE
QTVHSIPMTINKFEAIQRPVASDFE

SEQ ID NO: 51602 - protein, 25 aa, synthetic construct
  source 1..25: note = Seed: QTVHSIPLTINKEEALQRPVASDFE
QTVHSIPMTINKFEALQRPVASDFE

SEQ ID NO: 51603 - protein, 25 aa, synthetic construct
  source 1..25: note = Seed: QTVHSIPLTINKEEALQRPVASDFE
QTVHSIPMTINKGEAIQRPVASDFE

SEQ ID NO: 51604 - protein, 25 aa, synthetic construct
  source 1..25: note = Seed: QTVHSIPLTINKEEALQRPVASDFE
QTVHSIPMTINKGEAVQRPVASDFE

SEQ ID NO: 51605 - protein, 25 aa, synthetic construct
  source 1..25: note = Seed: QTVHSIPLTINKEEALQRPVASDFE
QTVHSIPMTINKIEAIQRPVASDFE

SEQ ID NO: 51606 - protein, 25 aa, synthetic construct
  source 1..25: note = Seed: QTVHSIPLTINKEEALQRPVASDFE
QTVHSIPMTINKIEAVQRPVASDFE

SEQ ID NO: 51607 - protein, 25 aa, synthetic construct
  source 1..25: note = Seed: QTVHSIPLTINKEEALQRPVASDFE
QTVHSIPMTINKNEAFQRPVASDFE

SEQ ID NO: 51608 - protein, 25 aa, synthetic construct
  source 1..25: note = Seed: QTVHSIPLTINKEEALQRPVASDFE
QTVHSIPMTINKNEAIQRPVASDFE

SEQ ID NO: 51609 - protein, 25 aa, synthetic construct
  source 1..25: note = Seed: QTVHSIPLTINKEEALQRPVASDFE
QTVHSIPMTINKNEALQRPVASDFE

SEQ ID NO: 51610 - protein, 25 aa, synthetic construct
  source 1..25: note = Seed: QTVHSIPLTINKEEALQRPVASDFE
QTVHSIPMTINKNEAMQRPVASDFE

SEQ ID NO: 51611 - protein, 25 aa, synthetic construct
  source 1..25: note = Seed: QTVHSIPLTINKEEALQRPVASDFE
QTVHSIPMTINKNEAVQRPVASDFE

SEQ ID NO: 51612 - protein, 25 aa, synthetic construct
  source 1..25: note = Seed: QTVHSIPLTINKEEALQRPVASDFE
QTVHSIPMTINKNEAYQRPVASDFE

SEQ ID NO: 51613 - protein, 25 aa, synthetic construct
  source 1..25: note = Seed: QTVHSIPLTINKEEALQRPVASDFE
QTVHSIPMTINKSEAFQRPVASDFE

SEQ ID NO: 51614 - protein, 25 aa, synthetic construct
  source 1..25: note = Seed: QTVHSIPLTINKEEALQRPVASDFE
QTVHSIPMTINKSEAIQRPVASDFE

SEQ ID NO: 51615 - protein, 25 aa, synthetic construct
  source 1..25: note = Seed: QTVHSIPLTINKEEALQRPVASDFE
QTVHSIPMTINKSEALQRPVASDFE

SEQ ID NO: 51616 - protein, 25 aa, synthetic construct
  source 1..25: note = Seed: QTVHSIPLTINKEEALQRPVASDFE
QTVHSIPMTINKSEAVQRPVASDFE

SEQ ID NO: 51617 - protein, 25 aa, synthetic construct
  source 1..25: note = Seed: QTVHSIPLTINKEEALQRPVASDFE
QTVHSIPMTINKTEAIQRPVASDFE

SEQ ID NO: 51618 - protein, 25 aa, synthetic construct
  source 1..25: note = Seed: QTVHSIPLTINKEEALQRPVASDFE
QTVHSIPMTINKVEAIQRPVASDFE

SEQ ID NO: 51619 - protein, 25 aa, synthetic construct
  source 1..25: note = Seed: QTVHSIPLTINKEEALQRPVASDFE
QTVHSIPMTINKVEAVQRPVASDFE

SEQ ID NO: 51620 - protein, 25 aa, synthetic construct
  source 1..25: note = Seed: QTVHSIPLTINKEEALQRPVASDFE
QTVHSIPMTIQKFEAFQRPVASDFE

SEQ ID NO: 51621 - protein, 25 aa, synthetic construct
  source 1..25: note = Seed: QTVHSIPLTINKEEALQRPVASDFE
QTVHSIPMTIQKFEAIQRPVASDFE

SEQ ID NO: 51622 - protein, 25 aa, synthetic construct
  source 1..25: note = Seed: QTVHSIPLTINKEEALQRPVASDFE
QTVHSIPMTIQKFEALQRPVASDFE

SEQ ID NO: 51623 - protein, 25 aa, synthetic construct
  source 1..25: note = Seed: QTVHSIPLTINKEEALQRPVASDFE
QTVHSIPMTIQKFEAVQRPVASDFE

SEQ ID NO: 51624 - protein, 25 aa, synthetic construct
  source 1..25: note = Seed: QTVHSIPLTINKEEALQRPVASDFE
QTVHSIPMTISKFEAFQRPVASDFE

SEQ ID NO: 51625 - protein, 25 aa, synthetic construct
  source 1..25: note = Seed: QTVHSIPLTINKEEALQRPVASDFE
QTVHSIPMTISKFEAIQRPVASDFE

SEQ ID NO: 51626 - protein, 25 aa, synthetic construct
  source 1..25: note = Seed: QTVHSIPLTINKEEALQRPVASDFE
QTVHSIPMTISKFEALQRPVASDFE

SEQ ID NO: 51627 - protein, 25 aa, synthetic construct
  source 1..25: note = Seed: QTVHSIPLTINKEEALQRPVASDFE
QTVHSIPMTISKFEAMQRPVASDFE

SEQ ID NO: 51628 - protein, 25 aa, synthetic construct
  source 1..25: note = Seed: QTVHSIPLTINKEEALQRPVASDFE
QTVHSIPMTISKFEAVQRPVASDFE

SEQ ID NO: 51629 - protein, 25 aa, synthetic construct
  source 1..25: note = Seed: QTVHSIPLTINKEEALQRPVASDFE
QTVHSIPMTITKFEAFQRPVASDFE

SEQ ID NO: 51630 - protein, 25 aa, synthetic construct
  source 1..25: note = Seed: QTVHSIPLTINKEEALQRPVASDFE
QTVHSIPMTITKFEAIQRPVASDFE

SEQ ID NO: 51631 - protein, 25 aa, synthetic construct
  source 1..25: note = Seed: QTVHSIPLTINKEEALQRPVASDFE
QTVHSIPMTITKFEALQRPVASDFE

SEQ ID NO: 51632 - protein, 25 aa, synthetic construct
  source 1..25: note = Seed: QTVHSIPLTINKEEALQRPVASDFE
QTVHSIPMTITKFEAMQRPVASDFE

SEQ ID NO: 51633 - protein, 25 aa, synthetic construct
  source 1..25: note = Seed: QTVHSIPLTINKEEALQRPVASDFE
QTVHSIPMTITKFEAVQRPVASDFE

SEQ ID NO: 51634 - protein, 25 aa, synthetic construct
  source 1..25: note = Seed: QTVHSIPLTINKEEALQRPVASDFE
QTVHSIPMTIVKFEAFQRPVASDFE

SEQ ID NO: 51635 - protein, 25 aa, synthetic construct
  source 1..25: note = Seed: QTVHSIPLTINKEEALQRPVASDFE
QTVHSIPMTIVKFEAIQRPVASDFE

SEQ ID NO: 51636 - protein, 25 aa, synthetic construct
  source 1..25: note = Seed: QTVHSIPLTINKEEALQRPVASDFE
QTVHSIPMTIVKFEALQRPVASDFE

SEQ ID NO: 51637 - protein, 25 aa, synthetic construct
  source 1..25: note = Seed: QTVHSIPLTINKEEALQRPVASDFE
QTVHSIPMTIVKFEAMQRPVASDFE

SEQ ID NO: 51638 - protein, 25 aa, synthetic construct
  source 1..25: note = Seed: QTVHSIPLTINKEEALQRPVASDFE
QTVHSIPMTIVKFEAVQRPVASDFE

SEQ ID NO: 51639 - protein, 25 aa, synthetic construct
  source 1..25: note = Seed: QTVHSIPLTINKEEALQRPVASDFE
QTVHSIPMTIVKFEAYQRPVASDFE

SEQ ID NO: 51640 - protein, 25 aa, synthetic construct
  source 1..25: note = Seed: QTVHSIPLTINKEEALQRPVASDFE
QTVHSIPMTIVKLEAFQRPVASDFE

SEQ ID NO: 51641 - protein, 25 aa, synthetic construct
  source 1..25: note = Seed: QTVHSIPLTINKEEALQRPVASDFE
QTVHSIPMTIVKLEALQRPVASDFE

SEQ ID NO: 51642 - protein, 25 aa, synthetic construct
  source 1..25: note = Seed: QTVHSIPLTINKEEALQRPVASDFE
QTVHSIPMTIVKYEAFQRPVASDFE

SEQ ID NO: 51643 - protein, 25 aa, synthetic construct
  source 1..25: note = Seed: QTVHSIPLTINKEEALQRPVASDFE
QTVHSIPMTIVKYEALQRPVASDFE

SEQ ID NO: 51644 - protein, 25 aa, synthetic construct
  source 1..25: note = Seed: QTVHSIPLTINKEEALQRPVASDFE
QTVHSIPMTIWKFEAFQRPVASDFE

SEQ ID NO: 51645 - protein, 25 aa, synthetic construct
  source 1..25: note = Seed: QTVHSIPLTINKEEALQRPVASDFE
QTVHSIPMTIWKFEAIQRPVASDFE

SEQ ID NO: 51646 - protein, 25 aa, synthetic construct
  source 1..25: note = Seed: QTVHSIPLTINKEEALQRPVASDFE
QTVHSIPMTIWKFEALQRPVASDFE

SEQ ID NO: 51647 - protein, 25 aa, synthetic construct
  source 1..25: note = Seed: QTVHSIPLTINKEEALQRPVASDFE
QTVHSIPMTIWKIEAAQRPVASDFE

SEQ ID NO: 51648 - protein, 25 aa, synthetic construct
  source 1..25: note = Seed: QTVHSIPLTINKEEALQRPVASDFE
QTVHSIPMTIWKIEAIQRPVASDFE

SEQ ID NO: 51649 - protein, 25 aa, synthetic construct
  source 1..25: note = Seed: QTVHSIPLTINKEEALQRPVASDFE
QTVHSIPMTIWKIEALQRPVASDFE

SEQ ID NO: 51650 - protein, 25 aa, synthetic construct
  source 1..25: note = Seed: QTVHSIPLTINKEEALQRPVASDFE
QTVHSIPMTIWKIEAMQRPVASDFE

SEQ ID NO: 51651 - protein, 25 aa, synthetic construct
  source 1..25: note = Seed: QTVHSIPLTINKEEALQRPVASDFE
QTVHSIPMTIWKIEAVQRPVASDFE

SEQ ID NO: 51652 - protein, 25 aa, synthetic construct
  source 1..25: note = Seed: QTVHSIPLTINKEEALQRPVASDFE
QTVHSIPMTIWKLEAFQRPVASDFE

SEQ ID NO: 51653 - protein, 25 aa, synthetic construct
  source 1..25: note = Seed: QTVHSIPLTINKEEALQRPVASDFE
QTVHSIPMTIWKVEAIQRPVASDFE

SEQ ID NO: 51654 - protein, 25 aa, synthetic construct
  source 1..25: note = Seed: QTVHSIPLTINKEEALQRPVASDFE
QTVHSIPMTIWKYEAFQRPVASDFE

SEQ ID NO: 51655 - protein, 25 aa, synthetic construct
  source 1..25: note = Seed: QTVHSIPLTINKEEALQRPVASDFE
QTVHSIPMTIYKAEAIQRPVASDFE

SEQ ID NO: 51656 - protein, 25 aa, synthetic construct
  source 1..25: note = Seed: QTVHSIPLTINKEEALQRPVASDFE
QTVHSIPMTIYKAEALQRPVASDFE

SEQ ID NO: 51657 - protein, 25 aa, synthetic construct
  source 1..25: note = Seed: QTVHSIPLTINKEEALQRPVASDFE
QTVHSIPMTIYKAEAVQRPVASDFE

SEQ ID NO: 51658 - protein, 25 aa, synthetic construct
  source 1..25: note = Seed: QTVHSIPLTINKEEALQRPVASDFE
QTVHSIPMTIYKDEAIQRPVASDFE

SEQ ID NO: 51659 - protein, 25 aa, synthetic construct
  source 1..25: note = Seed: QTVHSIPLTINKEEALQRPVASDFE
QTVHSIPMTIYKDEALQRPVASDFE

SEQ ID NO: 51660 - protein, 25 aa, synthetic construct
  source 1..25: note = Seed: QTVHSIPLTINKEEALQRPVASDFE
QTVHSIPMTIYKDEAVQRPVASDFE

SEQ ID NO: 51661 - protein, 25 aa, synthetic construct
  source 1..25: note = Seed: QTVHSIPLTINKEEALQRPVASDFE
QTVHSIPMTIYKFEAFQRPVASDFE

SEQ ID NO: 51662 - protein, 25 aa, synthetic construct
  source 1..25: note = Seed: QTVHSIPLTINKEEALQRPVASDFE
QTVHSIPMTIYKFEAIQRPVASDFE

SEQ ID NO: 51663 - protein, 25 aa, synthetic construct
  source 1..25: note = Seed: QTVHSIPLTINKEEALQRPVASDFE
QTVHSIPMTIYKFEALQRPVASDFE

SEQ ID NO: 51664 - protein, 25 aa, synthetic construct
  source 1..25: note = Seed: QTVHSIPLTINKEEALQRPVASDFE
QTVHSIPMTIYKFEAMQRPVASDFE

SEQ ID NO: 51665 - protein, 25 aa, synthetic construct
  source 1..25: note = Seed: QTVHSIPLTINKEEALQRPVASDFE
QTVHSIPMTIYKFEAVQRPVASDFE

SEQ ID NO: 51666 - protein, 25 aa, synthetic construct
  source 1..25: note = Seed: QTVHSIPLTINKEEALQRPVASDFE
QTVHSIPMTIYKIEAAQRPVASDFE

SEQ ID NO: 51667 - protein, 25 aa, synthetic construct
  source 1..25: note = Seed: QTVHSIPLTINKEEALQRPVASDFE
QTVHSIPMTIYKIEAFQRPVASDFE

SEQ ID NO: 51668 - protein, 25 aa, synthetic construct
  source 1..25: note = Seed: QTVHSIPLTINKEEALQRPVASDFE
QTVHSIPMTIYKIEAIQRPVASDFE

SEQ ID NO: 51669 - protein, 25 aa, synthetic construct
  source 1..25: note = Seed: QTVHSIPLTINKEEALQRPVASDFE
QTVHSIPMTIYKIEALQRPVASDFE

SEQ ID NO: 51670 - protein, 25 aa, synthetic construct
  source 1..25: note = Seed: QTVHSIPLTINKEEALQRPVASDFE
QTVHSIPMTIYKIEAMQRPVASDFE

SEQ ID NO: 51671 - protein, 25 aa, synthetic construct
  source 1..25: note = Seed: QTVHSIPLTINKEEALQRPVASDFE
QTVHSIPMTIYKIEAVQRPVASDFE

SEQ ID NO: 51672 - protein, 25 aa, synthetic construct
  source 1..25: note = Seed: QTVHSIPLTINKEEALQRPVASDFE
QTVHSIPMTIYKLEAAQRPVASDFE

SEQ ID NO: 51673 - protein, 25 aa, synthetic construct
  source 1..25: note = Seed: QTVHSIPLTINKEEALQRPVASDFE
QTVHSIPMTIYKLEAFQRPVASDFE

SEQ ID NO: 51674 - protein, 25 aa, synthetic construct
  source 1..25: note = Seed: QTVHSIPLTINKEEALQRPVASDFE
QTVHSIPMTIYKVEAAQRPVASDFE

SEQ ID NO: 51675 - protein, 25 aa, synthetic construct
  source 1..25: note = Seed: QTVHSIPLTINKEEALQRPVASDFE
QTVHSIPMTIYKVEAIQRPVASDFE

SEQ ID NO: 51676 - protein, 25 aa, synthetic construct
  source 1..25: note = Seed: QTVHSIPLTINKEEALQRPVASDFE
QTVHSIPMTIYKVEALQRPVASDFE

SEQ ID NO: 51677 - protein, 25 aa, synthetic construct
  source 1..25: note = Seed: QTVHSIPLTINKEEALQRPVASDFE
QTVHSIPMTIYKVEAMQRPVASDFE

SEQ ID NO: 51678 - protein, 25 aa, synthetic construct
  source 1..25: note = Seed: QTVHSIPLTINKEEALQRPVASDFE
QTVHSIPMTIYKVEAVQRPVASDFE

SEQ ID NO: 51679 - protein, 25 aa, synthetic construct
  source 1..25: note = Seed: QTVHSIPLTINKEEALQRPVASDFE
QTVHSIPMTIYKYEAFQRPVASDFE

SEQ ID NO: 51680 - protein, 25 aa, synthetic construct
  source 1..25: note = Seed: QTVHSIPLTINKEEALQRPVASDFE
QTVHSIPQTIFKFEAIQRPVASDFE

SEQ ID NO: 51681 - protein, 25 aa, synthetic construct
  source 1..25: note = Seed: QTVHSIPLTINKEEALQRPVASDFE
QTVHSIPQTIFKFEALQRPVASDFE

SEQ ID NO: 51682 - protein, 25 aa, synthetic construct
  source 1..25: note = Seed: QTVHSIPLTINKEEALQRPVASDFE
QTVHSIPQTILKFEALQRPVASDFE

SEQ ID NO: 51683 - protein, 25 aa, synthetic construct
  source 1..25: note = Seed: QTVHSIPLTINKEEALQRPVASDFE
QTVHSIPRTIFKFEAIQRPVASDFE

SEQ ID NO: 51684 - protein, 25 aa, synthetic construct
  source 1..25: note = Seed: QTVHSIPLTINKEEALQRPVASDFE
QTVHSIPRTIFKFEALQRPVASDFE

SEQ ID NO: 51685 - protein, 25 aa, synthetic construct
  source 1..25: note = Seed: QTVHSIPLTINKEEALQRPVASDFE
QTVHSIPRTIFKFEAMQRPVASDFE

SEQ ID NO: 51686 - protein, 25 aa, synthetic construct
  source 1..25: note = Seed: QTVHSIPLTINKEEALQRPVASDFE
QTVHSIPRTIFKFEAVQRPVASDFE

SEQ ID NO: 51687 - protein, 25 aa, synthetic construct
  source 1..25: note = Seed: QTVHSIPLTINKEEALQRPVASDFE
QTVHSIPRTIIKFEALQRPVASDFE

SEQ ID NO: 51688 - protein, 25 aa, synthetic construct
  source 1..25: note = Seed: QTVHSIPLTINKEEALQRPVASDFE
QTVHSIPTTIFKFEALQRPVASDFE

SEQ ID NO: 51689 - protein, 25 aa, synthetic construct
  source 1..25: note = Seed: QTVHSIPLTINKEEALQRPVASDFE
QTVHSIPTTIIKFEALQRPVASDFE

SEQ ID NO: 51690 - protein, 25 aa, synthetic construct
  source 1..25: note = Seed: QTVHSIPLTINKEEALQRPVASDFE
QTVHSIPTTILKFEALQRPVASDFE

SEQ ID NO: 51691 - protein, 25 aa, synthetic construct
  source 1..25: note = Seed: QTVHSIPLTINKEEALQRPVASDFE
QTVHSIPVTIAKFEAFQRPVASDFE

SEQ ID NO: 51692 - protein, 25 aa, synthetic construct
  source 1..25: note = Seed: QTVHSIPLTINKEEALQRPVASDFE
QTVHSIPVTIAKFEAIQRPVASDFE

SEQ ID NO: 51693 - protein, 25 aa, synthetic construct
  source 1..25: note = Seed: QTVHSIPLTINKEEALQRPVASDFE
QTVHSIPVTIAKFEALQRPVASDFE

SEQ ID NO: 51694 - protein, 25 aa, synthetic construct
  source 1..25: note = Seed: QTVHSIPLTINKEEALQRPVASDFE
QTVHSIPVTIAKFEAVQRPVASDFE

SEQ ID NO: 51695 - protein, 25 aa, synthetic construct
  source 1..25: note = Seed: QTVHSIPLTINKEEALQRPVASDFE
QTVHSIPVTIEKFEAFQRPVASDFE

SEQ ID NO: 51696 - protein, 25 aa, synthetic construct
  source 1..25: note = Seed: QTVHSIPLTINKEEALQRPVASDFE
QTVHSIPVTIEKFEAIQRPVASDFE

SEQ ID NO: 51697 - protein, 25 aa, synthetic construct
  source 1..25: note = Seed: QTVHSIPLTINKEEALQRPVASDFE
QTVHSIPVTIEKFEALQRPVASDFE

SEQ ID NO: 51698 - protein, 25 aa, synthetic construct
  source 1..25: note = Seed: QTVHSIPLTINKEEALQRPVASDFE
QTVHSIPVTIEKFEAVQRPVASDFE

SEQ ID NO: 51699 - protein, 25 aa, synthetic construct
  source 1..25: note = Seed: QTVHSIPLTINKEEALQRPVASDFE
QTVHSIPVTIFKAEAFQRPVASDFE

SEQ ID NO: 51700 - protein, 25 aa, synthetic construct
  source 1..25: note = Seed: QTVHSIPLTINKEEALQRPVASDFE
QTVHSIPVTIFKAEAIQRPVASDFE

SEQ ID NO: 51701 - protein, 25 aa, synthetic construct
  source 1..25: note = Seed: QTVHSIPLTINKEEALQRPVASDFE
QTVHSIPVTIFKAEAVQRPVASDFE

SEQ ID NO: 51702 - protein, 25 aa, synthetic construct
  source 1..25: note = Seed: QTVHSIPLTINKEEALQRPVASDFE
QTVHSIPVTIFKDEAAQRPVASDFE

SEQ ID NO: 51703 - protein, 25 aa, synthetic construct
  source 1..25: note = Seed: QTVHSIPLTINKEEALQRPVASDFE
QTVHSIPVTIFKDEAIQRPVASDFE

SEQ ID NO: 51704 - protein, 25 aa, synthetic construct
  source 1..25: note = Seed: QTVHSIPLTINKEEALQRPVASDFE
QTVHSIPVTIFKDEALQRPVASDFE

SEQ ID NO: 51705 - protein, 25 aa, synthetic construct
  source 1..25: note = Seed: QTVHSIPLTINKEEALQRPVASDFE
QTVHSIPVTIFKDEAVQRPVASDFE

SEQ ID NO: 51706 - protein, 25 aa, synthetic construct
  source 1..25: note = Seed: QTVHSIPLTINKEEALQRPVASDFE
QTVHSIPVTIFKFEAFQRPVASDFE

SEQ ID NO: 51707 - protein, 25 aa, synthetic construct
  source 1..25: note = Seed: QTVHSIPLTINKEEALQRPVASDFE
QTVHSIPVTIFKFEAIQRPVASDFE

SEQ ID NO: 51708 - protein, 25 aa, synthetic construct
  source 1..25: note = Seed: QTVHSIPLTINKEEALQRPVASDFE
QTVHSIPVTIFKFEALQRPVASDFE

SEQ ID NO: 51709 - protein, 25 aa, synthetic construct
  source 1..25: note = Seed: QTVHSIPLTINKEEALQRPVASDFE
QTVHSIPVTIFKFEAMQRPVASDFE

SEQ ID NO: 51710 - protein, 25 aa, synthetic construct
  source 1..25: note = Seed: QTVHSIPLTINKEEALQRPVASDFE
QTVHSIPVTIFKFEAVQRPVASDFE

SEQ ID NO: 51711 - protein, 25 aa, synthetic construct
  source 1..25: note = Seed: QTVHSIPLTINKEEALQRPVASDFE
QTVHSIPVTIFKFEAWQRPVASDFE

SEQ ID NO: 51712 - protein, 25 aa, synthetic construct
  source 1..25: note = Seed: QTVHSIPLTINKEEALQRPVASDFE
QTVHSIPVTIFKFEAYQRPVASDFE

SEQ ID NO: 51713 - protein, 25 aa, synthetic construct
  source 1..25: note = Seed: QTVHSIPLTINKEEALQRPVASDFE
QTVHSIPVTIFKIEAAQRPVASDFE

SEQ ID NO: 51714 - protein, 25 aa, synthetic construct
  source 1..25: note = Seed: QTVHSIPLTINKEEALQRPVASDFE
QTVHSIPVTIFKIEAFQRPVASDFE

SEQ ID NO: 51715 - protein, 25 aa, synthetic construct
  source 1..25: note = Seed: QTVHSIPLTINKEEALQRPVASDFE
QTVHSIPVTIFKIEAIQRPVASDFE

SEQ ID NO: 51716 - protein, 25 aa, synthetic construct
  source 1..25: note = Seed: QTVHSIPLTINKEEALQRPVASDFE
QTVHSIPVTIFKIEALQRPVASDFE

SEQ ID NO: 51717 - protein, 25 aa, synthetic construct
  source 1..25: note = Seed: QTVHSIPLTINKEEALQRPVASDFE
QTVHSIPVTIFKIEAMQRPVASDFE

SEQ ID NO: 51718 - protein, 25 aa, synthetic construct
  source 1..25: note = Seed: QTVHSIPLTINKEEALQRPVASDFE
QTVHSIPVTIFKIEAVQRPVASDFE

SEQ ID NO: 51719 - protein, 25 aa, synthetic construct
  source 1..25: note = Seed: QTVHSIPLTINKEEALQRPVASDFE
QTVHSIPVTIFKLEAFQRPVASDFE

SEQ ID NO: 51720 - protein, 25 aa, synthetic construct
  source 1..25: note = Seed: QTVHSIPLTINKEEALQRPVASDFE
QTVHSIPVTIFKLEAIQRPVASDFE

SEQ ID NO: 51721 - protein, 25 aa, synthetic construct
  source 1..25: note = Seed: QTVHSIPLTINKEEALQRPVASDFE
QTVHSIPVTIFKLEALQRPVASDFE

SEQ ID NO: 51722 - protein, 25 aa, synthetic construct
  source 1..25: note = Seed: QTVHSIPLTINKEEALQRPVASDFE
QTVHSIPVTIFKLEAMQRPVASDFE

SEQ ID NO: 51723 - protein, 25 aa, synthetic construct
  source 1..25: note = Seed: QTVHSIPLTINKEEALQRPVASDFE
QTVHSIPVTIFKLEAYQRPVASDFE

SEQ ID NO: 51724 - protein, 25 aa, synthetic construct
  source 1..25: note = Seed: QTVHSIPLTINKEEALQRPVASDFE
QTVHSIPVTIFKMEAFQRPVASDFE

SEQ ID NO: 51725 - protein, 25 aa, synthetic construct
  source 1..25: note = Seed: QTVHSIPLTINKEEALQRPVASDFE
QTVHSIPVTIFKMEALQRPVASDFE

SEQ ID NO: 51726 - protein, 25 aa, synthetic construct
  source 1..25: note = Seed: QTVHSIPLTINKEEALQRPVASDFE
QTVHSIPVTIFKVEAFQRPVASDFE

SEQ ID NO: 51727 - protein, 25 aa, synthetic construct
  source 1..25: note = Seed: QTVHSIPLTINKEEALQRPVASDFE
QTVHSIPVTIFKWEAFQRPVASDFE

SEQ ID NO: 51728 - protein, 25 aa, synthetic construct
  source 1..25: note = Seed: QTVHSIPLTINKEEALQRPVASDFE
QTVHSIPVTIFKWEALQRPVASDFE

SEQ ID NO: 51729 - protein, 25 aa, synthetic construct
  source 1..25: note = Seed: QTVHSIPLTINKEEALQRPVASDFE
QTVHSIPVTIFKYEAFQRPVASDFE

SEQ ID NO: 51730 - protein, 25 aa, synthetic construct
  source 1..25: note = Seed: QTVHSIPLTINKEEALQRPVASDFE
QTVHSIPVTIFKYEAIQRPVASDFE

SEQ ID NO: 51731 - protein, 25 aa, synthetic construct
  source 1..25: note = Seed: QTVHSIPLTINKEEALQRPVASDFE
QTVHSIPVTIFKYEALQRPVASDFE

SEQ ID NO: 51732 - protein, 25 aa, synthetic construct
  source 1..25: note = Seed: QTVHSIPLTINKEEALQRPVASDFE
QTVHSIPVTIFKYEAMQRPVASDFE

SEQ ID NO: 51733 - protein, 25 aa, synthetic construct
  source 1..25: note = Seed: QTVHSIPLTINKEEALQRPVASDFE
QTVHSIPVTIHKFEAFQRPVASDFE

SEQ ID NO: 51734 - protein, 25 aa, synthetic construct
  source 1..25: note = Seed: QTVHSIPLTINKEEALQRPVASDFE
QTVHSIPVTIHKFEAIQRPVASDFE

SEQ ID NO: 51735 - protein, 25 aa, synthetic construct
  source 1..25: note = Seed: QTVHSIPLTINKEEALQRPVASDFE
QTVHSIPVTIHKFEALQRPVASDFE

SEQ ID NO: 51736 - protein, 25 aa, synthetic construct
  source 1..25: note = Seed: QTVHSIPLTINKEEALQRPVASDFE
QTVHSIPVTIHKFEAVQRPVASDFE

SEQ ID NO: 51737 - protein, 25 aa, synthetic construct
  source 1..25: note = Seed: QTVHSIPLTINKEEALQRPVASDFE
QTVHSIPVTIIKFEAFQRPVASDFE

SEQ ID NO: 51738 - protein, 25 aa, synthetic construct
  source 1..25: note = Seed: QTVHSIPLTINKEEALQRPVASDFE
QTVHSIPVTIIKFEAIQRPVASDFE

SEQ ID NO: 51739 - protein, 25 aa, synthetic construct
  source 1..25: note = Seed: QTVHSIPLTINKEEALQRPVASDFE
QTVHSIPVTIIKFEALQRPVASDFE

SEQ ID NO: 51740 - protein, 25 aa, synthetic construct
  source 1..25: note = Seed: QTVHSIPLTINKEEALQRPVASDFE
QTVHSIPVTIIKFEAMQRPVASDFE

SEQ ID NO: 51741 - protein, 25 aa, synthetic construct
  source 1..25: note = Seed: QTVHSIPLTINKEEALQRPVASDFE
QTVHSIPVTIIKFEAVQRPVASDFE

SEQ ID NO: 51742 - protein, 25 aa, synthetic construct
  source 1..25: note = Seed: QTVHSIPLTINKEEALQRPVASDFE
QTVHSIPVTIIKFEAYQRPVASDFE

SEQ ID NO: 51743 - protein, 25 aa, synthetic construct
  source 1..25: note = Seed: QTVHSIPLTINKEEALQRPVASDFE
QTVHSIPVTIIKLEAFQRPVASDFE

SEQ ID NO: 51744 - protein, 25 aa, synthetic construct
  source 1..25: note = Seed: QTVHSIPLTINKEEALQRPVASDFE
QTVHSIPVTIIKYEAFQRPVASDFE

SEQ ID NO: 51745 - protein, 25 aa, synthetic construct
  source 1..25: note = Seed: QTVHSIPLTINKEEALQRPVASDFE
QTVHSIPVTIIKYEALQRPVASDFE

SEQ ID NO: 51746 - protein, 25 aa, synthetic construct
  source 1..25: note = Seed: QTVHSIPLTINKEEALQRPVASDFE
QTVHSIPVTILKFEAFQRPVASDFE

SEQ ID NO: 51747 - protein, 25 aa, synthetic construct
  source 1..25: note = Seed: QTVHSIPLTINKEEALQRPVASDFE
QTVHSIPVTILKFEAIQRPVASDFE

SEQ ID NO: 51748 - protein, 25 aa, synthetic construct
  source 1..25: note = Seed: QTVHSIPLTINKEEALQRPVASDFE
QTVHSIPVTILKFEALQRPVASDFE

SEQ ID NO: 51749 - protein, 25 aa, synthetic construct
  source 1..25: note = Seed: QTVHSIPLTINKEEALQRPVASDFE
QTVHSIPVTILKFEAMQRPVASDFE

SEQ ID NO: 51750 - protein, 25 aa, synthetic construct
  source 1..25: note = Seed: QTVHSIPLTINKEEALQRPVASDFE
QTVHSIPVTILKFEAVQRPVASDFE

SEQ ID NO: 51751 - protein, 25 aa, synthetic construct
  source 1..25: note = Seed: QTVHSIPLTINKEEALQRPVASDFE
QTVHSIPVTILKFEAYQRPVASDFE

SEQ ID NO: 51752 - protein, 25 aa, synthetic construct
  source 1..25: note = Seed: QTVHSIPLTINKEEALQRPVASDFE
QTVHSIPVTILKIEAFQRPVASDFE

SEQ ID NO: 51753 - protein, 25 aa, synthetic construct
  source 1..25: note = Seed: QTVHSIPLTINKEEALQRPVASDFE
QTVHSIPVTILKLEAFQRPVASDFE

SEQ ID NO: 51754 - protein, 25 aa, synthetic construct
  source 1..25: note = Seed: QTVHSIPLTINKEEALQRPVASDFE
QTVHSIPVTILKLEALQRPVASDFE

SEQ ID NO: 51755 - protein, 25 aa, synthetic construct
  source 1..25: note = Seed: QTVHSIPLTINKEEALQRPVASDFE
QTVHSIPVTILKWEALQRPVASDFE

SEQ ID NO: 51756 - protein, 25 aa, synthetic construct
  source 1..25: note = Seed: QTVHSIPLTINKEEALQRPVASDFE
QTVHSIPVTILKYEAFQRPVASDFE

SEQ ID NO: 51757 - protein, 25 aa, synthetic construct
  source 1..25: note = Seed: QTVHSIPLTINKEEALQRPVASDFE
QTVHSIPVTILKYEALQRPVASDFE

SEQ ID NO: 51758 - protein, 25 aa, synthetic construct
  source 1..25: note = Seed: QTVHSIPLTINKEEALQRPVASDFE
QTVHSIPVTIMKFEAFQRPVASDFE

SEQ ID NO: 51759 - protein, 25 aa, synthetic construct
  source 1..25: note = Seed: QTVHSIPLTINKEEALQRPVASDFE
QTVHSIPVTIMKFEAIQRPVASDFE

SEQ ID NO: 51760 - protein, 25 aa, synthetic construct
  source 1..25: note = Seed: QTVHSIPLTINKEEALQRPVASDFE
QTVHSIPVTIMKFEALQRPVASDFE

SEQ ID NO: 51761 - protein, 25 aa, synthetic construct
  source 1..25: note = Seed: QTVHSIPLTINKEEALQRPVASDFE
QTVHSIPVTIMKFEAMQRPVASDFE

SEQ ID NO: 51762 - protein, 25 aa, synthetic construct
  source 1..25: note = Seed: QTVHSIPLTINKEEALQRPVASDFE
QTVHSIPVTIMKFEAVQRPVASDFE

SEQ ID NO: 51763 - protein, 25 aa, synthetic construct
  source 1..25: note = Seed: QTVHSIPLTINKEEALQRPVASDFE
QTVHSIPVTIMKFEAYQRPVASDFE

SEQ ID NO: 51764 - protein, 25 aa, synthetic construct
  source 1..25: note = Seed: QTVHSIPLTINKEEALQRPVASDFE
QTVHSIPVTIMKIEAIQRPVASDFE

SEQ ID NO: 51765 - protein, 25 aa, synthetic construct
  source 1..25: note = Seed: QTVHSIPLTINKEEALQRPVASDFE
QTVHSIPVTIMKIEAVQRPVASDFE

SEQ ID NO: 51766 - protein, 25 aa, synthetic construct
  source 1..25: note = Seed: QTVHSIPLTINKEEALQRPVASDFE
QTVHSIPVTIMKLEAFQRPVASDFE

SEQ ID NO: 51767 - protein, 25 aa, synthetic construct
  source 1..25: note = Seed: QTVHSIPLTINKEEALQRPVASDFE
QTVHSIPVTIMKLEALQRPVASDFE

SEQ ID NO: 51768 - protein, 25 aa, synthetic construct
  source 1..25: note = Seed: QTVHSIPLTINKEEALQRPVASDFE
QTVHSIPVTIMKYEAFQRPVASDFE

SEQ ID NO: 51769 - protein, 25 aa, synthetic construct
  source 1..25: note = Seed: QTVHSIPLTINKEEALQRPVASDFE
QTVHSIPVTINKAEAFQRPVASDFE

SEQ ID NO: 51770 - protein, 25 aa, synthetic construct
  source 1..25: note = Seed: QTVHSIPLTINKEEALQRPVASDFE
QTVHSIPVTINKAEAIQRPVASDFE

SEQ ID NO: 51771 - protein, 25 aa, synthetic construct
  source 1..25: note = Seed: QTVHSIPLTINKEEALQRPVASDFE
QTVHSIPVTINKAEALQRPVASDFE

SEQ ID NO: 51772 - protein, 25 aa, synthetic construct
  source 1..25: note = Seed: QTVHSIPLTINKEEALQRPVASDFE
QTVHSIPVTINKAEAMQRPVASDFE

SEQ ID NO: 51773 - protein, 25 aa, synthetic construct
  source 1..25: note = Seed: QTVHSIPLTINKEEALQRPVASDFE
QTVHSIPVTINKAEAVQRPVASDFE

SEQ ID NO: 51774 - protein, 25 aa, synthetic construct
  source 1..25: note = Seed: QTVHSIPLTINKEEALQRPVASDFE
QTVHSIPVTINKFEAIQRPVASDFE

SEQ ID NO: 51775 - protein, 25 aa, synthetic construct
  source 1..25: note = Seed: QTVHSIPLTINKEEALQRPVASDFE
QTVHSIPVTINKFEALQRPVASDFE

SEQ ID NO: 51776 - protein, 25 aa, synthetic construct
  source 1..25: note = Seed: QTVHSIPLTINKEEALQRPVASDFE
QTVHSIPVTINKGEAIQRPVASDFE

SEQ ID NO: 51777 - protein, 25 aa, synthetic construct
  source 1..25: note = Seed: QTVHSIPLTINKEEALQRPVASDFE
QTVHSIPVTINKGEALQRPVASDFE

SEQ ID NO: 51778 - protein, 25 aa, synthetic construct
  source 1..25: note = Seed: QTVHSIPLTINKEEALQRPVASDFE
QTVHSIPVTINKGEAVQRPVASDFE

SEQ ID NO: 51779 - protein, 25 aa, synthetic construct
  source 1..25: note = Seed: QTVHSIPLTINKEEALQRPVASDFE
QTVHSIPVTINKIEAIQRPVASDFE

SEQ ID NO: 51780 - protein, 25 aa, synthetic construct
  source 1..25: note = Seed: QTVHSIPLTINKEEALQRPVASDFE
QTVHSIPVTINKIEALQRPVASDFE

SEQ ID NO: 51781 - protein, 25 aa, synthetic construct
  source 1..25: note = Seed: QTVHSIPLTINKEEALQRPVASDFE
QTVHSIPVTINKIEAVQRPVASDFE

SEQ ID NO: 51782 - protein, 25 aa, synthetic construct
  source 1..25: note = Seed: QTVHSIPLTINKEEALQRPVASDFE
QTVHSIPVTINKNEAFQRPVASDFE

SEQ ID NO: 51783 - protein, 25 aa, synthetic construct
  source 1..25: note = Seed: QTVHSIPLTINKEEALQRPVASDFE
QTVHSIPVTINKNEAIQRPVASDFE

SEQ ID NO: 51784 - protein, 25 aa, synthetic construct
  source 1..25: note = Seed: QTVHSIPLTINKEEALQRPVASDFE
QTVHSIPVTINKNEALQRPVASDFE

SEQ ID NO: 51785 - protein, 25 aa, synthetic construct
  source 1..25: note = Seed: QTVHSIPLTINKEEALQRPVASDFE
QTVHSIPVTINKNEAMQRPVASDFE

SEQ ID NO: 51786 - protein, 25 aa, synthetic construct
  source 1..25: note = Seed: QTVHSIPLTINKEEALQRPVASDFE
QTVHSIPVTINKNEAVQRPVASDFE

SEQ ID NO: 51787 - protein, 25 aa, synthetic construct
  source 1..25: note = Seed: QTVHSIPLTINKEEALQRPVASDFE
QTVHSIPVTINKNEAYQRPVASDFE

SEQ ID NO: 51788 - protein, 25 aa, synthetic construct
  source 1..25: note = Seed: QTVHSIPLTINKEEALQRPVASDFE
QTVHSIPVTINKPEAIQRPVASDFE

SEQ ID NO: 51789 - protein, 25 aa, synthetic construct
  source 1..25: note = Seed: QTVHSIPLTINKEEALQRPVASDFE
QTVHSIPVTINKSEAFQRPVASDFE

SEQ ID NO: 51790 - protein, 25 aa, synthetic construct
  source 1..25: note = Seed: QTVHSIPLTINKEEALQRPVASDFE
QTVHSIPVTINKSEAIQRPVASDFE

SEQ ID NO: 51791 - protein, 25 aa, synthetic construct
  source 1..25: note = Seed: QTVHSIPLTINKEEALQRPVASDFE
QTVHSIPVTINKSEALQRPVASDFE

SEQ ID NO: 51792 - protein, 25 aa, synthetic construct
  source 1..25: note = Seed: QTVHSIPLTINKEEALQRPVASDFE
QTVHSIPVTINKSEAMQRPVASDFE

SEQ ID NO: 51793 - protein, 25 aa, synthetic construct
  source 1..25: note = Seed: QTVHSIPLTINKEEALQRPVASDFE
QTVHSIPVTINKSEAVQRPVASDFE

SEQ ID NO: 51794 - protein, 25 aa, synthetic construct
  source 1..25: note = Seed: QTVHSIPLTINKEEALQRPVASDFE
QTVHSIPVTINKTEAIQRPVASDFE

SEQ ID NO: 51795 - protein, 25 aa, synthetic construct
  source 1..25: note = Seed: QTVHSIPLTINKEEALQRPVASDFE
QTVHSIPVTINKTEALQRPVASDFE

SEQ ID NO: 51796 - protein, 25 aa, synthetic construct
  source 1..25: note = Seed: QTVHSIPLTINKEEALQRPVASDFE
QTVHSIPVTINKTEAVQRPVASDFE

SEQ ID NO: 51797 - protein, 25 aa, synthetic construct
  source 1..25: note = Seed: QTVHSIPLTINKEEALQRPVASDFE
QTVHSIPVTINKVEAIQRPVASDFE

SEQ ID NO: 51798 - protein, 25 aa, synthetic construct
  source 1..25: note = Seed: QTVHSIPLTINKEEALQRPVASDFE
QTVHSIPVTINKVEALQRPVASDFE

SEQ ID NO: 51799 - protein, 25 aa, synthetic construct
  source 1..25: note = Seed: QTVHSIPLTINKEEALQRPVASDFE
QTVHSIPVTINKVEAVQRPVASDFE

SEQ ID NO: 51800 - protein, 25 aa, synthetic construct
  source 1..25: note = Seed: QTVHSIPLTINKEEALQRPVASDFE
QTVHSIPVTIQKFEAFQRPVASDFE

SEQ ID NO: 51801 - protein, 25 aa, synthetic construct
  source 1..25: note = Seed: QTVHSIPLTINKEEALQRPVASDFE
QTVHSIPVTIQKFEAIQRPVASDFE

SEQ ID NO: 51802 - protein, 25 aa, synthetic construct
  source 1..25: note = Seed: QTVHSIPLTINKEEALQRPVASDFE
QTVHSIPVTIQKFEALQRPVASDFE

SEQ ID NO: 51803 - protein, 25 aa, synthetic construct
  source 1..25: note = Seed: QTVHSIPLTINKEEALQRPVASDFE
QTVHSIPVTISKFEAFQRPVASDFE

SEQ ID NO: 51804 - protein, 25 aa, synthetic construct
  source 1..25: note = Seed: QTVHSIPLTINKEEALQRPVASDFE
QTVHSIPVTISKFEAIQRPVASDFE

SEQ ID NO: 51805 - protein, 25 aa, synthetic construct
  source 1..25: note = Seed: QTVHSIPLTINKEEALQRPVASDFE
QTVHSIPVTISKFEALQRPVASDFE

SEQ ID NO: 51806 - protein, 25 aa, synthetic construct
  source 1..25: note = Seed: QTVHSIPLTINKEEALQRPVASDFE
QTVHSIPVTISKFEAVQRPVASDFE

SEQ ID NO: 51807 - protein, 25 aa, synthetic construct
  source 1..25: note = Seed: QTVHSIPLTINKEEALQRPVASDFE
QTVHSIPVTITKFEAFQRPVASDFE

SEQ ID NO: 51808 - protein, 25 aa, synthetic construct
  source 1..25: note = Seed: QTVHSIPLTINKEEALQRPVASDFE
QTVHSIPVTITKFEAIQRPVASDFE

SEQ ID NO: 51809 - protein, 25 aa, synthetic construct
  source 1..25: note = Seed: QTVHSIPLTINKEEALQRPVASDFE
QTVHSIPVTITKFEALQRPVASDFE

SEQ ID NO: 51810 - protein, 25 aa, synthetic construct
  source 1..25: note = Seed: QTVHSIPLTINKEEALQRPVASDFE
QTVHSIPVTITKFEAMQRPVASDFE

SEQ ID NO: 51811 - protein, 25 aa, synthetic construct
  source 1..25: note = Seed: QTVHSIPLTINKEEALQRPVASDFE
QTVHSIPVTITKFEAVQRPVASDFE

SEQ ID NO: 51812 - protein, 25 aa, synthetic construct
  source 1..25: note = Seed: QTVHSIPLTINKEEALQRPVASDFE
QTVHSIPVTIVKFEAFQRPVASDFE

SEQ ID NO: 51813 - protein, 25 aa, synthetic construct
  source 1..25: note = Seed: QTVHSIPLTINKEEALQRPVASDFE
QTVHSIPVTIVKFEAIQRPVASDFE

SEQ ID NO: 51814 - protein, 25 aa, synthetic construct
  source 1..25: note = Seed: QTVHSIPLTINKEEALQRPVASDFE
QTVHSIPVTIVKFEALQRPVASDFE

SEQ ID NO: 51815 - protein, 25 aa, synthetic construct
  source 1..25: note = Seed: QTVHSIPLTINKEEALQRPVASDFE
QTVHSIPVTIVKFEAMQRPVASDFE

SEQ ID NO: 51816 - protein, 25 aa, synthetic construct
  source 1..25: note = Seed: QTVHSIPLTINKEEALQRPVASDFE
QTVHSIPVTIVKFEAVQRPVASDFE

SEQ ID NO: 51817 - protein, 25 aa, synthetic construct
  source 1..25: note = Seed: QTVHSIPLTINKEEALQRPVASDFE
QTVHSIPVTIVKFEAYQRPVASDFE

SEQ ID NO: 51818 - protein, 25 aa, synthetic construct
  source 1..25: note = Seed: QTVHSIPLTINKEEALQRPVASDFE
QTVHSIPVTIVKYEAFQRPVASDFE

SEQ ID NO: 51819 - protein, 25 aa, synthetic construct
  source 1..25: note = Seed: QTVHSIPLTINKEEALQRPVASDFE
QTVHSIPVTIWKFEAFQRPVASDFE

SEQ ID NO: 51820 - protein, 25 aa, synthetic construct
  source 1..25: note = Seed: QTVHSIPLTINKEEALQRPVASDFE
QTVHSIPVTIWKFEALQRPVASDFE

SEQ ID NO: 51821 - protein, 25 aa, synthetic construct
  source 1..25: note = Seed: QTVHSIPLTINKEEALQRPVASDFE
QTVHSIPVTIWKIEAIQRPVASDFE

SEQ ID NO: 51822 - protein, 25 aa, synthetic construct
  source 1..25: note = Seed: QTVHSIPLTINKEEALQRPVASDFE
QTVHSIPVTIYKDEAIQRPVASDFE

SEQ ID NO: 51823 - protein, 25 aa, synthetic construct
  source 1..25: note = Seed: QTVHSIPLTINKEEALQRPVASDFE
QTVHSIPVTIYKDEALQRPVASDFE

SEQ ID NO: 51824 - protein, 25 aa, synthetic construct
  source 1..25: note = Seed: QTVHSIPLTINKEEALQRPVASDFE
QTVHSIPVTIYKDEAVQRPVASDFE

SEQ ID NO: 51825 - protein, 25 aa, synthetic construct
  source 1..25: note = Seed: QTVHSIPLTINKEEALQRPVASDFE
QTVHSIPVTIYKFEAFQRPVASDFE

SEQ ID NO: 51826 - protein, 25 aa, synthetic construct
  source 1..25: note = Seed: QTVHSIPLTINKEEALQRPVASDFE
QTVHSIPVTIYKFEAIQRPVASDFE

SEQ ID NO: 51827 - protein, 25 aa, synthetic construct
  source 1..25: note = Seed: QTVHSIPLTINKEEALQRPVASDFE
QTVHSIPVTIYKFEALQRPVASDFE

SEQ ID NO: 51828 - protein, 25 aa, synthetic construct
  source 1..25: note = Seed: QTVHSIPLTINKEEALQRPVASDFE
QTVHSIPVTIYKIEAAQRPVASDFE

SEQ ID NO: 51829 - protein, 25 aa, synthetic construct
  source 1..25: note = Seed: QTVHSIPLTINKEEALQRPVASDFE
QTVHSIPVTIYKIEAIQRPVASDFE

SEQ ID NO: 51830 - protein, 25 aa, synthetic construct
  source 1..25: note = Seed: QTVHSIPLTINKEEALQRPVASDFE
QTVHSIPVTIYKIEAVQRPVASDFE

SEQ ID NO: 51831 - protein, 25 aa, synthetic construct
  source 1..25: note = Seed: QTVHSIPLTINKEEALQRPVASDFE
QTVHSIPVTIYKYEAFQRPVASDFE

SEQ ID NO: 51832 - protein, 25 aa, synthetic construct
  source 1..25: note = Seed: QTVHSIPLTINKEEALQRPVASDFE
QTVHSIPWTIAKFEAFQRPVASDFE

SEQ ID NO: 51833 - protein, 25 aa, synthetic construct
  source 1..25: note = Seed: QTVHSIPLTINKEEALQRPVASDFE
QTVHSIPWTIAKFEAIQRPVASDFE

SEQ ID NO: 51834 - protein, 25 aa, synthetic construct
  source 1..25: note = Seed: QTVHSIPLTINKEEALQRPVASDFE
QTVHSIPWTIAKFEALQRPVASDFE

SEQ ID NO: 51835 - protein, 25 aa, synthetic construct
  source 1..25: note = Seed: QTVHSIPLTINKEEALQRPVASDFE
QTVHSIPWTIAKFEAMQRPVASDFE

SEQ ID NO: 51836 - protein, 25 aa, synthetic construct
  source 1..25: note = Seed: QTVHSIPLTINKEEALQRPVASDFE
QTVHSIPWTIAKFEAVQRPVASDFE

SEQ ID NO: 51837 - protein, 25 aa, synthetic construct
  source 1..25: note = Seed: QTVHSIPLTINKEEALQRPVASDFE
QTVHSIPWTIEKFEAFQRPVASDFE

SEQ ID NO: 51838 - protein, 25 aa, synthetic construct
  source 1..25: note = Seed: QTVHSIPLTINKEEALQRPVASDFE
QTVHSIPWTIEKFEAIQRPVASDFE

SEQ ID NO: 51839 - protein, 25 aa, synthetic construct
  source 1..25: note = Seed: QTVHSIPLTINKEEALQRPVASDFE
QTVHSIPWTIEKFEALQRPVASDFE

SEQ ID NO: 51840 - protein, 25 aa, synthetic construct
  source 1..25: note = Seed: QTVHSIPLTINKEEALQRPVASDFE
QTVHSIPWTIEKFEAMQRPVASDFE

SEQ ID NO: 51841 - protein, 25 aa, synthetic construct
  source 1..25: note = Seed: QTVHSIPLTINKEEALQRPVASDFE
QTVHSIPWTIEKFEAVQRPVASDFE

SEQ ID NO: 51842 - protein, 25 aa, synthetic construct
  source 1..25: note = Seed: QTVHSIPLTINKEEALQRPVASDFE
QTVHSIPWTIFKAEAFQRPVASDFE

SEQ ID NO: 51843 - protein, 25 aa, synthetic construct
  source 1..25: note = Seed: QTVHSIPLTINKEEALQRPVASDFE
QTVHSIPWTIFKAEALQRPVASDFE

SEQ ID NO: 51844 - protein, 25 aa, synthetic construct
  source 1..25: note = Seed: QTVHSIPLTINKEEALQRPVASDFE
QTVHSIPWTIFKFEAAQRPVASDFE

SEQ ID NO: 51845 - protein, 25 aa, synthetic construct
  source 1..25: note = Seed: QTVHSIPLTINKEEALQRPVASDFE
QTVHSIPWTIFKFEAFQRPVASDFE

SEQ ID NO: 51846 - protein, 25 aa, synthetic construct
  source 1..25: note = Seed: QTVHSIPLTINKEEALQRPVASDFE
QTVHSIPWTIFKFEAIQRPVASDFE

SEQ ID NO: 51847 - protein, 25 aa, synthetic construct
  source 1..25: note = Seed: QTVHSIPLTINKEEALQRPVASDFE
QTVHSIPWTIFKFEALQRPVASDFE

SEQ ID NO: 51848 - protein, 25 aa, synthetic construct
  source 1..25: note = Seed: QTVHSIPLTINKEEALQRPVASDFE
QTVHSIPWTIFKFEAMQRPVASDFE

SEQ ID NO: 51849 - protein, 25 aa, synthetic construct
  source 1..25: note = Seed: QTVHSIPLTINKEEALQRPVASDFE
QTVHSIPWTIFKFEATQRPVASDFE

SEQ ID NO: 51850 - protein, 25 aa, synthetic construct
  source 1..25: note = Seed: QTVHSIPLTINKEEALQRPVASDFE
QTVHSIPWTIFKFEAVQRPVASDFE

SEQ ID NO: 51851 - protein, 25 aa, synthetic construct
  source 1..25: note = Seed: QTVHSIPLTINKEEALQRPVASDFE
QTVHSIPWTIFKFEAWQRPVASDFE

SEQ ID NO: 51852 - protein, 25 aa, synthetic construct
  source 1..25: note = Seed: QTVHSIPLTINKEEALQRPVASDFE
QTVHSIPWTIFKFEAYQRPVASDFE

SEQ ID NO: 51853 - protein, 25 aa, synthetic construct
  source 1..25: note = Seed: QTVHSIPLTINKEEALQRPVASDFE
QTVHSIPWTIFKIEAFQRPVASDFE

SEQ ID NO: 51854 - protein, 25 aa, synthetic construct
  source 1..25: note = Seed: QTVHSIPLTINKEEALQRPVASDFE
QTVHSIPWTIFKIEAIQRPVASDFE

SEQ ID NO: 51855 - protein, 25 aa, synthetic construct
  source 1..25: note = Seed: QTVHSIPLTINKEEALQRPVASDFE
QTVHSIPWTIFKIEALQRPVASDFE

SEQ ID NO: 51856 - protein, 25 aa, synthetic construct
  source 1..25: note = Seed: QTVHSIPLTINKEEALQRPVASDFE
QTVHSIPWTIFKIEAYQRPVASDFE

SEQ ID NO: 51857 - protein, 25 aa, synthetic construct
  source 1..25: note = Seed: QTVHSIPLTINKEEALQRPVASDFE
QTVHSIPWTIFKLEAFQRPVASDFE

SEQ ID NO: 51858 - protein, 25 aa, synthetic construct
  source 1..25: note = Seed: QTVHSIPLTINKEEALQRPVASDFE
QTVHSIPWTIFKLEAIQRPVASDFE

SEQ ID NO: 51859 - protein, 25 aa, synthetic construct
  source 1..25: note = Seed: QTVHSIPLTINKEEALQRPVASDFE
QTVHSIPWTIFKLEALQRPVASDFE

SEQ ID NO: 51860 - protein, 25 aa, synthetic construct
  source 1..25: note = Seed: QTVHSIPLTINKEEALQRPVASDFE
QTVHSIPWTIFKLEAMQRPVASDFE

SEQ ID NO: 51861 - protein, 25 aa, synthetic construct
  source 1..25: note = Seed: QTVHSIPLTINKEEALQRPVASDFE
QTVHSIPWTIFKLEAVQRPVASDFE

SEQ ID NO: 51862 - protein, 25 aa, synthetic construct
  source 1..25: note = Seed: QTVHSIPLTINKEEALQRPVASDFE
QTVHSIPWTIFKLEAYQRPVASDFE

SEQ ID NO: 51863 - protein, 25 aa, synthetic construct
  source 1..25: note = Seed: QTVHSIPLTINKEEALQRPVASDFE
QTVHSIPWTIFKMEAFQRPVASDFE

SEQ ID NO: 51864 - protein, 25 aa, synthetic construct
  source 1..25: note = Seed: QTVHSIPLTINKEEALQRPVASDFE
QTVHSIPWTIFKMEAIQRPVASDFE

SEQ ID NO: 51865 - protein, 25 aa, synthetic construct
  source 1..25: note = Seed: QTVHSIPLTINKEEALQRPVASDFE
QTVHSIPWTIFKMEALQRPVASDFE

SEQ ID NO: 51866 - protein, 25 aa, synthetic construct
  source 1..25: note = Seed: QTVHSIPLTINKEEALQRPVASDFE
QTVHSIPWTIFKTEAFQRPVASDFE

SEQ ID NO: 51867 - protein, 25 aa, synthetic construct
  source 1..25: note = Seed: QTVHSIPLTINKEEALQRPVASDFE
QTVHSIPWTIFKVEAFQRPVASDFE

SEQ ID NO: 51868 - protein, 25 aa, synthetic construct
  source 1..25: note = Seed: QTVHSIPLTINKEEALQRPVASDFE
QTVHSIPWTIFKVEALQRPVASDFE

SEQ ID NO: 51869 - protein, 25 aa, synthetic construct
  source 1..25: note = Seed: QTVHSIPLTINKEEALQRPVASDFE
QTVHSIPWTIFKWEAFQRPVASDFE

SEQ ID NO: 51870 - protein, 25 aa, synthetic construct
  source 1..25: note = Seed: QTVHSIPLTINKEEALQRPVASDFE
QTVHSIPWTIFKWEAIQRPVASDFE

SEQ ID NO: 51871 - protein, 25 aa, synthetic construct
  source 1..25: note = Seed: QTVHSIPLTINKEEALQRPVASDFE
QTVHSIPWTIFKWEALQRPVASDFE

SEQ ID NO: 51872 - protein, 25 aa, synthetic construct
  source 1..25: note = Seed: QTVHSIPLTINKEEALQRPVASDFE
QTVHSIPWTIFKYEAFQRPVASDFE

SEQ ID NO: 51873 - protein, 25 aa, synthetic construct
  source 1..25: note = Seed: QTVHSIPLTINKEEALQRPVASDFE
QTVHSIPWTIFKYEAIQRPVASDFE

SEQ ID NO: 51874 - protein, 25 aa, synthetic construct
  source 1..25: note = Seed: QTVHSIPLTINKEEALQRPVASDFE
QTVHSIPWTIFKYEALQRPVASDFE

SEQ ID NO: 51875 - protein, 25 aa, synthetic construct
  source 1..25: note = Seed: QTVHSIPLTINKEEALQRPVASDFE
QTVHSIPWTIFKYEAMQRPVASDFE

SEQ ID NO: 51876 - protein, 25 aa, synthetic construct
  source 1..25: note = Seed: QTVHSIPLTINKEEALQRPVASDFE
QTVHSIPWTIFKYEAVQRPVASDFE

SEQ ID NO: 51877 - protein, 25 aa, synthetic construct
  source 1..25: note = Seed: QTVHSIPLTINKEEALQRPVASDFE
QTVHSIPWTIFKYEAWQRPVASDFE

SEQ ID NO: 51878 - protein, 25 aa, synthetic construct
  source 1..25: note = Seed: QTVHSIPLTINKEEALQRPVASDFE
QTVHSIPWTIFKYEAYQRPVASDFE

SEQ ID NO: 51879 - protein, 25 aa, synthetic construct
  source 1..25: note = Seed: QTVHSIPLTINKEEALQRPVASDFE
QTVHSIPWTIHKFEAFQRPVASDFE

SEQ ID NO: 51880 - protein, 25 aa, synthetic construct
  source 1..25: note = Seed: QTVHSIPLTINKEEALQRPVASDFE
QTVHSIPWTIHKFEAIQRPVASDFE

SEQ ID NO: 51881 - protein, 25 aa, synthetic construct
  source 1..25: note = Seed: QTVHSIPLTINKEEALQRPVASDFE
QTVHSIPWTIHKFEALQRPVASDFE

SEQ ID NO: 51882 - protein, 25 aa, synthetic construct
  source 1..25: note = Seed: QTVHSIPLTINKEEALQRPVASDFE
QTVHSIPWTIHKFEAMQRPVASDFE

SEQ ID NO: 51883 - protein, 25 aa, synthetic construct
  source 1..25: note = Seed: QTVHSIPLTINKEEALQRPVASDFE
QTVHSIPWTIHKFEAVQRPVASDFE

SEQ ID NO: 51884 - protein, 25 aa, synthetic construct
  source 1..25: note = Seed: QTVHSIPLTINKEEALQRPVASDFE
QTVHSIPWTIIKFEAAQRPVASDFE

SEQ ID NO: 51885 - protein, 25 aa, synthetic construct
  source 1..25: note = Seed: QTVHSIPLTINKEEALQRPVASDFE
QTVHSIPWTIIKFEAEQRPVASDFE

SEQ ID NO: 51886 - protein, 25 aa, synthetic construct
  source 1..25: note = Seed: QTVHSIPLTINKEEALQRPVASDFE
QTVHSIPWTIIKFEAFQRPVASDFE

SEQ ID NO: 51887 - protein, 25 aa, synthetic construct
  source 1..25: note = Seed: QTVHSIPLTINKEEALQRPVASDFE
QTVHSIPWTIIKFEAIQRPVASDFE

SEQ ID NO: 51888 - protein, 25 aa, synthetic construct
  source 1..25: note = Seed: QTVHSIPLTINKEEALQRPVASDFE
QTVHSIPWTIIKFEALQRPVASDFE

SEQ ID NO: 51889 - protein, 25 aa, synthetic construct
  source 1..25: note = Seed: QTVHSIPLTINKEEALQRPVASDFE
QTVHSIPWTIIKFEAMQRPVASDFE

SEQ ID NO: 51890 - protein, 25 aa, synthetic construct
  source 1..25: note = Seed: QTVHSIPLTINKEEALQRPVASDFE
QTVHSIPWTIIKFEANQRPVASDFE

SEQ ID NO: 51891 - protein, 25 aa, synthetic construct
  source 1..25: note = Seed: QTVHSIPLTINKEEALQRPVASDFE
QTVHSIPWTIIKFEATQRPVASDFE

SEQ ID NO: 51892 - protein, 25 aa, synthetic construct
  source 1..25: note = Seed: QTVHSIPLTINKEEALQRPVASDFE
QTVHSIPWTIIKFEAVQRPVASDFE

SEQ ID NO: 51893 - protein, 25 aa, synthetic construct
  source 1..25: note = Seed: QTVHSIPLTINKEEALQRPVASDFE
QTVHSIPWTIIKFEAYQRPVASDFE

SEQ ID NO: 51894 - protein, 25 aa, synthetic construct
  source 1..25: note = Seed: QTVHSIPLTINKEEALQRPVASDFE
QTVHSIPWTIIKIEAFQRPVASDFE

SEQ ID NO: 51895 - protein, 25 aa, synthetic construct
  source 1..25: note = Seed: QTVHSIPLTINKEEALQRPVASDFE
QTVHSIPWTIIKLEAFQRPVASDFE

SEQ ID NO: 51896 - protein, 25 aa, synthetic construct
  source 1..25: note = Seed: QTVHSIPLTINKEEALQRPVASDFE
QTVHSIPWTIIKLEAIQRPVASDFE

SEQ ID NO: 51897 - protein, 25 aa, synthetic construct
  source 1..25: note = Seed: QTVHSIPLTINKEEALQRPVASDFE
QTVHSIPWTIIKLEALQRPVASDFE

SEQ ID NO: 51898 - protein, 25 aa, synthetic construct
  source 1..25: note = Seed: QTVHSIPLTINKEEALQRPVASDFE
QTVHSIPWTIIKMEAFQRPVASDFE

SEQ ID NO: 51899 - protein, 25 aa, synthetic construct
  source 1..25: note = Seed: QTVHSIPLTINKEEALQRPVASDFE
QTVHSIPWTIIKWEALQRPVASDFE

SEQ ID NO: 51900 - protein, 25 aa, synthetic construct
  source 1..25: note = Seed: QTVHSIPLTINKEEALQRPVASDFE
QTVHSIPWTIIKYEAFQRPVASDFE

SEQ ID NO: 51901 - protein, 25 aa, synthetic construct
  source 1..25: note = Seed: QTVHSIPLTINKEEALQRPVASDFE
QTVHSIPWTIIKYEAIQRPVASDFE

SEQ ID NO: 51902 - protein, 25 aa, synthetic construct
  source 1..25: note = Seed: QTVHSIPLTINKEEALQRPVASDFE
QTVHSIPWTIIKYEALQRPVASDFE

SEQ ID NO: 51903 - protein, 25 aa, synthetic construct
  source 1..25: note = Seed: QTVHSIPLTINKEEALQRPVASDFE
QTVHSIPWTIIKYEAVQRPVASDFE

SEQ ID NO: 51904 - protein, 25 aa, synthetic construct
  source 1..25: note = Seed: QTVHSIPLTINKEEALQRPVASDFE
QTVHSIPWTIKKFEALQRPVASDFE

SEQ ID NO: 51905 - protein, 25 aa, synthetic construct
  source 1..25: note = Seed: QTVHSIPLTINKEEALQRPVASDFE
QTVHSIPWTILKAEAFQRPVASDFE

SEQ ID NO: 51906 - protein, 25 aa, synthetic construct
  source 1..25: note = Seed: QTVHSIPLTINKEEALQRPVASDFE
QTVHSIPWTILKFEAAQRPVASDFE

SEQ ID NO: 51907 - protein, 25 aa, synthetic construct
  source 1..25: note = Seed: QTVHSIPLTINKEEALQRPVASDFE
QTVHSIPWTILKFEAEQRPVASDFE

SEQ ID NO: 51908 - protein, 25 aa, synthetic construct
  source 1..25: note = Seed: QTVHSIPLTINKEEALQRPVASDFE
QTVHSIPWTILKFEAFQRPVASDFE

SEQ ID NO: 51909 - protein, 25 aa, synthetic construct
  source 1..25: note = Seed: QTVHSIPLTINKEEALQRPVASDFE
QTVHSIPWTILKFEAIQRPVASDFE

SEQ ID NO: 51910 - protein, 25 aa, synthetic construct
  source 1..25: note = Seed: QTVHSIPLTINKEEALQRPVASDFE
QTVHSIPWTILKFEALQRPVASDFE

SEQ ID NO: 51911 - protein, 25 aa, synthetic construct
  source 1..25: note = Seed: QTVHSIPLTINKEEALQRPVASDFE
QTVHSIPWTILKFEAMQRPVASDFE

SEQ ID NO: 51912 - protein, 25 aa, synthetic construct
  source 1..25: note = Seed: QTVHSIPLTINKEEALQRPVASDFE
QTVHSIPWTILKFEAVQRPVASDFE

SEQ ID NO: 51913 - protein, 25 aa, synthetic construct
  source 1..25: note = Seed: QTVHSIPLTINKEEALQRPVASDFE
QTVHSIPWTILKFEAWQRPVASDFE

SEQ ID NO: 51914 - protein, 25 aa, synthetic construct
  source 1..25: note = Seed: QTVHSIPLTINKEEALQRPVASDFE
QTVHSIPWTILKFEAYQRPVASDFE

SEQ ID NO: 51915 - protein, 25 aa, synthetic construct
  source 1..25: note = Seed: QTVHSIPLTINKEEALQRPVASDFE
QTVHSIPWTILKIEAFQRPVASDFE

SEQ ID NO: 51916 - protein, 25 aa, synthetic construct
  source 1..25: note = Seed: QTVHSIPLTINKEEALQRPVASDFE
QTVHSIPWTILKIEALQRPVASDFE

SEQ ID NO: 51917 - protein, 25 aa, synthetic construct
  source 1..25: note = Seed: QTVHSIPLTINKEEALQRPVASDFE
QTVHSIPWTILKLEAFQRPVASDFE

SEQ ID NO: 51918 - protein, 25 aa, synthetic construct
  source 1..25: note = Seed: QTVHSIPLTINKEEALQRPVASDFE
QTVHSIPWTILKLEAIQRPVASDFE

SEQ ID NO: 51919 - protein, 25 aa, synthetic construct
  source 1..25: note = Seed: QTVHSIPLTINKEEALQRPVASDFE
QTVHSIPWTILKLEALQRPVASDFE

SEQ ID NO: 51920 - protein, 25 aa, synthetic construct
  source 1..25: note = Seed: QTVHSIPLTINKEEALQRPVASDFE
QTVHSIPWTILKMEAFQRPVASDFE

SEQ ID NO: 51921 - protein, 25 aa, synthetic construct
  source 1..25: note = Seed: QTVHSIPLTINKEEALQRPVASDFE
QTVHSIPWTILKVEAFQRPVASDFE

SEQ ID NO: 51922 - protein, 25 aa, synthetic construct
  source 1..25: note = Seed: QTVHSIPLTINKEEALQRPVASDFE
QTVHSIPWTILKWEALQRPVASDFE

SEQ ID NO: 51923 - protein, 25 aa, synthetic construct
  source 1..25: note = Seed: QTVHSIPLTINKEEALQRPVASDFE
QTVHSIPWTILKYEAFQRPVASDFE

SEQ ID NO: 51924 - protein, 25 aa, synthetic construct
  source 1..25: note = Seed: QTVHSIPLTINKEEALQRPVASDFE
QTVHSIPWTILKYEAIQRPVASDFE

SEQ ID NO: 51925 - protein, 25 aa, synthetic construct
  source 1..25: note = Seed: QTVHSIPLTINKEEALQRPVASDFE
QTVHSIPWTILKYEALQRPVASDFE

SEQ ID NO: 51926 - protein, 25 aa, synthetic construct
  source 1..25: note = Seed: QTVHSIPLTINKEEALQRPVASDFE
QTVHSIPWTIMKFEAFQRPVASDFE

SEQ ID NO: 51927 - protein, 25 aa, synthetic construct
  source 1..25: note = Seed: QTVHSIPLTINKEEALQRPVASDFE
QTVHSIPWTIMKFEAIQRPVASDFE

SEQ ID NO: 51928 - protein, 25 aa, synthetic construct
  source 1..25: note = Seed: QTVHSIPLTINKEEALQRPVASDFE
QTVHSIPWTIMKFEALQRPVASDFE

SEQ ID NO: 51929 - protein, 25 aa, synthetic construct
  source 1..25: note = Seed: QTVHSIPLTINKEEALQRPVASDFE
QTVHSIPWTIMKFEAMQRPVASDFE

SEQ ID NO: 51930 - protein, 25 aa, synthetic construct
  source 1..25: note = Seed: QTVHSIPLTINKEEALQRPVASDFE
QTVHSIPWTIMKFEAVQRPVASDFE

SEQ ID NO: 51931 - protein, 25 aa, synthetic construct
  source 1..25: note = Seed: QTVHSIPLTINKEEALQRPVASDFE
QTVHSIPWTIMKFEAYQRPVASDFE

SEQ ID NO: 51932 - protein, 25 aa, synthetic construct
  source 1..25: note = Seed: QTVHSIPLTINKEEALQRPVASDFE
QTVHSIPWTIMKIEAIQRPVASDFE

SEQ ID NO: 51933 - protein, 25 aa, synthetic construct
  source 1..25: note = Seed: QTVHSIPLTINKEEALQRPVASDFE
QTVHSIPWTIMKIEAVQRPVASDFE

SEQ ID NO: 51934 - protein, 25 aa, synthetic construct
  source 1..25: note = Seed: QTVHSIPLTINKEEALQRPVASDFE
QTVHSIPWTIMKLEAFQRPVASDFE

SEQ ID NO: 51935 - protein, 25 aa, synthetic construct
  source 1..25: note = Seed: QTVHSIPLTINKEEALQRPVASDFE
QTVHSIPWTIMKLEALQRPVASDFE

SEQ ID NO: 51936 - protein, 25 aa, synthetic construct
  source 1..25: note = Seed: QTVHSIPLTINKEEALQRPVASDFE
QTVHSIPWTIMKWEAFQRPVASDFE

SEQ ID NO: 51937 - protein, 25 aa, synthetic construct
  source 1..25: note = Seed: QTVHSIPLTINKEEALQRPVASDFE
QTVHSIPWTIMKYEAFQRPVASDFE

SEQ ID NO: 51938 - protein, 25 aa, synthetic construct
  source 1..25: note = Seed: QTVHSIPLTINKEEALQRPVASDFE
QTVHSIPWTINKAEAIQRPVASDFE

SEQ ID NO: 51939 - protein, 25 aa, synthetic construct
  source 1..25: note = Seed: QTVHSIPLTINKEEALQRPVASDFE
QTVHSIPWTINKAEALQRPVASDFE

SEQ ID NO: 51940 - protein, 25 aa, synthetic construct
  source 1..25: note = Seed: QTVHSIPLTINKEEALQRPVASDFE
QTVHSIPWTINKAEAVQRPVASDFE

SEQ ID NO: 51941 - protein, 25 aa, synthetic construct
  source 1..25: note = Seed: QTVHSIPLTINKEEALQRPVASDFE
QTVHSIPWTINKFEAFQRPVASDFE

SEQ ID NO: 51942 - protein, 25 aa, synthetic construct
  source 1..25: note = Seed: QTVHSIPLTINKEEALQRPVASDFE
QTVHSIPWTINKFEAIQRPVASDFE

SEQ ID NO: 51943 - protein, 25 aa, synthetic construct
  source 1..25: note = Seed: QTVHSIPLTINKEEALQRPVASDFE
QTVHSIPWTINKFEALQRPVASDFE

SEQ ID NO: 51944 - protein, 25 aa, synthetic construct
  source 1..25: note = Seed: QTVHSIPLTINKEEALQRPVASDFE
QTVHSIPWTINKFEAVQRPVASDFE

SEQ ID NO: 51945 - protein, 25 aa, synthetic construct
  source 1..25: note = Seed: QTVHSIPLTINKEEALQRPVASDFE
QTVHSIPWTINKIEAIQRPVASDFE

SEQ ID NO: 51946 - protein, 25 aa, synthetic construct
  source 1..25: note = Seed: QTVHSIPLTINKEEALQRPVASDFE
QTVHSIPWTINKNEAFQRPVASDFE

SEQ ID NO: 51947 - protein, 25 aa, synthetic construct
  source 1..25: note = Seed: QTVHSIPLTINKEEALQRPVASDFE
QTVHSIPWTINKNEAIQRPVASDFE

SEQ ID NO: 51948 - protein, 25 aa, synthetic construct
  source 1..25: note = Seed: QTVHSIPLTINKEEALQRPVASDFE
QTVHSIPWTINKNEALQRPVASDFE

SEQ ID NO: 51949 - protein, 25 aa, synthetic construct
  source 1..25: note = Seed: QTVHSIPLTINKEEALQRPVASDFE
QTVHSIPWTINKNEAVQRPVASDFE

SEQ ID NO: 51950 - protein, 25 aa, synthetic construct
  source 1..25: note = Seed: QTVHSIPLTINKEEALQRPVASDFE
QTVHSIPWTINKSEAIQRPVASDFE

SEQ ID NO: 51951 - protein, 25 aa, synthetic construct
  source 1..25: note = Seed: QTVHSIPLTINKEEALQRPVASDFE
QTVHSIPWTINKSEALQRPVASDFE

SEQ ID NO: 51952 - protein, 25 aa, synthetic construct
  source 1..25: note = Seed: QTVHSIPLTINKEEALQRPVASDFE
QTVHSIPWTINKSEAVQRPVASDFE

SEQ ID NO: 51953 - protein, 25 aa, synthetic construct
  source 1..25: note = Seed: QTVHSIPLTINKEEALQRPVASDFE
QTVHSIPWTINKTEAIQRPVASDFE

SEQ ID NO: 51954 - protein, 25 aa, synthetic construct
  source 1..25: note = Seed: QTVHSIPLTINKEEALQRPVASDFE
QTVHSIPWTINKVEAIQRPVASDFE

SEQ ID NO: 51955 - protein, 25 aa, synthetic construct
  source 1..25: note = Seed: QTVHSIPLTINKEEALQRPVASDFE
QTVHSIPWTIQKFEAFQRPVASDFE

SEQ ID NO: 51956 - protein, 25 aa, synthetic construct
  source 1..25: note = Seed: QTVHSIPLTINKEEALQRPVASDFE
QTVHSIPWTIQKFEAIQRPVASDFE

SEQ ID NO: 51957 - protein, 25 aa, synthetic construct
  source 1..25: note = Seed: QTVHSIPLTINKEEALQRPVASDFE
QTVHSIPWTIQKFEALQRPVASDFE

SEQ ID NO: 51958 - protein, 25 aa, synthetic construct
  source 1..25: note = Seed: QTVHSIPLTINKEEALQRPVASDFE
QTVHSIPWTIQKFEAMQRPVASDFE

SEQ ID NO: 51959 - protein, 25 aa, synthetic construct
  source 1..25: note = Seed: QTVHSIPLTINKEEALQRPVASDFE
QTVHSIPWTIQKFEAVQRPVASDFE

SEQ ID NO: 51960 - protein, 25 aa, synthetic construct
  source 1..25: note = Seed: QTVHSIPLTINKEEALQRPVASDFE
QTVHSIPWTISKFEAFQRPVASDFE

SEQ ID NO: 51961 - protein, 25 aa, synthetic construct
  source 1..25: note = Seed: QTVHSIPLTINKEEALQRPVASDFE
QTVHSIPWTISKFEAIQRPVASDFE

SEQ ID NO: 51962 - protein, 25 aa, synthetic construct
  source 1..25: note = Seed: QTVHSIPLTINKEEALQRPVASDFE
QTVHSIPWTISKFEALQRPVASDFE

SEQ ID NO: 51963 - protein, 25 aa, synthetic construct
  source 1..25: note = Seed: QTVHSIPLTINKEEALQRPVASDFE
QTVHSIPWTISKFEAMQRPVASDFE

SEQ ID NO: 51964 - protein, 25 aa, synthetic construct
  source 1..25: note = Seed: QTVHSIPLTINKEEALQRPVASDFE
QTVHSIPWTISKFEAVQRPVASDFE

SEQ ID NO: 51965 - protein, 25 aa, synthetic construct
  source 1..25: note = Seed: QTVHSIPLTINKEEALQRPVASDFE
QTVHSIPWTITKFEAAQRPVASDFE

SEQ ID NO: 51966 - protein, 25 aa, synthetic construct
  source 1..25: note = Seed: QTVHSIPLTINKEEALQRPVASDFE
QTVHSIPWTITKFEAFQRPVASDFE

SEQ ID NO: 51967 - protein, 25 aa, synthetic construct
  source 1..25: note = Seed: QTVHSIPLTINKEEALQRPVASDFE
QTVHSIPWTITKFEAIQRPVASDFE

SEQ ID NO: 51968 - protein, 25 aa, synthetic construct
  source 1..25: note = Seed: QTVHSIPLTINKEEALQRPVASDFE
QTVHSIPWTITKFEALQRPVASDFE

SEQ ID NO: 51969 - protein, 25 aa, synthetic construct
  source 1..25: note = Seed: QTVHSIPLTINKEEALQRPVASDFE
QTVHSIPWTITKFEAMQRPVASDFE

SEQ ID NO: 51970 - protein, 25 aa, synthetic construct
  source 1..25: note = Seed: QTVHSIPLTINKEEALQRPVASDFE
QTVHSIPWTITKFEATQRPVASDFE

SEQ ID NO: 51971 - protein, 25 aa, synthetic construct
  source 1..25: note = Seed: QTVHSIPLTINKEEALQRPVASDFE
QTVHSIPWTITKFEAVQRPVASDFE

SEQ ID NO: 51972 - protein, 25 aa, synthetic construct
  source 1..25: note = Seed: QTVHSIPLTINKEEALQRPVASDFE
QTVHSIPWTITKFEAYQRPVASDFE

SEQ ID NO: 51973 - protein, 25 aa, synthetic construct
  source 1..25: note = Seed: QTVHSIPLTINKEEALQRPVASDFE
QTVHSIPWTIVKFEAAQRPVASDFE

SEQ ID NO: 51974 - protein, 25 aa, synthetic construct
  source 1..25: note = Seed: QTVHSIPLTINKEEALQRPVASDFE
QTVHSIPWTIVKFEAFQRPVASDFE

SEQ ID NO: 51975 - protein, 25 aa, synthetic construct
  source 1..25: note = Seed: QTVHSIPLTINKEEALQRPVASDFE
QTVHSIPWTIVKFEAIQRPVASDFE

SEQ ID NO: 51976 - protein, 25 aa, synthetic construct
  source 1..25: note = Seed: QTVHSIPLTINKEEALQRPVASDFE
QTVHSIPWTIVKFEALQRPVASDFE

SEQ ID NO: 51977 - protein, 25 aa, synthetic construct
  source 1..25: note = Seed: QTVHSIPLTINKEEALQRPVASDFE
QTVHSIPWTIVKFEAMQRPVASDFE

SEQ ID NO: 51978 - protein, 25 aa, synthetic construct
  source 1..25: note = Seed: QTVHSIPLTINKEEALQRPVASDFE
QTVHSIPWTIVKFEANQRPVASDFE

SEQ ID NO: 51979 - protein, 25 aa, synthetic construct
  source 1..25: note = Seed: QTVHSIPLTINKEEALQRPVASDFE
QTVHSIPWTIVKFEATQRPVASDFE

SEQ ID NO: 51980 - protein, 25 aa, synthetic construct
  source 1..25: note = Seed: QTVHSIPLTINKEEALQRPVASDFE
QTVHSIPWTIVKFEAVQRPVASDFE

SEQ ID NO: 51981 - protein, 25 aa, synthetic construct
  source 1..25: note = Seed: QTVHSIPLTINKEEALQRPVASDFE
QTVHSIPWTIVKFEAYQRPVASDFE

SEQ ID NO: 51982 - protein, 25 aa, synthetic construct
  source 1..25: note = Seed: QTVHSIPLTINKEEALQRPVASDFE
QTVHSIPWTIVKLEAFQRPVASDFE

SEQ ID NO: 51983 - protein, 25 aa, synthetic construct
  source 1..25: note = Seed: QTVHSIPLTINKEEALQRPVASDFE
QTVHSIPWTIVKWEAFQRPVASDFE

SEQ ID NO: 51984 - protein, 25 aa, synthetic construct
  source 1..25: note = Seed: QTVHSIPLTINKEEALQRPVASDFE
QTVHSIPWTIVKYEAFQRPVASDFE

SEQ ID NO: 51985 - protein, 25 aa, synthetic construct
  source 1..25: note = Seed: QTVHSIPLTINKEEALQRPVASDFE
QTVHSIPWTIVKYEAIQRPVASDFE

SEQ ID NO: 51986 - protein, 25 aa, synthetic construct
  source 1..25: note = Seed: QTVHSIPLTINKEEALQRPVASDFE
QTVHSIPWTIVKYEALQRPVASDFE

SEQ ID NO: 51987 - protein, 25 aa, synthetic construct
  source 1..25: note = Seed: QTVHSIPLTINKEEALQRPVASDFE
QTVHSIPWTIVKYEAVQRPVASDFE

SEQ ID NO: 51988 - protein, 25 aa, synthetic construct
  source 1..25: note = Seed: QTVHSIPLTINKEEALQRPVASDFE
QTVHSIPWTIWKFEAFQRPVASDFE

SEQ ID NO: 51989 - protein, 25 aa, synthetic construct
  source 1..25: note = Seed: QTVHSIPLTINKEEALQRPVASDFE
QTVHSIPWTIWKFEAIQRPVASDFE

SEQ ID NO: 51990 - protein, 25 aa, synthetic construct
  source 1..25: note = Seed: QTVHSIPLTINKEEALQRPVASDFE
QTVHSIPWTIWKFEALQRPVASDFE

SEQ ID NO: 51991 - protein, 25 aa, synthetic construct
  source 1..25: note = Seed: QTVHSIPLTINKEEALQRPVASDFE
QTVHSIPWTIWKFEAMQRPVASDFE

SEQ ID NO: 51992 - protein, 25 aa, synthetic construct
  source 1..25: note = Seed: QTVHSIPLTINKEEALQRPVASDFE
QTVHSIPWTIWKFEAVQRPVASDFE

SEQ ID NO: 51993 - protein, 25 aa, synthetic construct
  source 1..25: note = Seed: QTVHSIPLTINKEEALQRPVASDFE
QTVHSIPWTIWKIEAIQRPVASDFE

SEQ ID NO: 51994 - protein, 25 aa, synthetic construct
  source 1..25: note = Seed: QTVHSIPLTINKEEALQRPVASDFE
QTVHSIPWTIWKLEAFQRPVASDFE

SEQ ID NO: 51995 - protein, 25 aa, synthetic construct
  source 1..25: note = Seed: QTVHSIPLTINKEEALQRPVASDFE
QTVHSIPWTIWKYEAFQRPVASDFE

SEQ ID NO: 51996 - protein, 25 aa, synthetic construct
  source 1..25: note = Seed: QTVHSIPLTINKEEALQRPVASDFE
QTVHSIPWTIYKFEAFQRPVASDFE

SEQ ID NO: 51997 - protein, 25 aa, synthetic construct
  source 1..25: note = Seed: QTVHSIPLTINKEEALQRPVASDFE
QTVHSIPWTIYKFEAIQRPVASDFE

SEQ ID NO: 51998 - protein, 25 aa, synthetic construct
  source 1..25: note = Seed: QTVHSIPLTINKEEALQRPVASDFE
QTVHSIPWTIYKFEALQRPVASDFE

SEQ ID NO: 51999 - protein, 25 aa, synthetic construct
  source 1..25: note = Seed: QTVHSIPLTINKEEALQRPVASDFE
QTVHSIPWTIYKFEAMQRPVASDFE

SEQ ID NO: 52000 - protein, 25 aa, synthetic construct
  source 1..25: note = Seed: QTVHSIPLTINKEEALQRPVASDFE
QTVHSIPWTIYKFEAVQRPVASDFE

SEQ ID NO: 52001 - protein, 25 aa, synthetic construct
  source 1..25: note = Seed: QTVHSIPLTINKEEALQRPVASDFE
QTVHSIPWTIYKFEAYQRPVASDFE

SEQ ID NO: 52002 - protein, 25 aa, synthetic construct
  source 1..25: note = Seed: QTVHSIPLTINKEEALQRPVASDFE
QTVHSIPWTIYKLEAFQRPVASDFE

SEQ ID NO: 52003 - protein, 25 aa, synthetic construct
  source 1..25: note = Seed: QTVHSIPLTINKEEALQRPVASDFE
QTVHSIPWTIYKYEAFQRPVASDFE

SEQ ID NO: 52004 - protein, 25 aa, synthetic construct
  source 1..25: note = Seed: QTVHSIPLTINKEEALQRPVASDFE
QTVHSIPWTIYKYEALQRPVASDFE

SEQ ID NO: 52005 - protein, 25 aa, synthetic construct
  source 1..25: note = Seed: QTVHSIPLTINKEEALQRPVASDFE
QTVHSIPYTIAKFEAFQRPVASDFE

SEQ ID NO: 52006 - protein, 25 aa, synthetic construct
  source 1..25: note = Seed: QTVHSIPLTINKEEALQRPVASDFE
QTVHSIPYTIAKFEAIQRPVASDFE

SEQ ID NO: 52007 - protein, 25 aa, synthetic construct
  source 1..25: note = Seed: QTVHSIPLTINKEEALQRPVASDFE
QTVHSIPYTIAKFEALQRPVASDFE

SEQ ID NO: 52008 - protein, 25 aa, synthetic construct
  source 1..25: note = Seed: QTVHSIPLTINKEEALQRPVASDFE
QTVHSIPYTIAKFEAMQRPVASDFE

SEQ ID NO: 52009 - protein, 25 aa, synthetic construct
  source 1..25: note = Seed: QTVHSIPLTINKEEALQRPVASDFE
QTVHSIPYTIAKFEAVQRPVASDFE

SEQ ID NO: 52010 - protein, 25 aa, synthetic construct
  source 1..25: note = Seed: QTVHSIPLTINKEEALQRPVASDFE
QTVHSIPYTIEKFEAFQRPVASDFE

SEQ ID NO: 52011 - protein, 25 aa, synthetic construct
  source 1..25: note = Seed: QTVHSIPLTINKEEALQRPVASDFE
QTVHSIPYTIEKFEAIQRPVASDFE

SEQ ID NO: 52012 - protein, 25 aa, synthetic construct
  source 1..25: note = Seed: QTVHSIPLTINKEEALQRPVASDFE
QTVHSIPYTIEKFEALQRPVASDFE

SEQ ID NO: 52013 - protein, 25 aa, synthetic construct
  source 1..25: note = Seed: QTVHSIPLTINKEEALQRPVASDFE
QTVHSIPYTIEKFEAMQRPVASDFE

SEQ ID NO: 52014 - protein, 25 aa, synthetic construct
  source 1..25: note = Seed: QTVHSIPLTINKEEALQRPVASDFE
QTVHSIPYTIEKFEAVQRPVASDFE

SEQ ID NO: 52015 - protein, 25 aa, synthetic construct
  source 1..25: note = Seed: QTVHSIPLTINKEEALQRPVASDFE
QTVHSIPYTIFKAEAFQRPVASDFE

SEQ ID NO: 52016 - protein, 25 aa, synthetic construct
  source 1..25: note = Seed: QTVHSIPLTINKEEALQRPVASDFE
QTVHSIPYTIFKAEALQRPVASDFE

SEQ ID NO: 52017 - protein, 25 aa, synthetic construct
  source 1..25: note = Seed: QTVHSIPLTINKEEALQRPVASDFE
QTVHSIPYTIFKFEAAQRPVASDFE

SEQ ID NO: 52018 - protein, 25 aa, synthetic construct
  source 1..25: note = Seed: QTVHSIPLTINKEEALQRPVASDFE
QTVHSIPYTIFKFEAEQRPVASDFE

SEQ ID NO: 52019 - protein, 25 aa, synthetic construct
  source 1..25: note = Seed: QTVHSIPLTINKEEALQRPVASDFE
QTVHSIPYTIFKFEAFQRPVASDFE

SEQ ID NO: 52020 - protein, 25 aa, synthetic construct
  source 1..25: note = Seed: QTVHSIPLTINKEEALQRPVASDFE
QTVHSIPYTIFKFEAIQRPVASDFE

SEQ ID NO: 52021 - protein, 25 aa, synthetic construct
  source 1..25: note = Seed: QTVHSIPLTINKEEALQRPVASDFE
QTVHSIPYTIFKFEALQRPVASDFE

SEQ ID NO: 52022 - protein, 25 aa, synthetic construct
  source 1..25: note = Seed: QTVHSIPLTINKEEALQRPVASDFE
QTVHSIPYTIFKFEAMQRPVASDFE

SEQ ID NO: 52023 - protein, 25 aa, synthetic construct
  source 1..25: note = Seed: QTVHSIPLTINKEEALQRPVASDFE
QTVHSIPYTIFKFEANQRPVASDFE

SEQ ID NO: 52024 - protein, 25 aa, synthetic construct
  source 1..25: note = Seed: QTVHSIPLTINKEEALQRPVASDFE
QTVHSIPYTIFKFEASQRPVASDFE

SEQ ID NO: 52025 - protein, 25 aa, synthetic construct
  source 1..25: note = Seed: QTVHSIPLTINKEEALQRPVASDFE
QTVHSIPYTIFKFEATQRPVASDFE

SEQ ID NO: 52026 - protein, 25 aa, synthetic construct
  source 1..25: note = Seed: QTVHSIPLTINKEEALQRPVASDFE
QTVHSIPYTIFKFEAVQRPVASDFE

SEQ ID NO: 52027 - protein, 25 aa, synthetic construct
  source 1..25: note = Seed: QTVHSIPLTINKEEALQRPVASDFE
QTVHSIPYTIFKFEAWQRPVASDFE

SEQ ID NO: 52028 - protein, 25 aa, synthetic construct
  source 1..25: note = Seed: QTVHSIPLTINKEEALQRPVASDFE
QTVHSIPYTIFKFEAYQRPVASDFE

SEQ ID NO: 52029 - protein, 25 aa, synthetic construct
  source 1..25: note = Seed: QTVHSIPLTINKEEALQRPVASDFE
QTVHSIPYTIFKIEAFQRPVASDFE

SEQ ID NO: 52030 - protein, 25 aa, synthetic construct
  source 1..25: note = Seed: QTVHSIPLTINKEEALQRPVASDFE
QTVHSIPYTIFKIEAIQRPVASDFE

SEQ ID NO: 52031 - protein, 25 aa, synthetic construct
  source 1..25: note = Seed: QTVHSIPLTINKEEALQRPVASDFE
QTVHSIPYTIFKIEALQRPVASDFE

SEQ ID NO: 52032 - protein, 25 aa, synthetic construct
  source 1..25: note = Seed: QTVHSIPLTINKEEALQRPVASDFE
QTVHSIPYTIFKIEAMQRPVASDFE

SEQ ID NO: 52033 - protein, 25 aa, synthetic construct
  source 1..25: note = Seed: QTVHSIPLTINKEEALQRPVASDFE
QTVHSIPYTIFKIEAVQRPVASDFE

SEQ ID NO: 52034 - protein, 25 aa, synthetic construct
  source 1..25: note = Seed: QTVHSIPLTINKEEALQRPVASDFE
QTVHSIPYTIFKIEAYQRPVASDFE

SEQ ID NO: 52035 - protein, 25 aa, synthetic construct
  source 1..25: note = Seed: QTVHSIPLTINKEEALQRPVASDFE
QTVHSIPYTIFKLEAFQRPVASDFE

SEQ ID NO: 52036 - protein, 25 aa, synthetic construct
  source 1..25: note = Seed: QTVHSIPLTINKEEALQRPVASDFE
QTVHSIPYTIFKLEAIQRPVASDFE

SEQ ID NO: 52037 - protein, 25 aa, synthetic construct
  source 1..25: note = Seed: QTVHSIPLTINKEEALQRPVASDFE
QTVHSIPYTIFKLEALQRPVASDFE

SEQ ID NO: 52038 - protein, 25 aa, synthetic construct
  source 1..25: note = Seed: QTVHSIPLTINKEEALQRPVASDFE
QTVHSIPYTIFKLEAMQRPVASDFE

SEQ ID NO: 52039 - protein, 25 aa, synthetic construct
  source 1..25: note = Seed: QTVHSIPLTINKEEALQRPVASDFE
QTVHSIPYTIFKLEAVQRPVASDFE

SEQ ID NO: 52040 - protein, 25 aa, synthetic construct
  source 1..25: note = Seed: QTVHSIPLTINKEEALQRPVASDFE
QTVHSIPYTIFKLEAWQRPVASDFE

SEQ ID NO: 52041 - protein, 25 aa, synthetic construct
  source 1..25: note = Seed: QTVHSIPLTINKEEALQRPVASDFE
QTVHSIPYTIFKLEAYQRPVASDFE

SEQ ID NO: 52042 - protein, 25 aa, synthetic construct
  source 1..25: note = Seed: QTVHSIPLTINKEEALQRPVASDFE
QTVHSIPYTIFKMEAFQRPVASDFE

SEQ ID NO: 52043 - protein, 25 aa, synthetic construct
  source 1..25: note = Seed: QTVHSIPLTINKEEALQRPVASDFE
QTVHSIPYTIFKMEAIQRPVASDFE

SEQ ID NO: 52044 - protein, 25 aa, synthetic construct
  source 1..25: note = Seed: QTVHSIPLTINKEEALQRPVASDFE
QTVHSIPYTIFKMEALQRPVASDFE

SEQ ID NO: 52045 - protein, 25 aa, synthetic construct
  source 1..25: note = Seed: QTVHSIPLTINKEEALQRPVASDFE
QTVHSIPYTIFKMEAMQRPVASDFE

SEQ ID NO: 52046 - protein, 25 aa, synthetic construct
  source 1..25: note = Seed: QTVHSIPLTINKEEALQRPVASDFE
QTVHSIPYTIFKMEAVQRPVASDFE

SEQ ID NO: 52047 - protein, 25 aa, synthetic construct
  source 1..25: note = Seed: QTVHSIPLTINKEEALQRPVASDFE
QTVHSIPYTIFKVEAFQRPVASDFE

SEQ ID NO: 52048 - protein, 25 aa, synthetic construct
  source 1..25: note = Seed: QTVHSIPLTINKEEALQRPVASDFE
QTVHSIPYTIFKVEAIQRPVASDFE

SEQ ID NO: 52049 - protein, 25 aa, synthetic construct
  source 1..25: note = Seed: QTVHSIPLTINKEEALQRPVASDFE
QTVHSIPYTIFKVEALQRPVASDFE

SEQ ID NO: 52050 - protein, 25 aa, synthetic construct
  source 1..25: note = Seed: QTVHSIPLTINKEEALQRPVASDFE
QTVHSIPYTIFKWEAFQRPVASDFE

SEQ ID NO: 52051 - protein, 25 aa, synthetic construct
  source 1..25: note = Seed: QTVHSIPLTINKEEALQRPVASDFE
QTVHSIPYTIFKWEAIQRPVASDFE

SEQ ID NO: 52052 - protein, 25 aa, synthetic construct
  source 1..25: note = Seed: QTVHSIPLTINKEEALQRPVASDFE
QTVHSIPYTIFKWEALQRPVASDFE

SEQ ID NO: 52053 - protein, 25 aa, synthetic construct
  source 1..25: note = Seed: QTVHSIPLTINKEEALQRPVASDFE
QTVHSIPYTIFKWEAMQRPVASDFE

SEQ ID NO: 52054 - protein, 25 aa, synthetic construct
  source 1..25: note = Seed: QTVHSIPLTINKEEALQRPVASDFE
QTVHSIPYTIFKWEAVQRPVASDFE

SEQ ID NO: 52055 - protein, 25 aa, synthetic construct
  source 1..25: note = Seed: QTVHSIPLTINKEEALQRPVASDFE
QTVHSIPYTIFKYEAFQRPVASDFE

SEQ ID NO: 52056 - protein, 25 aa, synthetic construct
  source 1..25: note = Seed: QTVHSIPLTINKEEALQRPVASDFE
QTVHSIPYTIFKYEAIQRPVASDFE

SEQ ID NO: 52057 - protein, 25 aa, synthetic construct
  source 1..25: note = Seed: QTVHSIPLTINKEEALQRPVASDFE
QTVHSIPYTIFKYEALQRPVASDFE

SEQ ID NO: 52058 - protein, 25 aa, synthetic construct
  source 1..25: note = Seed: QTVHSIPLTINKEEALQRPVASDFE
QTVHSIPYTIFKYEAMQRPVASDFE

SEQ ID NO: 52059 - protein, 25 aa, synthetic construct
  source 1..25: note = Seed: QTVHSIPLTINKEEALQRPVASDFE
QTVHSIPYTIFKYEAVQRPVASDFE

SEQ ID NO: 52060 - protein, 25 aa, synthetic construct
  source 1..25: note = Seed: QTVHSIPLTINKEEALQRPVASDFE
QTVHSIPYTIFKYEAWQRPVASDFE

SEQ ID NO: 52061 - protein, 25 aa, synthetic construct
  source 1..25: note = Seed: QTVHSIPLTINKEEALQRPVASDFE
QTVHSIPYTIFKYEAYQRPVASDFE

SEQ ID NO: 52062 - protein, 25 aa, synthetic construct
  source 1..25: note = Seed: QTVHSIPLTINKEEALQRPVASDFE
QTVHSIPYTIHKFEAFQRPVASDFE

SEQ ID NO: 52063 - protein, 25 aa, synthetic construct
  source 1..25: note = Seed: QTVHSIPLTINKEEALQRPVASDFE
QTVHSIPYTIHKFEAIQRPVASDFE

SEQ ID NO: 52064 - protein, 25 aa, synthetic construct
  source 1..25: note = Seed: QTVHSIPLTINKEEALQRPVASDFE
QTVHSIPYTIHKFEALQRPVASDFE

SEQ ID NO: 52065 - protein, 25 aa, synthetic construct
  source 1..25: note = Seed: QTVHSIPLTINKEEALQRPVASDFE
QTVHSIPYTIHKFEAMQRPVASDFE

SEQ ID NO: 52066 - protein, 25 aa, synthetic construct
  source 1..25: note = Seed: QTVHSIPLTINKEEALQRPVASDFE
QTVHSIPYTIHKFEAVQRPVASDFE

SEQ ID NO: 52067 - protein, 25 aa, synthetic construct
  source 1..25: note = Seed: QTVHSIPLTINKEEALQRPVASDFE
QTVHSIPYTIIKAEAFQRPVASDFE

SEQ ID NO: 52068 - protein, 25 aa, synthetic construct
  source 1..25: note = Seed: QTVHSIPLTINKEEALQRPVASDFE
QTVHSIPYTIIKFEAAQRPVASDFE

SEQ ID NO: 52069 - protein, 25 aa, synthetic construct
  source 1..25: note = Seed: QTVHSIPLTINKEEALQRPVASDFE
QTVHSIPYTIIKFEADQRPVASDFE

SEQ ID NO: 52070 - protein, 25 aa, synthetic construct
  source 1..25: note = Seed: QTVHSIPLTINKEEALQRPVASDFE
QTVHSIPYTIIKFEAEQRPVASDFE

SEQ ID NO: 52071 - protein, 25 aa, synthetic construct
  source 1..25: note = Seed: QTVHSIPLTINKEEALQRPVASDFE
QTVHSIPYTIIKFEAFQRPVASDFE

SEQ ID NO: 52072 - protein, 25 aa, synthetic construct
  source 1..25: note = Seed: QTVHSIPLTINKEEALQRPVASDFE
QTVHSIPYTIIKFEAIQRPVASDFE

SEQ ID NO: 52073 - protein, 25 aa, synthetic construct
  source 1..25: note = Seed: QTVHSIPLTINKEEALQRPVASDFE
QTVHSIPYTIIKFEALQRPVASDFE

SEQ ID NO: 52074 - protein, 25 aa, synthetic construct
  source 1..25: note = Seed: QTVHSIPLTINKEEALQRPVASDFE
QTVHSIPYTIIKFEAMQRPVASDFE

SEQ ID NO: 52075 - protein, 25 aa, synthetic construct
  source 1..25: note = Seed: QTVHSIPLTINKEEALQRPVASDFE
QTVHSIPYTIIKFEANQRPVASDFE

SEQ ID NO: 52076 - protein, 25 aa, synthetic construct
  source 1..25: note = Seed: QTVHSIPLTINKEEALQRPVASDFE
QTVHSIPYTIIKFEASQRPVASDFE

SEQ ID NO: 52077 - protein, 25 aa, synthetic construct
  source 1..25: note = Seed: QTVHSIPLTINKEEALQRPVASDFE
QTVHSIPYTIIKFEATQRPVASDFE

SEQ ID NO: 52078 - protein, 25 aa, synthetic construct
  source 1..25: note = Seed: QTVHSIPLTINKEEALQRPVASDFE
QTVHSIPYTIIKFEAVQRPVASDFE

SEQ ID NO: 52079 - protein, 25 aa, synthetic construct
  source 1..25: note = Seed: QTVHSIPLTINKEEALQRPVASDFE
QTVHSIPYTIIKFEAWQRPVASDFE

SEQ ID NO: 52080 - protein, 25 aa, synthetic construct
  source 1..25: note = Seed: QTVHSIPLTINKEEALQRPVASDFE
QTVHSIPYTIIKFEAYQRPVASDFE

SEQ ID NO: 52081 - protein, 25 aa, synthetic construct
  source 1..25: note = Seed: QTVHSIPLTINKEEALQRPVASDFE
QTVHSIPYTIIKIEAFQRPVASDFE

SEQ ID NO: 52082 - protein, 25 aa, synthetic construct
  source 1..25: note = Seed: QTVHSIPLTINKEEALQRPVASDFE
QTVHSIPYTIIKIEAIQRPVASDFE

SEQ ID NO: 52083 - protein, 25 aa, synthetic construct
  source 1..25: note = Seed: QTVHSIPLTINKEEALQRPVASDFE
QTVHSIPYTIIKIEALQRPVASDFE

SEQ ID NO: 52084 - protein, 25 aa, synthetic construct
  source 1..25: note = Seed: QTVHSIPLTINKEEALQRPVASDFE
QTVHSIPYTIIKLEAFQRPVASDFE

SEQ ID NO: 52085 - protein, 25 aa, synthetic construct
  source 1..25: note = Seed: QTVHSIPLTINKEEALQRPVASDFE
QTVHSIPYTIIKLEAIQRPVASDFE

SEQ ID NO: 52086 - protein, 25 aa, synthetic construct
  source 1..25: note = Seed: QTVHSIPLTINKEEALQRPVASDFE
QTVHSIPYTIIKLEALQRPVASDFE

SEQ ID NO: 52087 - protein, 25 aa, synthetic construct
  source 1..25: note = Seed: QTVHSIPLTINKEEALQRPVASDFE
QTVHSIPYTIIKLEAVQRPVASDFE

SEQ ID NO: 52088 - protein, 25 aa, synthetic construct
  source 1..25: note = Seed: QTVHSIPLTINKEEALQRPVASDFE
QTVHSIPYTIIKMEAFQRPVASDFE

SEQ ID NO: 52089 - protein, 25 aa, synthetic construct
  source 1..25: note = Seed: QTVHSIPLTINKEEALQRPVASDFE
QTVHSIPYTIIKMEALQRPVASDFE

SEQ ID NO: 52090 - protein, 25 aa, synthetic construct
  source 1..25: note = Seed: QTVHSIPLTINKEEALQRPVASDFE
QTVHSIPYTIIKNEAVQRPVASDFE

SEQ ID NO: 52091 - protein, 25 aa, synthetic construct
  source 1..25: note = Seed: QTVHSIPLTINKEEALQRPVASDFE
QTVHSIPYTIIKVEAFQRPVASDFE

SEQ ID NO: 52092 - protein, 25 aa, synthetic construct
  source 1..25: note = Seed: QTVHSIPLTINKEEALQRPVASDFE
QTVHSIPYTIIKWEAFQRPVASDFE

SEQ ID NO: 52093 - protein, 25 aa, synthetic construct
  source 1..25: note = Seed: QTVHSIPLTINKEEALQRPVASDFE
QTVHSIPYTIIKWEAIQRPVASDFE

SEQ ID NO: 52094 - protein, 25 aa, synthetic construct
  source 1..25: note = Seed: QTVHSIPLTINKEEALQRPVASDFE
QTVHSIPYTIIKWEALQRPVASDFE

SEQ ID NO: 52095 - protein, 25 aa, synthetic construct
  source 1..25: note = Seed: QTVHSIPLTINKEEALQRPVASDFE
QTVHSIPYTIIKWEAVQRPVASDFE

SEQ ID NO: 52096 - protein, 25 aa, synthetic construct
  source 1..25: note = Seed: QTVHSIPLTINKEEALQRPVASDFE
QTVHSIPYTIIKYEAFQRPVASDFE

SEQ ID NO: 52097 - protein, 25 aa, synthetic construct
  source 1..25: note = Seed: QTVHSIPLTINKEEALQRPVASDFE
QTVHSIPYTIIKYEAIQRPVASDFE

SEQ ID NO: 52098 - protein, 25 aa, synthetic construct
  source 1..25: note = Seed: QTVHSIPLTINKEEALQRPVASDFE
QTVHSIPYTIIKYEALQRPVASDFE

SEQ ID NO: 52099 - protein, 25 aa, synthetic construct
  source 1..25: note = Seed: QTVHSIPLTINKEEALQRPVASDFE
QTVHSIPYTIIKYEAMQRPVASDFE

SEQ ID NO: 52100 - protein, 25 aa, synthetic construct
  source 1..25: note = Seed: QTVHSIPLTINKEEALQRPVASDFE
QTVHSIPYTIIKYEAVQRPVASDFE

SEQ ID NO: 52101 - protein, 25 aa, synthetic construct
  source 1..25: note = Seed: QTVHSIPLTINKEEALQRPVASDFE
QTVHSIPYTIIKYEAYQRPVASDFE

SEQ ID NO: 52102 - protein, 25 aa, synthetic construct
  source 1..25: note = Seed: QTVHSIPLTINKEEALQRPVASDFE
QTVHSIPYTIKKFEALQRPVASDFE

SEQ ID NO: 52103 - protein, 25 aa, synthetic construct
  source 1..25: note = Seed: QTVHSIPLTINKEEALQRPVASDFE
QTVHSIPYTILKAEAFQRPVASDFE

SEQ ID NO: 52104 - protein, 25 aa, synthetic construct
  source 1..25: note = Seed: QTVHSIPLTINKEEALQRPVASDFE
QTVHSIPYTILKFEAAQRPVASDFE

SEQ ID NO: 52105 - protein, 25 aa, synthetic construct
  source 1..25: note = Seed: QTVHSIPLTINKEEALQRPVASDFE
QTVHSIPYTILKFEAEQRPVASDFE

SEQ ID NO: 52106 - protein, 25 aa, synthetic construct
  source 1..25: note = Seed: QTVHSIPLTINKEEALQRPVASDFE
QTVHSIPYTILKFEAFQRPVASDFE

SEQ ID NO: 52107 - protein, 25 aa, synthetic construct
  source 1..25: note = Seed: QTVHSIPLTINKEEALQRPVASDFE
QTVHSIPYTILKFEAIQRPVASDFE

SEQ ID NO: 52108 - protein, 25 aa, synthetic construct
  source 1..25: note = Seed: QTVHSIPLTINKEEALQRPVASDFE
QTVHSIPYTILKFEALQRPVASDFE

SEQ ID NO: 52109 - protein, 25 aa, synthetic construct
  source 1..25: note = Seed: QTVHSIPLTINKEEALQRPVASDFE
QTVHSIPYTILKFEAMQRPVASDFE

SEQ ID NO: 52110 - protein, 25 aa, synthetic construct
  source 1..25: note = Seed: QTVHSIPLTINKEEALQRPVASDFE
QTVHSIPYTILKFEANQRPVASDFE

SEQ ID NO: 52111 - protein, 25 aa, synthetic construct
  source 1..25: note = Seed: QTVHSIPLTINKEEALQRPVASDFE
QTVHSIPYTILKFEASQRPVASDFE

SEQ ID NO: 52112 - protein, 25 aa, synthetic construct
  source 1..25: note = Seed: QTVHSIPLTINKEEALQRPVASDFE
QTVHSIPYTILKFEATQRPVASDFE

SEQ ID NO: 52113 - protein, 25 aa, synthetic construct
  source 1..25: note = Seed: QTVHSIPLTINKEEALQRPVASDFE
QTVHSIPYTILKFEAVQRPVASDFE

SEQ ID NO: 52114 - protein, 25 aa, synthetic construct
  source 1..25: note = Seed: QTVHSIPLTINKEEALQRPVASDFE
QTVHSIPYTILKFEAWQRPVASDFE

SEQ ID NO: 52115 - protein, 25 aa, synthetic construct
  source 1..25: note = Seed: QTVHSIPLTINKEEALQRPVASDFE
QTVHSIPYTILKFEAYQRPVASDFE

SEQ ID NO: 52116 - protein, 25 aa, synthetic construct
  source 1..25: note = Seed: QTVHSIPLTINKEEALQRPVASDFE
QTVHSIPYTILKIEAFQRPVASDFE

SEQ ID NO: 52117 - protein, 25 aa, synthetic construct
  source 1..25: note = Seed: QTVHSIPLTINKEEALQRPVASDFE
QTVHSIPYTILKIEALQRPVASDFE

SEQ ID NO: 52118 - protein, 25 aa, synthetic construct
  source 1..25: note = Seed: QTVHSIPLTINKEEALQRPVASDFE
QTVHSIPYTILKLEAFQRPVASDFE

SEQ ID NO: 52119 - protein, 25 aa, synthetic construct
  source 1..25: note = Seed: QTVHSIPLTINKEEALQRPVASDFE
QTVHSIPYTILKLEAIQRPVASDFE

SEQ ID NO: 52120 - protein, 25 aa, synthetic construct
  source 1..25: note = Seed: QTVHSIPLTINKEEALQRPVASDFE
QTVHSIPYTILKLEALQRPVASDFE

SEQ ID NO: 52121 - protein, 25 aa, synthetic construct
  source 1..25: note = Seed: QTVHSIPLTINKEEALQRPVASDFE
QTVHSIPYTILKLEAMQRPVASDFE

SEQ ID NO: 52122 - protein, 25 aa, synthetic construct
  source 1..25: note = Seed: QTVHSIPLTINKEEALQRPVASDFE
QTVHSIPYTILKLEAVQRPVASDFE

SEQ ID NO: 52123 - protein, 25 aa, synthetic construct
  source 1..25: note = Seed: QTVHSIPLTINKEEALQRPVASDFE
QTVHSIPYTILKMEAFQRPVASDFE

SEQ ID NO: 52124 - protein, 25 aa, synthetic construct
  source 1..25: note = Seed: QTVHSIPLTINKEEALQRPVASDFE
QTVHSIPYTILKMEALQRPVASDFE

SEQ ID NO: 52125 - protein, 25 aa, synthetic construct
  source 1..25: note = Seed: QTVHSIPLTINKEEALQRPVASDFE
QTVHSIPYTILKVEAFQRPVASDFE

SEQ ID NO: 52126 - protein, 25 aa, synthetic construct
  source 1..25: note = Seed: QTVHSIPLTINKEEALQRPVASDFE
QTVHSIPYTILKVEALQRPVASDFE

SEQ ID NO: 52127 - protein, 25 aa, synthetic construct
  source 1..25: note = Seed: QTVHSIPLTINKEEALQRPVASDFE
QTVHSIPYTILKWEAFQRPVASDFE

SEQ ID NO: 52128 - protein, 25 aa, synthetic construct
  source 1..25: note = Seed: QTVHSIPLTINKEEALQRPVASDFE
QTVHSIPYTILKWEAIQRPVASDFE

SEQ ID NO: 52129 - protein, 25 aa, synthetic construct
  source 1..25: note = Seed: QTVHSIPLTINKEEALQRPVASDFE
QTVHSIPYTILKWEALQRPVASDFE

SEQ ID NO: 52130 - protein, 25 aa, synthetic construct
  source 1..25: note = Seed: QTVHSIPLTINKEEALQRPVASDFE
QTVHSIPYTILKYEAFQRPVASDFE

SEQ ID NO: 52131 - protein, 25 aa, synthetic construct
  source 1..25: note = Seed: QTVHSIPLTINKEEALQRPVASDFE
QTVHSIPYTILKYEAIQRPVASDFE

SEQ ID NO: 52132 - protein, 25 aa, synthetic construct
  source 1..25: note = Seed: QTVHSIPLTINKEEALQRPVASDFE
QTVHSIPYTILKYEALQRPVASDFE

SEQ ID NO: 52133 - protein, 25 aa, synthetic construct
  source 1..25: note = Seed: QTVHSIPLTINKEEALQRPVASDFE
QTVHSIPYTILKYEAMQRPVASDFE

SEQ ID NO: 52134 - protein, 25 aa, synthetic construct
  source 1..25: note = Seed: QTVHSIPLTINKEEALQRPVASDFE
QTVHSIPYTILKYEAVQRPVASDFE

SEQ ID NO: 52135 - protein, 25 aa, synthetic construct
  source 1..25: note = Seed: QTVHSIPLTINKEEALQRPVASDFE
QTVHSIPYTILKYEAWQRPVASDFE

SEQ ID NO: 52136 - protein, 25 aa, synthetic construct
  source 1..25: note = Seed: QTVHSIPLTINKEEALQRPVASDFE
QTVHSIPYTILKYEAYQRPVASDFE

SEQ ID NO: 52137 - protein, 25 aa, synthetic construct
  source 1..25: note = Seed: QTVHSIPLTINKEEALQRPVASDFE
QTVHSIPYTIMKFEAFQRPVASDFE

SEQ ID NO: 52138 - protein, 25 aa, synthetic construct
  source 1..25: note = Seed: QTVHSIPLTINKEEALQRPVASDFE
QTVHSIPYTIMKFEAIQRPVASDFE

SEQ ID NO: 52139 - protein, 25 aa, synthetic construct
  source 1..25: note = Seed: QTVHSIPLTINKEEALQRPVASDFE
QTVHSIPYTIMKFEALQRPVASDFE

SEQ ID NO: 52140 - protein, 25 aa, synthetic construct
  source 1..25: note = Seed: QTVHSIPLTINKEEALQRPVASDFE
QTVHSIPYTIMKFEAMQRPVASDFE

SEQ ID NO: 52141 - protein, 25 aa, synthetic construct
  source 1..25: note = Seed: QTVHSIPLTINKEEALQRPVASDFE
QTVHSIPYTIMKFEAVQRPVASDFE

SEQ ID NO: 52142 - protein, 25 aa, synthetic construct
  source 1..25: note = Seed: QTVHSIPLTINKEEALQRPVASDFE
QTVHSIPYTIMKFEAYQRPVASDFE

SEQ ID NO: 52143 - protein, 25 aa, synthetic construct
  source 1..25: note = Seed: QTVHSIPLTINKEEALQRPVASDFE
QTVHSIPYTIMKIEAFQRPVASDFE

SEQ ID NO: 52144 - protein, 25 aa, synthetic construct
  source 1..25: note = Seed: QTVHSIPLTINKEEALQRPVASDFE
QTVHSIPYTIMKLEAFQRPVASDFE

SEQ ID NO: 52145 - protein, 25 aa, synthetic construct
  source 1..25: note = Seed: QTVHSIPLTINKEEALQRPVASDFE
QTVHSIPYTIMKLEALQRPVASDFE

SEQ ID NO: 52146 - protein, 25 aa, synthetic construct
  source 1..25: note = Seed: QTVHSIPLTINKEEALQRPVASDFE
QTVHSIPYTIMKWEAFQRPVASDFE

SEQ ID NO: 52147 - protein, 25 aa, synthetic construct
  source 1..25: note = Seed: QTVHSIPLTINKEEALQRPVASDFE
QTVHSIPYTIMKYEAFQRPVASDFE

SEQ ID NO: 52148 - protein, 25 aa, synthetic construct
  source 1..25: note = Seed: QTVHSIPLTINKEEALQRPVASDFE
QTVHSIPYTIMKYEALQRPVASDFE

SEQ ID NO: 52149 - protein, 25 aa, synthetic construct
  source 1..25: note = Seed: QTVHSIPLTINKEEALQRPVASDFE
QTVHSIPYTINKAEAIQRPVASDFE

SEQ ID NO: 52150 - protein, 25 aa, synthetic construct
  source 1..25: note = Seed: QTVHSIPLTINKEEALQRPVASDFE
QTVHSIPYTINKAEALQRPVASDFE

SEQ ID NO: 52151 - protein, 25 aa, synthetic construct
  source 1..25: note = Seed: QTVHSIPLTINKEEALQRPVASDFE
QTVHSIPYTINKAEAVQRPVASDFE

SEQ ID NO: 52152 - protein, 25 aa, synthetic construct
  source 1..25: note = Seed: QTVHSIPLTINKEEALQRPVASDFE
QTVHSIPYTINKFEAFQRPVASDFE

SEQ ID NO: 52153 - protein, 25 aa, synthetic construct
  source 1..25: note = Seed: QTVHSIPLTINKEEALQRPVASDFE
QTVHSIPYTINKFEAIQRPVASDFE

SEQ ID NO: 52154 - protein, 25 aa, synthetic construct
  source 1..25: note = Seed: QTVHSIPLTINKEEALQRPVASDFE
QTVHSIPYTINKFEALQRPVASDFE

SEQ ID NO: 52155 - protein, 25 aa, synthetic construct
  source 1..25: note = Seed: QTVHSIPLTINKEEALQRPVASDFE
QTVHSIPYTINKFEAMQRPVASDFE

SEQ ID NO: 52156 - protein, 25 aa, synthetic construct
  source 1..25: note = Seed: QTVHSIPLTINKEEALQRPVASDFE
QTVHSIPYTINKFEAVQRPVASDFE

SEQ ID NO: 52157 - protein, 25 aa, synthetic construct
  source 1..25: note = Seed: QTVHSIPLTINKEEALQRPVASDFE
QTVHSIPYTINKIEAIQRPVASDFE

SEQ ID NO: 52158 - protein, 25 aa, synthetic construct
  source 1..25: note = Seed: QTVHSIPLTINKEEALQRPVASDFE
QTVHSIPYTINKIEAVQRPVASDFE

SEQ ID NO: 52159 - protein, 25 aa, synthetic construct
  source 1..25: note = Seed: QTVHSIPLTINKEEALQRPVASDFE
QTVHSIPYTINKNEAFQRPVASDFE

SEQ ID NO: 52160 - protein, 25 aa, synthetic construct
  source 1..25: note = Seed: QTVHSIPLTINKEEALQRPVASDFE
QTVHSIPYTINKNEAIQRPVASDFE

SEQ ID NO: 52161 - protein, 25 aa, synthetic construct
  source 1..25: note = Seed: QTVHSIPLTINKEEALQRPVASDFE
QTVHSIPYTINKNEALQRPVASDFE

SEQ ID NO: 52162 - protein, 25 aa, synthetic construct
  source 1..25: note = Seed: QTVHSIPLTINKEEALQRPVASDFE
QTVHSIPYTINKNEAVQRPVASDFE

SEQ ID NO: 52163 - protein, 25 aa, synthetic construct
  source 1..25: note = Seed: QTVHSIPLTINKEEALQRPVASDFE
QTVHSIPYTINKSEAIQRPVASDFE

SEQ ID NO: 52164 - protein, 25 aa, synthetic construct
  source 1..25: note = Seed: QTVHSIPLTINKEEALQRPVASDFE
QTVHSIPYTINKSEALQRPVASDFE

SEQ ID NO: 52165 - protein, 25 aa, synthetic construct
  source 1..25: note = Seed: QTVHSIPLTINKEEALQRPVASDFE
QTVHSIPYTINKSEAVQRPVASDFE

SEQ ID NO: 52166 - protein, 25 aa, synthetic construct
  source 1..25: note = Seed: QTVHSIPLTINKEEALQRPVASDFE
QTVHSIPYTINKTEAIQRPVASDFE

SEQ ID NO: 52167 - protein, 25 aa, synthetic construct
  source 1..25: note = Seed: QTVHSIPLTINKEEALQRPVASDFE
QTVHSIPYTINKVEAIQRPVASDFE

SEQ ID NO: 52168 - protein, 25 aa, synthetic construct
  source 1..25: note = Seed: QTVHSIPLTINKEEALQRPVASDFE
QTVHSIPYTINKVEAVQRPVASDFE

SEQ ID NO: 52169 - protein, 25 aa, synthetic construct
  source 1..25: note = Seed: QTVHSIPLTINKEEALQRPVASDFE
QTVHSIPYTIQKFEAFQRPVASDFE

SEQ ID NO: 52170 - protein, 25 aa, synthetic construct
  source 1..25: note = Seed: QTVHSIPLTINKEEALQRPVASDFE
QTVHSIPYTIQKFEAIQRPVASDFE

SEQ ID NO: 52171 - protein, 25 aa, synthetic construct
  source 1..25: note = Seed: QTVHSIPLTINKEEALQRPVASDFE
QTVHSIPYTIQKFEALQRPVASDFE

SEQ ID NO: 52172 - protein, 25 aa, synthetic construct
  source 1..25: note = Seed: QTVHSIPLTINKEEALQRPVASDFE
QTVHSIPYTIQKFEAMQRPVASDFE

SEQ ID NO: 52173 - protein, 25 aa, synthetic construct
  source 1..25: note = Seed: QTVHSIPLTINKEEALQRPVASDFE
QTVHSIPYTIQKFEAVQRPVASDFE

SEQ ID NO: 52174 - protein, 25 aa, synthetic construct
  source 1..25: note = Seed: QTVHSIPLTINKEEALQRPVASDFE
QTVHSIPYTISKFEAFQRPVASDFE

SEQ ID NO: 52175 - protein, 25 aa, synthetic construct
  source 1..25: note = Seed: QTVHSIPLTINKEEALQRPVASDFE
QTVHSIPYTISKFEAIQRPVASDFE

SEQ ID NO: 52176 - protein, 25 aa, synthetic construct
  source 1..25: note = Seed: QTVHSIPLTINKEEALQRPVASDFE
QTVHSIPYTISKFEALQRPVASDFE

SEQ ID NO: 52177 - protein, 25 aa, synthetic construct
  source 1..25: note = Seed: QTVHSIPLTINKEEALQRPVASDFE
QTVHSIPYTISKFEAMQRPVASDFE

SEQ ID NO: 52178 - protein, 25 aa, synthetic construct
  source 1..25: note = Seed: QTVHSIPLTINKEEALQRPVASDFE
QTVHSIPYTISKFEAVQRPVASDFE

SEQ ID NO: 52179 - protein, 25 aa, synthetic construct
  source 1..25: note = Seed: QTVHSIPLTINKEEALQRPVASDFE
QTVHSIPYTISKFEAYQRPVASDFE

SEQ ID NO: 52180 - protein, 25 aa, synthetic construct
  source 1..25: note = Seed: QTVHSIPLTINKEEALQRPVASDFE
QTVHSIPYTITKFEAAQRPVASDFE

SEQ ID NO: 52181 - protein, 25 aa, synthetic construct
  source 1..25: note = Seed: QTVHSIPLTINKEEALQRPVASDFE
QTVHSIPYTITKFEAFQRPVASDFE

SEQ ID NO: 52182 - protein, 25 aa, synthetic construct
  source 1..25: note = Seed: QTVHSIPLTINKEEALQRPVASDFE
QTVHSIPYTITKFEAIQRPVASDFE

SEQ ID NO: 52183 - protein, 25 aa, synthetic construct
  source 1..25: note = Seed: QTVHSIPLTINKEEALQRPVASDFE
QTVHSIPYTITKFEALQRPVASDFE

SEQ ID NO: 52184 - protein, 25 aa, synthetic construct
  source 1..25: note = Seed: QTVHSIPLTINKEEALQRPVASDFE
QTVHSIPYTITKFEAMQRPVASDFE

SEQ ID NO: 52185 - protein, 25 aa, synthetic construct
  source 1..25: note = Seed: QTVHSIPLTINKEEALQRPVASDFE
QTVHSIPYTITKFEATQRPVASDFE

SEQ ID NO: 52186 - protein, 25 aa, synthetic construct
  source 1..25: note = Seed: QTVHSIPLTINKEEALQRPVASDFE
QTVHSIPYTITKFEAVQRPVASDFE

SEQ ID NO: 52187 - protein, 25 aa, synthetic construct
  source 1..25: note = Seed: QTVHSIPLTINKEEALQRPVASDFE
QTVHSIPYTITKFEAYQRPVASDFE

SEQ ID NO: 52188 - protein, 25 aa, synthetic construct
  source 1..25: note = Seed: QTVHSIPLTINKEEALQRPVASDFE
QTVHSIPYTITKYEAIQRPVASDFE

SEQ ID NO: 52189 - protein, 25 aa, synthetic construct
  source 1..25: note = Seed: QTVHSIPLTINKEEALQRPVASDFE
QTVHSIPYTITKYEALQRPVASDFE

SEQ ID NO: 52190 - protein, 25 aa, synthetic construct
  source 1..25: note = Seed: QTVHSIPLTINKEEALQRPVASDFE
QTVHSIPYTIVKFEAAQRPVASDFE

SEQ ID NO: 52191 - protein, 25 aa, synthetic construct
  source 1..25: note = Seed: QTVHSIPLTINKEEALQRPVASDFE
QTVHSIPYTIVKFEADQRPVASDFE

SEQ ID NO: 52192 - protein, 25 aa, synthetic construct
  source 1..25: note = Seed: QTVHSIPLTINKEEALQRPVASDFE
QTVHSIPYTIVKFEAEQRPVASDFE

SEQ ID NO: 52193 - protein, 25 aa, synthetic construct
  source 1..25: note = Seed: QTVHSIPLTINKEEALQRPVASDFE
QTVHSIPYTIVKFEAFQRPVASDFE

SEQ ID NO: 52194 - protein, 25 aa, synthetic construct
  source 1..25: note = Seed: QTVHSIPLTINKEEALQRPVASDFE
QTVHSIPYTIVKFEAIQRPVASDFE

SEQ ID NO: 52195 - protein, 25 aa, synthetic construct
  source 1..25: note = Seed: QTVHSIPLTINKEEALQRPVASDFE
QTVHSIPYTIVKFEALQRPVASDFE

SEQ ID NO: 52196 - protein, 25 aa, synthetic construct
  source 1..25: note = Seed: QTVHSIPLTINKEEALQRPVASDFE
QTVHSIPYTIVKFEAMQRPVASDFE

SEQ ID NO: 52197 - protein, 25 aa, synthetic construct
  source 1..25: note = Seed: QTVHSIPLTINKEEALQRPVASDFE
QTVHSIPYTIVKFEANQRPVASDFE

SEQ ID NO: 52198 - protein, 25 aa, synthetic construct
  source 1..25: note = Seed: QTVHSIPLTINKEEALQRPVASDFE
QTVHSIPYTIVKFEASQRPVASDFE

SEQ ID NO: 52199 - protein, 25 aa, synthetic construct
  source 1..25: note = Seed: QTVHSIPLTINKEEALQRPVASDFE
QTVHSIPYTIVKFEATQRPVASDFE

SEQ ID NO: 52200 - protein, 25 aa, synthetic construct
  source 1..25: note = Seed: QTVHSIPLTINKEEALQRPVASDFE
QTVHSIPYTIVKFEAVQRPVASDFE

SEQ ID NO: 52201 - protein, 25 aa, synthetic construct
  source 1..25: note = Seed: QTVHSIPLTINKEEALQRPVASDFE
QTVHSIPYTIVKFEAWQRPVASDFE

SEQ ID NO: 52202 - protein, 25 aa, synthetic construct
  source 1..25: note = Seed: QTVHSIPLTINKEEALQRPVASDFE
QTVHSIPYTIVKFEAYQRPVASDFE

SEQ ID NO: 52203 - protein, 25 aa, synthetic construct
  source 1..25: note = Seed: QTVHSIPLTINKEEALQRPVASDFE
QTVHSIPYTIVKIEAFQRPVASDFE

SEQ ID NO: 52204 - protein, 25 aa, synthetic construct
  source 1..25: note = Seed: QTVHSIPLTINKEEALQRPVASDFE
QTVHSIPYTIVKIEALQRPVASDFE

SEQ ID NO: 52205 - protein, 25 aa, synthetic construct
  source 1..25: note = Seed: QTVHSIPLTINKEEALQRPVASDFE
QTVHSIPYTIVKLEAFQRPVASDFE

SEQ ID NO: 52206 - protein, 25 aa, synthetic construct
  source 1..25: note = Seed: QTVHSIPLTINKEEALQRPVASDFE
QTVHSIPYTIVKLEAIQRPVASDFE

SEQ ID NO: 52207 - protein, 25 aa, synthetic construct
  source 1..25: note = Seed: QTVHSIPLTINKEEALQRPVASDFE
QTVHSIPYTIVKLEALQRPVASDFE

SEQ ID NO: 52208 - protein, 25 aa, synthetic construct
  source 1..25: note = Seed: QTVHSIPLTINKEEALQRPVASDFE
QTVHSIPYTIVKWEAFQRPVASDFE

SEQ ID NO: 52209 - protein, 25 aa, synthetic construct
  source 1..25: note = Seed: QTVHSIPLTINKEEALQRPVASDFE
QTVHSIPYTIVKWEAIQRPVASDFE

SEQ ID NO: 52210 - protein, 25 aa, synthetic construct
  source 1..25: note = Seed: QTVHSIPLTINKEEALQRPVASDFE
QTVHSIPYTIVKWEALQRPVASDFE

SEQ ID NO: 52211 - protein, 25 aa, synthetic construct
  source 1..25: note = Seed: QTVHSIPLTINKEEALQRPVASDFE
QTVHSIPYTIVKYEAFQRPVASDFE

SEQ ID NO: 52212 - protein, 25 aa, synthetic construct
  source 1..25: note = Seed: QTVHSIPLTINKEEALQRPVASDFE
QTVHSIPYTIVKYEAIQRPVASDFE

SEQ ID NO: 52213 - protein, 25 aa, synthetic construct
  source 1..25: note = Seed: QTVHSIPLTINKEEALQRPVASDFE
QTVHSIPYTIVKYEALQRPVASDFE

SEQ ID NO: 52214 - protein, 25 aa, synthetic construct
  source 1..25: note = Seed: QTVHSIPLTINKEEALQRPVASDFE
QTVHSIPYTIVKYEAMQRPVASDFE

SEQ ID NO: 52215 - protein, 25 aa, synthetic construct
  source 1..25: note = Seed: QTVHSIPLTINKEEALQRPVASDFE
QTVHSIPYTIVKYEAVQRPVASDFE

SEQ ID NO: 52216 - protein, 25 aa, synthetic construct
  source 1..25: note = Seed: QTVHSIPLTINKEEALQRPVASDFE
QTVHSIPYTIWKFEAFQRPVASDFE

SEQ ID NO: 52217 - protein, 25 aa, synthetic construct
  source 1..25: note = Seed: QTVHSIPLTINKEEALQRPVASDFE
QTVHSIPYTIWKFEAIQRPVASDFE

SEQ ID NO: 52218 - protein, 25 aa, synthetic construct
  source 1..25: note = Seed: QTVHSIPLTINKEEALQRPVASDFE
QTVHSIPYTIWKFEALQRPVASDFE

SEQ ID NO: 52219 - protein, 25 aa, synthetic construct
  source 1..25: note = Seed: QTVHSIPLTINKEEALQRPVASDFE
QTVHSIPYTIWKFEAMQRPVASDFE

SEQ ID NO: 52220 - protein, 25 aa, synthetic construct
  source 1..25: note = Seed: QTVHSIPLTINKEEALQRPVASDFE
QTVHSIPYTIWKFEAVQRPVASDFE

SEQ ID NO: 52221 - protein, 25 aa, synthetic construct
  source 1..25: note = Seed: QTVHSIPLTINKEEALQRPVASDFE
QTVHSIPYTIWKFEAYQRPVASDFE

SEQ ID NO: 52222 - protein, 25 aa, synthetic construct
  source 1..25: note = Seed: QTVHSIPLTINKEEALQRPVASDFE
QTVHSIPYTIWKLEAFQRPVASDFE

SEQ ID NO: 52223 - protein, 25 aa, synthetic construct
  source 1..25: note = Seed: QTVHSIPLTINKEEALQRPVASDFE
QTVHSIPYTIWKYEAFQRPVASDFE

SEQ ID NO: 52224 - protein, 25 aa, synthetic construct
  source 1..25: note = Seed: QTVHSIPLTINKEEALQRPVASDFE
QTVHSIPYTIWKYEALQRPVASDFE

SEQ ID NO: 52225 - protein, 25 aa, synthetic construct
  source 1..25: note = Seed: QTVHSIPLTINKEEALQRPVASDFE
QTVHSIPYTIYKFEAFQRPVASDFE

SEQ ID NO: 52226 - protein, 25 aa, synthetic construct
  source 1..25: note = Seed: QTVHSIPLTINKEEALQRPVASDFE
QTVHSIPYTIYKFEAIQRPVASDFE

SEQ ID NO: 52227 - protein, 25 aa, synthetic construct
  source 1..25: note = Seed: QTVHSIPLTINKEEALQRPVASDFE
QTVHSIPYTIYKFEALQRPVASDFE

SEQ ID NO: 52228 - protein, 25 aa, synthetic construct
  source 1..25: note = Seed: QTVHSIPLTINKEEALQRPVASDFE
QTVHSIPYTIYKFEAMQRPVASDFE

SEQ ID NO: 52229 - protein, 25 aa, synthetic construct
  source 1..25: note = Seed: QTVHSIPLTINKEEALQRPVASDFE
QTVHSIPYTIYKFEAVQRPVASDFE

SEQ ID NO: 52230 - protein, 25 aa, synthetic construct
  source 1..25: note = Seed: QTVHSIPLTINKEEALQRPVASDFE
QTVHSIPYTIYKFEAYQRPVASDFE

SEQ ID NO: 52231 - protein, 25 aa, synthetic construct
  source 1..25: note = Seed: QTVHSIPLTINKEEALQRPVASDFE
QTVHSIPYTIYKIEAFQRPVASDFE

SEQ ID NO: 52232 - protein, 25 aa, synthetic construct
  source 1..25: note = Seed: QTVHSIPLTINKEEALQRPVASDFE
QTVHSIPYTIYKLEAFQRPVASDFE

SEQ ID NO: 52233 - protein, 25 aa, synthetic construct
  source 1..25: note = Seed: QTVHSIPLTINKEEALQRPVASDFE
QTVHSIPYTIYKLEALQRPVASDFE

SEQ ID NO: 52234 - protein, 25 aa, synthetic construct
  source 1..25: note = Seed: QTVHSIPLTINKEEALQRPVASDFE
QTVHSIPYTIYKWEAFQRPVASDFE

SEQ ID NO: 52235 - protein, 25 aa, synthetic construct
  source 1..25: note = Seed: QTVHSIPLTINKEEALQRPVASDFE
QTVHSIPYTIYKYEAFQRPVASDFE

SEQ ID NO: 52236 - protein, 25 aa, synthetic construct
  source 1..25: note = Seed: QTVHSIPLTINKEEALQRPVASDFE
QTVHSIPYTIYKYEAIQRPVASDFE

SEQ ID NO: 52237 - protein, 25 aa, synthetic construct
  source 1..25: note = Seed: QTVHSIPLTINKEEALQRPVASDFE
QTVHSIPYTIYKYEALQRPVASDFE

SEQ ID NO: 52238 - protein, 25 aa, synthetic construct
  source 1..25: note = Seed: VKLQTVHSIPLTINKEEALQRPVAS
VKLQTVHSIPLTFNKAEALQAPVAS

SEQ ID NO: 52239 - protein, 25 aa, synthetic construct
  source 1..25: note = Seed: VKLQTVHSIPLTINKEEALQRPVAS
VKLQTVHSIPLTFNKAEALQCPVAS

SEQ ID NO: 52240 - protein, 25 aa, synthetic construct
  source 1..25: note = Seed: VKLQTVHSIPLTINKEEALQRPVAS
VKLQTVHSIPLTFNKAEALQGPVAS

SEQ ID NO: 52241 - protein, 25 aa, synthetic construct
  source 1..25: note = Seed: VKLQTVHSIPLTINKEEALQRPVAS
VKLQTVHSIPLTFNKAEALQIPVAS

SEQ ID NO: 52242 - protein, 25 aa, synthetic construct
  source 1..25: note = Seed: VKLQTVHSIPLTINKEEALQRPVAS
VKLQTVHSIPLTFNKAEALQLPVAS

SEQ ID NO: 52243 - protein, 25 aa, synthetic construct
  source 1..25: note = Seed: VKLQTVHSIPLTINKEEALQRPVAS
VKLQTVHSIPLTFNKAEALQMPVAS

SEQ ID NO: 52244 - protein, 25 aa, synthetic construct
  source 1..25: note = Seed: VKLQTVHSIPLTINKEEALQRPVAS
VKLQTVHSIPLTFNKAEALQSPVAS

SEQ ID NO: 52245 - protein, 25 aa, synthetic construct
  source 1..25: note = Seed: VKLQTVHSIPLTINKEEALQRPVAS
VKLQTVHSIPLTFNKAEALQTPVAS

SEQ ID NO: 52246 - protein, 25 aa, synthetic construct
  source 1..25: note = Seed: VKLQTVHSIPLTINKEEALQRPVAS
VKLQTVHSIPLTFNKAEALQVPVAS

SEQ ID NO: 52247 - protein, 25 aa, synthetic construct
  source 1..25: note = Seed: VKLQTVHSIPLTINKEEALQRPVAS
VKLQTVHSIPLTFNKAEFLQIPVAS

SEQ ID NO: 52248 - protein, 25 aa, synthetic construct
  source 1..25: note = Seed: VKLQTVHSIPLTINKEEALQRPVAS
VKLQTVHSIPLTFNKAEFLQLPVAS

SEQ ID NO: 52249 - protein, 25 aa, synthetic construct
  source 1..25: note = Seed: VKLQTVHSIPLTINKEEALQRPVAS
VKLQTVHSIPLTFNKAEFLQVPVAS

SEQ ID NO: 52250 - protein, 25 aa, synthetic construct
  source 1..25: note = Seed: VKLQTVHSIPLTINKEEALQRPVAS
VKLQTVHSIPLTFNKAEGLQAPVAS

SEQ ID NO: 52251 - protein, 25 aa, synthetic construct
  source 1..25: note = Seed: VKLQTVHSIPLTINKEEALQRPVAS
VKLQTVHSIPLTFNKAEGLQGPVAS

SEQ ID NO: 52252 - protein, 25 aa, synthetic construct
  source 1..25: note = Seed: VKLQTVHSIPLTINKEEALQRPVAS
VKLQTVHSIPLTFNKAEGLQIPVAS

SEQ ID NO: 52253 - protein, 25 aa, synthetic construct
  source 1..25: note = Seed: VKLQTVHSIPLTINKEEALQRPVAS
VKLQTVHSIPLTFNKAEGLQLPVAS

SEQ ID NO: 52254 - protein, 25 aa, synthetic construct
  source 1..25: note = Seed: VKLQTVHSIPLTINKEEALQRPVAS
VKLQTVHSIPLTFNKAEGLQMPVAS

SEQ ID NO: 52255 - protein, 25 aa, synthetic construct
  source 1..25: note = Seed: VKLQTVHSIPLTINKEEALQRPVAS
VKLQTVHSIPLTFNKAEGLQSPVAS

SEQ ID NO: 52256 - protein, 25 aa, synthetic construct
  source 1..25: note = Seed: VKLQTVHSIPLTINKEEALQRPVAS
VKLQTVHSIPLTFNKAEGLQTPVAS

SEQ ID NO: 52257 - protein, 25 aa, synthetic construct
  source 1..25: note = Seed: VKLQTVHSIPLTINKEEALQRPVAS
VKLQTVHSIPLTFNKAEGLQVPVAS

SEQ ID NO: 52258 - protein, 25 aa, synthetic construct
  source 1..25: note = Seed: VKLQTVHSIPLTINKEEALQRPVAS
VKLQTVHSIPLTFNKAENLQAPVAS

SEQ ID NO: 52259 - protein, 25 aa, synthetic construct
  source 1..25: note = Seed: VKLQTVHSIPLTINKEEALQRPVAS
VKLQTVHSIPLTFNKAENLQLPVAS

SEQ ID NO: 52260 - protein, 25 aa, synthetic construct
  source 1..25: note = Seed: VKLQTVHSIPLTINKEEALQRPVAS
VKLQTVHSIPLTFNKAENLQSPVAS

SEQ ID NO: 52261 - protein, 25 aa, synthetic construct
  source 1..25: note = Seed: VKLQTVHSIPLTINKEEALQRPVAS
VKLQTVHSIPLTFNKAENLQVPVAS

SEQ ID NO: 52262 - protein, 25 aa, synthetic construct
  source 1..25: note = Seed: VKLQTVHSIPLTINKEEALQRPVAS
VKLQTVHSIPLTFNKAEPLQAPVAS

SEQ ID NO: 52263 - protein, 25 aa, synthetic construct
  source 1..25: note = Seed: VKLQTVHSIPLTINKEEALQRPVAS
VKLQTVHSIPLTFNKAEPLQIPVAS

SEQ ID NO: 52264 - protein, 25 aa, synthetic construct
  source 1..25: note = Seed: VKLQTVHSIPLTINKEEALQRPVAS
VKLQTVHSIPLTFNKAEPLQLPVAS

SEQ ID NO: 52265 - protein, 25 aa, synthetic construct
  source 1..25: note = Seed: VKLQTVHSIPLTINKEEALQRPVAS
VKLQTVHSIPLTFNKAEPLQVPVAS

SEQ ID NO: 52266 - protein, 25 aa, synthetic construct
  source 1..25: note = Seed: VKLQTVHSIPLTINKEEALQRPVAS
VKLQTVHSIPLTFNKAESLQAPVAS

SEQ ID NO: 52267 - protein, 25 aa, synthetic construct
  source 1..25: note = Seed: VKLQTVHSIPLTINKEEALQRPVAS
VKLQTVHSIPLTFNKAESLQGPVAS

SEQ ID NO: 52268 - protein, 25 aa, synthetic construct
  source 1..25: note = Seed: VKLQTVHSIPLTINKEEALQRPVAS
VKLQTVHSIPLTFNKAESLQIPVAS

SEQ ID NO: 52269 - protein, 25 aa, synthetic construct
  source 1..25: note = Seed: VKLQTVHSIPLTINKEEALQRPVAS
VKLQTVHSIPLTFNKAESLQLPVAS

SEQ ID NO: 52270 - protein, 25 aa, synthetic construct
  source 1..25: note = Seed: VKLQTVHSIPLTINKEEALQRPVAS
VKLQTVHSIPLTFNKAESLQMPVAS

SEQ ID NO: 52271 - protein, 25 aa, synthetic construct
  source 1..25: note = Seed: VKLQTVHSIPLTINKEEALQRPVAS
VKLQTVHSIPLTFNKAESLQSPVAS

SEQ ID NO: 52272 - protein, 25 aa, synthetic construct
  source 1..25: note = Seed: VKLQTVHSIPLTINKEEALQRPVAS
VKLQTVHSIPLTFNKAESLQTPVAS

SEQ ID NO: 52273 - protein, 25 aa, synthetic construct
  source 1..25: note = Seed: VKLQTVHSIPLTINKEEALQRPVAS
VKLQTVHSIPLTFNKAESLQVPVAS

SEQ ID NO: 52274 - protein, 25 aa, synthetic construct
  source 1..25: note = Seed: VKLQTVHSIPLTINKEEALQRPVAS
VKLQTVHSIPLTFNKAETLQAPVAS

SEQ ID NO: 52275 - protein, 25 aa, synthetic construct
  source 1..25: note = Seed: VKLQTVHSIPLTINKEEALQRPVAS
VKLQTVHSIPLTFNKAETLQIPVAS

SEQ ID NO: 52276 - protein, 25 aa, synthetic construct
  source 1..25: note = Seed: VKLQTVHSIPLTINKEEALQRPVAS
VKLQTVHSIPLTFNKAETLQLPVAS

SEQ ID NO: 52277 - protein, 25 aa, synthetic construct
  source 1..25: note = Seed: VKLQTVHSIPLTINKEEALQRPVAS
VKLQTVHSIPLTFNKAETLQSPVAS

SEQ ID NO: 52278 - protein, 25 aa, synthetic construct
  source 1..25: note = Seed: VKLQTVHSIPLTINKEEALQRPVAS
VKLQTVHSIPLTFNKAETLQVPVAS

SEQ ID NO: 52279 - protein, 25 aa, synthetic construct
  source 1..25: note = Seed: VKLQTVHSIPLTINKEEALQRPVAS
VKLQTVHSIPLTFNKCEALQAPVAS

SEQ ID NO: 52280 - protein, 25 aa, synthetic construct
  source 1..25: note = Seed: VKLQTVHSIPLTINKEEALQRPVAS
VKLQTVHSIPLTFNKCEALQIPVAS

SEQ ID NO: 52281 - protein, 25 aa, synthetic construct
  source 1..25: note = Seed: VKLQTVHSIPLTINKEEALQRPVAS
VKLQTVHSIPLTFNKCEALQLPVAS

SEQ ID NO: 52282 - protein, 25 aa, synthetic construct
  source 1..25: note = Seed: VKLQTVHSIPLTINKEEALQRPVAS
VKLQTVHSIPLTFNKCEALQVPVAS

SEQ ID NO: 52283 - protein, 25 aa, synthetic construct
  source 1..25: note = Seed: VKLQTVHSIPLTINKEEALQRPVAS
VKLQTVHSIPLTFNKEEALQAPVAS

SEQ ID NO: 52284 - protein, 25 aa, synthetic construct
  source 1..25: note = Seed: VKLQTVHSIPLTINKEEALQRPVAS
VKLQTVHSIPLTFNKEEALQIPVAS

SEQ ID NO: 52285 - protein, 25 aa, synthetic construct
  source 1..25: note = Seed: VKLQTVHSIPLTINKEEALQRPVAS
VKLQTVHSIPLTFNKEEALQLPVAS

SEQ ID NO: 52286 - protein, 25 aa, synthetic construct
  source 1..25: note = Seed: VKLQTVHSIPLTINKEEALQRPVAS
VKLQTVHSIPLTFNKEEALQVPVAS

SEQ ID NO: 52287 - protein, 25 aa, synthetic construct
  source 1..25: note = Seed: VKLQTVHSIPLTINKEEALQRPVAS
VKLQTVHSIPLTFNKEEFLQIPVAS

SEQ ID NO: 52288 - protein, 25 aa, synthetic construct
  source 1..25: note = Seed: VKLQTVHSIPLTINKEEALQRPVAS
VKLQTVHSIPLTFNKEEFLQLPVAS

SEQ ID NO: 52289 - protein, 25 aa, synthetic construct
  source 1..25: note = Seed: VKLQTVHSIPLTINKEEALQRPVAS
VKLQTVHSIPLTFNKEEFLQVPVAS

SEQ ID NO: 52290 - protein, 25 aa, synthetic construct
  source 1..25: note = Seed: VKLQTVHSIPLTINKEEALQRPVAS
VKLQTVHSIPLTFNKEEGLQLPVAS

SEQ ID NO: 52291 - protein, 25 aa, synthetic construct
  source 1..25: note = Seed: VKLQTVHSIPLTINKEEALQRPVAS
VKLQTVHSIPLTFNKEEGLQVPVAS

SEQ ID NO: 52292 - protein, 25 aa, synthetic construct
  source 1..25: note = Seed: VKLQTVHSIPLTINKEEALQRPVAS
VKLQTVHSIPLTFNKFEALQAPVAS

SEQ ID NO: 52293 - protein, 25 aa, synthetic construct
  source 1..25: note = Seed: VKLQTVHSIPLTINKEEALQRPVAS
VKLQTVHSIPLTFNKFEALQIPVAS

SEQ ID NO: 52294 - protein, 25 aa, synthetic construct
  source 1..25: note = Seed: VKLQTVHSIPLTINKEEALQRPVAS
VKLQTVHSIPLTFNKFEALQLPVAS

SEQ ID NO: 52295 - protein, 25 aa, synthetic construct
  source 1..25: note = Seed: VKLQTVHSIPLTINKEEALQRPVAS
VKLQTVHSIPLTFNKFEALQMPVAS

SEQ ID NO: 52296 - protein, 25 aa, synthetic construct
  source 1..25: note = Seed: VKLQTVHSIPLTINKEEALQRPVAS
VKLQTVHSIPLTFNKFEALQVPVAS

SEQ ID NO: 52297 - protein, 25 aa, synthetic construct
  source 1..25: note = Seed: VKLQTVHSIPLTINKEEALQRPVAS
VKLQTVHSIPLTFNKFEGLQIPVAS

SEQ ID NO: 52298 - protein, 25 aa, synthetic construct
  source 1..25: note = Seed: VKLQTVHSIPLTINKEEALQRPVAS
VKLQTVHSIPLTFNKFEGLQLPVAS

SEQ ID NO: 52299 - protein, 25 aa, synthetic construct
  source 1..25: note = Seed: VKLQTVHSIPLTINKEEALQRPVAS
VKLQTVHSIPLTFNKFEGLQTPVAS

SEQ ID NO: 52300 - protein, 25 aa, synthetic construct
  source 1..25: note = Seed: VKLQTVHSIPLTINKEEALQRPVAS
VKLQTVHSIPLTFNKFEGLQVPVAS

SEQ ID NO: 52301 - protein, 25 aa, synthetic construct
  source 1..25: note = Seed: VKLQTVHSIPLTINKEEALQRPVAS
VKLQTVHSIPLTFNKFENLQAPVAS

SEQ ID NO: 52302 - protein, 25 aa, synthetic construct
  source 1..25: note = Seed: VKLQTVHSIPLTINKEEALQRPVAS
VKLQTVHSIPLTFNKFENLQIPVAS

SEQ ID NO: 52303 - protein, 25 aa, synthetic construct
  source 1..25: note = Seed: VKLQTVHSIPLTINKEEALQRPVAS
VKLQTVHSIPLTFNKFENLQLPVAS

SEQ ID NO: 52304 - protein, 25 aa, synthetic construct
  source 1..25: note = Seed: VKLQTVHSIPLTINKEEALQRPVAS
VKLQTVHSIPLTFNKFENLQSPVAS

SEQ ID NO: 52305 - protein, 25 aa, synthetic construct
  source 1..25: note = Seed: VKLQTVHSIPLTINKEEALQRPVAS
VKLQTVHSIPLTFNKFENLQVPVAS

SEQ ID NO: 52306 - protein, 25 aa, synthetic construct
  source 1..25: note = Seed: VKLQTVHSIPLTINKEEALQRPVAS
VKLQTVHSIPLTFNKFEPLQIPVAS

SEQ ID NO: 52307 - protein, 25 aa, synthetic construct
  source 1..25: note = Seed: VKLQTVHSIPLTINKEEALQRPVAS
VKLQTVHSIPLTFNKFEPLQLPVAS

SEQ ID NO: 52308 - protein, 25 aa, synthetic construct
  source 1..25: note = Seed: VKLQTVHSIPLTINKEEALQRPVAS
VKLQTVHSIPLTFNKFEPLQVPVAS

SEQ ID NO: 52309 - protein, 25 aa, synthetic construct
  source 1..25: note = Seed: VKLQTVHSIPLTINKEEALQRPVAS
VKLQTVHSIPLTFNKFESLQIPVAS

SEQ ID NO: 52310 - protein, 25 aa, synthetic construct
  source 1..25: note = Seed: VKLQTVHSIPLTINKEEALQRPVAS
VKLQTVHSIPLTFNKFESLQLPVAS

SEQ ID NO: 52311 - protein, 25 aa, synthetic construct
  source 1..25: note = Seed: VKLQTVHSIPLTINKEEALQRPVAS
VKLQTVHSIPLTFNKFESLQMPVAS

SEQ ID NO: 52312 - protein, 25 aa, synthetic construct
  source 1..25: note = Seed: VKLQTVHSIPLTINKEEALQRPVAS
VKLQTVHSIPLTFNKFESLQSPVAS

SEQ ID NO: 52313 - protein, 25 aa, synthetic construct
  source 1..25: note = Seed: VKLQTVHSIPLTINKEEALQRPVAS
VKLQTVHSIPLTFNKFETLQAPVAS

SEQ ID NO: 52314 - protein, 25 aa, synthetic construct
  source 1..25: note = Seed: VKLQTVHSIPLTINKEEALQRPVAS
VKLQTVHSIPLTFNKFETLQIPVAS

SEQ ID NO: 52315 - protein, 25 aa, synthetic construct
  source 1..25: note = Seed: VKLQTVHSIPLTINKEEALQRPVAS
VKLQTVHSIPLTFNKFETLQSPVAS

SEQ ID NO: 52316 - protein, 25 aa, synthetic construct
  source 1..25: note = Seed: VKLQTVHSIPLTINKEEALQRPVAS
VKLQTVHSIPLTFNKFETLQVPVAS

SEQ ID NO: 52317 - protein, 25 aa, synthetic construct
  source 1..25: note = Seed: VKLQTVHSIPLTINKEEALQRPVAS
VKLQTVHSIPLTFNKGEALQAPVAS

SEQ ID NO: 52318 - protein, 25 aa, synthetic construct
  source 1..25: note = Seed: VKLQTVHSIPLTINKEEALQRPVAS
VKLQTVHSIPLTFNKGEALQIPVAS

SEQ ID NO: 52319 - protein, 25 aa, synthetic construct
  source 1..25: note = Seed: VKLQTVHSIPLTINKEEALQRPVAS
VKLQTVHSIPLTFNKGEALQLPVAS

SEQ ID NO: 52320 - protein, 25 aa, synthetic construct
  source 1..25: note = Seed: VKLQTVHSIPLTINKEEALQRPVAS
VKLQTVHSIPLTFNKGEALQMPVAS

SEQ ID NO: 52321 - protein, 25 aa, synthetic construct
  source 1..25: note = Seed: VKLQTVHSIPLTINKEEALQRPVAS
VKLQTVHSIPLTFNKGEALQTPVAS

SEQ ID NO: 52322 - protein, 25 aa, synthetic construct
  source 1..25: note = Seed: VKLQTVHSIPLTINKEEALQRPVAS
VKLQTVHSIPLTFNKGEALQVPVAS

SEQ ID NO: 52323 - protein, 25 aa, synthetic construct
  source 1..25: note = Seed: VKLQTVHSIPLTINKEEALQRPVAS
VKLQTVHSIPLTFNKGEGLQIPVAS

SEQ ID NO: 52324 - protein, 25 aa, synthetic construct
  source 1..25: note = Seed: VKLQTVHSIPLTINKEEALQRPVAS
VKLQTVHSIPLTFNKGEGLQLPVAS

SEQ ID NO: 52325 - protein, 25 aa, synthetic construct
  source 1..25: note = Seed: VKLQTVHSIPLTINKEEALQRPVAS
VKLQTVHSIPLTFNKGEGLQVPVAS

SEQ ID NO: 52326 - protein, 25 aa, synthetic construct
  source 1..25: note = Seed: VKLQTVHSIPLTINKEEALQRPVAS
VKLQTVHSIPLTFNKGESLQIPVAS

SEQ ID NO: 52327 - protein, 25 aa, synthetic construct
  source 1..25: note = Seed: VKLQTVHSIPLTINKEEALQRPVAS
VKLQTVHSIPLTFNKGESLQLPVAS

SEQ ID NO: 52328 - protein, 25 aa, synthetic construct
  source 1..25: note = Seed: VKLQTVHSIPLTINKEEALQRPVAS
VKLQTVHSIPLTFNKGESLQVPVAS

SEQ ID NO: 52329 - protein, 25 aa, synthetic construct
  source 1..25: note = Seed: VKLQTVHSIPLTINKEEALQRPVAS
VKLQTVHSIPLTFNKHEALQIPVAS

SEQ ID NO: 52330 - protein, 25 aa, synthetic construct
  source 1..25: note = Seed: VKLQTVHSIPLTINKEEALQRPVAS
VKLQTVHSIPLTFNKHEALQLPVAS

SEQ ID NO: 52331 - protein, 25 aa, synthetic construct
  source 1..25: note = Seed: VKLQTVHSIPLTINKEEALQRPVAS
VKLQTVHSIPLTFNKHEALQVPVAS

SEQ ID NO: 52332 - protein, 25 aa, synthetic construct
  source 1..25: note = Seed: VKLQTVHSIPLTINKEEALQRPVAS
VKLQTVHSIPLTFNKHEFLQLPVAS

SEQ ID NO: 52333 - protein, 25 aa, synthetic construct
  source 1..25: note = Seed: VKLQTVHSIPLTINKEEALQRPVAS
VKLQTVHSIPLTFNKIEALQAPVAS

SEQ ID NO: 52334 - protein, 25 aa, synthetic construct
  source 1..25: note = Seed: VKLQTVHSIPLTINKEEALQRPVAS
VKLQTVHSIPLTFNKIEALQCPVAS

SEQ ID NO: 52335 - protein, 25 aa, synthetic construct
  source 1..25: note = Seed: VKLQTVHSIPLTINKEEALQRPVAS
VKLQTVHSIPLTFNKIEALQFPVAS

SEQ ID NO: 52336 - protein, 25 aa, synthetic construct
  source 1..25: note = Seed: VKLQTVHSIPLTINKEEALQRPVAS
VKLQTVHSIPLTFNKIEALQGPVAS

SEQ ID NO: 52337 - protein, 25 aa, synthetic construct
  source 1..25: note = Seed: VKLQTVHSIPLTINKEEALQRPVAS
VKLQTVHSIPLTFNKIEALQHPVAS

SEQ ID NO: 52338 - protein, 25 aa, synthetic construct
  source 1..25: note = Seed: VKLQTVHSIPLTINKEEALQRPVAS
VKLQTVHSIPLTFNKIEALQIPVAS

SEQ ID NO: 52339 - protein, 25 aa, synthetic construct
  source 1..25: note = Seed: VKLQTVHSIPLTINKEEALQRPVAS
VKLQTVHSIPLTFNKIEALQLPVAS

SEQ ID NO: 52340 - protein, 25 aa, synthetic construct
  source 1..25: note = Seed: VKLQTVHSIPLTINKEEALQRPVAS
VKLQTVHSIPLTFNKIEALQMPVAS

SEQ ID NO: 52341 - protein, 25 aa, synthetic construct
  source 1..25: note = Seed: VKLQTVHSIPLTINKEEALQRPVAS
VKLQTVHSIPLTFNKIEALQNPVAS

SEQ ID NO: 52342 - protein, 25 aa, synthetic construct
  source 1..25: note = Seed: VKLQTVHSIPLTINKEEALQRPVAS
VKLQTVHSIPLTFNKIEALQSPVAS

SEQ ID NO: 52343 - protein, 25 aa, synthetic construct
  source 1..25: note = Seed: VKLQTVHSIPLTINKEEALQRPVAS
VKLQTVHSIPLTFNKIEALQTPVAS

SEQ ID NO: 52344 - protein, 25 aa, synthetic construct
  source 1..25: note = Seed: VKLQTVHSIPLTINKEEALQRPVAS
VKLQTVHSIPLTFNKIEALQVPVAS

SEQ ID NO: 52345 - protein, 25 aa, synthetic construct
  source 1..25: note = Seed: VKLQTVHSIPLTINKEEALQRPVAS
VKLQTVHSIPLTFNKIEALQYPVAS

SEQ ID NO: 52346 - protein, 25 aa, synthetic construct
  source 1..25: note = Seed: VKLQTVHSIPLTINKEEALQRPVAS
VKLQTVHSIPLTFNKIEGLQAPVAS

SEQ ID NO: 52347 - protein, 25 aa, synthetic construct
  source 1..25: note = Seed: VKLQTVHSIPLTINKEEALQRPVAS
VKLQTVHSIPLTFNKIEGLQGPVAS

SEQ ID NO: 52348 - protein, 25 aa, synthetic construct
  source 1..25: note = Seed: VKLQTVHSIPLTINKEEALQRPVAS
VKLQTVHSIPLTFNKIEGLQIPVAS

SEQ ID NO: 52349 - protein, 25 aa, synthetic construct
  source 1..25: note = Seed: VKLQTVHSIPLTINKEEALQRPVAS
VKLQTVHSIPLTFNKIEGLQLPVAS

SEQ ID NO: 52350 - protein, 25 aa, synthetic construct
  source 1..25: note = Seed: VKLQTVHSIPLTINKEEALQRPVAS
VKLQTVHSIPLTFNKIEGLQMPVAS

SEQ ID NO: 52351 - protein, 25 aa, synthetic construct
  source 1..25: note = Seed: VKLQTVHSIPLTINKEEALQRPVAS
VKLQTVHSIPLTFNKIEGLQNPVAS

SEQ ID NO: 52352 - protein, 25 aa, synthetic construct
  source 1..25: note = Seed: VKLQTVHSIPLTINKEEALQRPVAS
VKLQTVHSIPLTFNKIEGLQSPVAS

SEQ ID NO: 52353 - protein, 25 aa, synthetic construct
  source 1..25: note = Seed: VKLQTVHSIPLTINKEEALQRPVAS
VKLQTVHSIPLTFNKIEGLQTPVAS

SEQ ID NO: 52354 - protein, 25 aa, synthetic construct
  source 1..25: note = Seed: VKLQTVHSIPLTINKEEALQRPVAS
VKLQTVHSIPLTFNKIEGLQVPVAS

SEQ ID NO: 52355 - protein, 25 aa, synthetic construct
  source 1..25: note = Seed: VKLQTVHSIPLTINKEEALQRPVAS
VKLQTVHSIPLTFNKIENLQAPVAS

SEQ ID NO: 52356 - protein, 25 aa, synthetic construct
  source 1..25: note = Seed: VKLQTVHSIPLTINKEEALQRPVAS
VKLQTVHSIPLTFNKIENLQGPVAS

SEQ ID NO: 52357 - protein, 25 aa, synthetic construct
  source 1..25: note = Seed: VKLQTVHSIPLTINKEEALQRPVAS
VKLQTVHSIPLTFNKIENLQIPVAS

SEQ ID NO: 52358 - protein, 25 aa, synthetic construct
  source 1..25: note = Seed: VKLQTVHSIPLTINKEEALQRPVAS
VKLQTVHSIPLTFNKIENLQLPVAS

SEQ ID NO: 52359 - protein, 25 aa, synthetic construct
  source 1..25: note = Seed: VKLQTVHSIPLTINKEEALQRPVAS
VKLQTVHSIPLTFNKIENLQSPVAS

SEQ ID NO: 52360 - protein, 25 aa, synthetic construct
  source 1..25: note = Seed: VKLQTVHSIPLTINKEEALQRPVAS
VKLQTVHSIPLTFNKIENLQTPVAS

SEQ ID NO: 52361 - protein, 25 aa, synthetic construct
  source 1..25: note = Seed: VKLQTVHSIPLTINKEEALQRPVAS
VKLQTVHSIPLTFNKIENLQVPVAS

SEQ ID NO: 52362 - protein, 25 aa, synthetic construct
  source 1..25: note = Seed: VKLQTVHSIPLTINKEEALQRPVAS
VKLQTVHSIPLTFNKIEPLQAPVAS

SEQ ID NO: 52363 - protein, 25 aa, synthetic construct
  source 1..25: note = Seed: VKLQTVHSIPLTINKEEALQRPVAS
VKLQTVHSIPLTFNKIEPLQIPVAS

SEQ ID NO: 52364 - protein, 25 aa, synthetic construct
  source 1..25: note = Seed: VKLQTVHSIPLTINKEEALQRPVAS
VKLQTVHSIPLTFNKIEPLQLPVAS

SEQ ID NO: 52365 - protein, 25 aa, synthetic construct
  source 1..25: note = Seed: VKLQTVHSIPLTINKEEALQRPVAS
VKLQTVHSIPLTFNKIEPLQMPVAS

SEQ ID NO: 52366 - protein, 25 aa, synthetic construct
  source 1..25: note = Seed: VKLQTVHSIPLTINKEEALQRPVAS
VKLQTVHSIPLTFNKIEPLQNPVAS

SEQ ID NO: 52367 - protein, 25 aa, synthetic construct
  source 1..25: note = Seed: VKLQTVHSIPLTINKEEALQRPVAS
VKLQTVHSIPLTFNKIEPLQSPVAS

SEQ ID NO: 52368 - protein, 25 aa, synthetic construct
  source 1..25: note = Seed: VKLQTVHSIPLTINKEEALQRPVAS
VKLQTVHSIPLTFNKIEPLQTPVAS

SEQ ID NO: 52369 - protein, 25 aa, synthetic construct
  source 1..25: note = Seed: VKLQTVHSIPLTINKEEALQRPVAS
VKLQTVHSIPLTFNKIEPLQVPVAS

SEQ ID NO: 52370 - protein, 25 aa, synthetic construct
  source 1..25: note = Seed: VKLQTVHSIPLTINKEEALQRPVAS
VKLQTVHSIPLTFNKIESLQAPVAS

SEQ ID NO: 52371 - protein, 25 aa, synthetic construct
  source 1..25: note = Seed: VKLQTVHSIPLTINKEEALQRPVAS
VKLQTVHSIPLTFNKIESLQIPVAS

SEQ ID NO: 52372 - protein, 25 aa, synthetic construct
  source 1..25: note = Seed: VKLQTVHSIPLTINKEEALQRPVAS
VKLQTVHSIPLTFNKIESLQLPVAS

SEQ ID NO: 52373 - protein, 25 aa, synthetic construct
  source 1..25: note = Seed: VKLQTVHSIPLTINKEEALQRPVAS
VKLQTVHSIPLTFNKIESLQMPVAS

SEQ ID NO: 52374 - protein, 25 aa, synthetic construct
  source 1..25: note = Seed: VKLQTVHSIPLTINKEEALQRPVAS
VKLQTVHSIPLTFNKIESLQNPVAS

SEQ ID NO: 52375 - protein, 25 aa, synthetic construct
  source 1..25: note = Seed: VKLQTVHSIPLTINKEEALQRPVAS
VKLQTVHSIPLTFNKIESLQSPVAS

SEQ ID NO: 52376 - protein, 25 aa, synthetic construct
  source 1..25: note = Seed: VKLQTVHSIPLTINKEEALQRPVAS
VKLQTVHSIPLTFNKIESLQTPVAS

SEQ ID NO: 52377 - protein, 25 aa, synthetic construct
  source 1..25: note = Seed: VKLQTVHSIPLTINKEEALQRPVAS
VKLQTVHSIPLTFNKIESLQVPVAS

SEQ ID NO: 52378 - protein, 25 aa, synthetic construct
  source 1..25: note = Seed: VKLQTVHSIPLTINKEEALQRPVAS
VKLQTVHSIPLTFNKIETLQAPVAS

SEQ ID NO: 52379 - protein, 25 aa, synthetic construct
  source 1..25: note = Seed: VKLQTVHSIPLTINKEEALQRPVAS
VKLQTVHSIPLTFNKIETLQGPVAS

SEQ ID NO: 52380 - protein, 25 aa, synthetic construct
  source 1..25: note = Seed: VKLQTVHSIPLTINKEEALQRPVAS
VKLQTVHSIPLTFNKIETLQIPVAS

SEQ ID NO: 52381 - protein, 25 aa, synthetic construct
  source 1..25: note = Seed: VKLQTVHSIPLTINKEEALQRPVAS
VKLQTVHSIPLTFNKIETLQLPVAS

SEQ ID NO: 52382 - protein, 25 aa, synthetic construct
  source 1..25: note = Seed: VKLQTVHSIPLTINKEEALQRPVAS
VKLQTVHSIPLTFNKIETLQMPVAS

SEQ ID NO: 52383 - protein, 25 aa, synthetic construct
  source 1..25: note = Seed: VKLQTVHSIPLTINKEEALQRPVAS
VKLQTVHSIPLTFNKIETLQQPVAS

SEQ ID NO: 52384 - protein, 25 aa, synthetic construct
  source 1..25: note = Seed: VKLQTVHSIPLTINKEEALQRPVAS
VKLQTVHSIPLTFNKIETLQSPVAS

SEQ ID NO: 52385 - protein, 25 aa, synthetic construct
  source 1..25: note = Seed: VKLQTVHSIPLTINKEEALQRPVAS
VKLQTVHSIPLTFNKIETLQTPVAS

SEQ ID NO: 52386 - protein, 25 aa, synthetic construct
  source 1..25: note = Seed: VKLQTVHSIPLTINKEEALQRPVAS
VKLQTVHSIPLTFNKIETLQVPVAS

SEQ ID NO: 52387 - protein, 25 aa, synthetic construct
  source 1..25: note = Seed: VKLQTVHSIPLTINKEEALQRPVAS
VKLQTVHSIPLTFNKIEVLQVPVAS

SEQ ID NO: 52388 - protein, 25 aa, synthetic construct
  source 1..25: note = Seed: VKLQTVHSIPLTINKEEALQRPVAS
VKLQTVHSIPLTFNKLEALQAPVAS

SEQ ID NO: 52389 - protein, 25 aa, synthetic construct
  source 1..25: note = Seed: VKLQTVHSIPLTINKEEALQRPVAS
VKLQTVHSIPLTFNKLEALQCPVAS

SEQ ID NO: 52390 - protein, 25 aa, synthetic construct
  source 1..25: note = Seed: VKLQTVHSIPLTINKEEALQRPVAS
VKLQTVHSIPLTFNKLEALQFPVAS

SEQ ID NO: 52391 - protein, 25 aa, synthetic construct
  source 1..25: note = Seed: VKLQTVHSIPLTINKEEALQRPVAS
VKLQTVHSIPLTFNKLEALQGPVAS

SEQ ID NO: 52392 - protein, 25 aa, synthetic construct
  source 1..25: note = Seed: VKLQTVHSIPLTINKEEALQRPVAS
VKLQTVHSIPLTFNKLEALQHPVAS

SEQ ID NO: 52393 - protein, 25 aa, synthetic construct
  source 1..25: note = Seed: VKLQTVHSIPLTINKEEALQRPVAS
VKLQTVHSIPLTFNKLEALQIPVAS

SEQ ID NO: 52394 - protein, 25 aa, synthetic construct
  source 1..25: note = Seed: VKLQTVHSIPLTINKEEALQRPVAS
VKLQTVHSIPLTFNKLEALQKPVAS

SEQ ID NO: 52395 - protein, 25 aa, synthetic construct
  source 1..25: note = Seed: VKLQTVHSIPLTINKEEALQRPVAS
VKLQTVHSIPLTFNKLEALQLPVAS

SEQ ID NO: 52396 - protein, 25 aa, synthetic construct
  source 1..25: note = Seed: VKLQTVHSIPLTINKEEALQRPVAS
VKLQTVHSIPLTFNKLEALQMPVAS

SEQ ID NO: 52397 - protein, 25 aa, synthetic construct
  source 1..25: note = Seed: VKLQTVHSIPLTINKEEALQRPVAS
VKLQTVHSIPLTFNKLEALQNPVAS

SEQ ID NO: 52398 - protein, 25 aa, synthetic construct
  source 1..25: note = Seed: VKLQTVHSIPLTINKEEALQRPVAS
VKLQTVHSIPLTFNKLEALQPPVAS

SEQ ID NO: 52399 - protein, 25 aa, synthetic construct
  source 1..25: note = Seed: VKLQTVHSIPLTINKEEALQRPVAS
VKLQTVHSIPLTFNKLEALQQPVAS

SEQ ID NO: 52400 - protein, 25 aa, synthetic construct
  source 1..25: note = Seed: VKLQTVHSIPLTINKEEALQRPVAS
VKLQTVHSIPLTFNKLEALQRPVAS

SEQ ID NO: 52401 - protein, 25 aa, synthetic construct
  source 1..25: note = Seed: VKLQTVHSIPLTINKEEALQRPVAS
VKLQTVHSIPLTFNKLEALQSPVAS

SEQ ID NO: 52402 - protein, 25 aa, synthetic construct
  source 1..25: note = Seed: VKLQTVHSIPLTINKEEALQRPVAS
VKLQTVHSIPLTFNKLEALQTPVAS

SEQ ID NO: 52403 - protein, 25 aa, synthetic construct
  source 1..25: note = Seed: VKLQTVHSIPLTINKEEALQRPVAS
VKLQTVHSIPLTFNKLEALQVPVAS

SEQ ID NO: 52404 - protein, 25 aa, synthetic construct
  source 1..25: note = Seed: VKLQTVHSIPLTINKEEALQRPVAS
VKLQTVHSIPLTFNKLEALQYPVAS

SEQ ID NO: 52405 - protein, 25 aa, synthetic construct
  source 1..25: note = Seed: VKLQTVHSIPLTINKEEALQRPVAS
VKLQTVHSIPLTFNKLEGLQAPVAS

SEQ ID NO: 52406 - protein, 25 aa, synthetic construct
  source 1..25: note = Seed: VKLQTVHSIPLTINKEEALQRPVAS
VKLQTVHSIPLTFNKLEGLQCPVAS

SEQ ID NO: 52407 - protein, 25 aa, synthetic construct
  source 1..25: note = Seed: VKLQTVHSIPLTINKEEALQRPVAS
VKLQTVHSIPLTFNKLEGLQFPVAS

SEQ ID NO: 52408 - protein, 25 aa, synthetic construct
  source 1..25: note = Seed: VKLQTVHSIPLTINKEEALQRPVAS
VKLQTVHSIPLTFNKLEGLQGPVAS

SEQ ID NO: 52409 - protein, 25 aa, synthetic construct
  source 1..25: note = Seed: VKLQTVHSIPLTINKEEALQRPVAS
VKLQTVHSIPLTFNKLEGLQHPVAS

SEQ ID NO: 52410 - protein, 25 aa, synthetic construct
  source 1..25: note = Seed: VKLQTVHSIPLTINKEEALQRPVAS
VKLQTVHSIPLTFNKLEGLQIPVAS

SEQ ID NO: 52411 - protein, 25 aa, synthetic construct
  source 1..25: note = Seed: VKLQTVHSIPLTINKEEALQRPVAS
VKLQTVHSIPLTFNKLEGLQLPVAS

SEQ ID NO: 52412 - protein, 25 aa, synthetic construct
  source 1..25: note = Seed: VKLQTVHSIPLTINKEEALQRPVAS
VKLQTVHSIPLTFNKLEGLQMPVAS

SEQ ID NO: 52413 - protein, 25 aa, synthetic construct
  source 1..25: note = Seed: VKLQTVHSIPLTINKEEALQRPVAS
VKLQTVHSIPLTFNKLEGLQNPVAS

SEQ ID NO: 52414 - protein, 25 aa, synthetic construct
  source 1..25: note = Seed: VKLQTVHSIPLTINKEEALQRPVAS
VKLQTVHSIPLTFNKLEGLQSPVAS

SEQ ID NO: 52415 - protein, 25 aa, synthetic construct
  source 1..25: note = Seed: VKLQTVHSIPLTINKEEALQRPVAS
VKLQTVHSIPLTFNKLEGLQTPVAS

SEQ ID NO: 52416 - protein, 25 aa, synthetic construct
  source 1..25: note = Seed: VKLQTVHSIPLTINKEEALQRPVAS
VKLQTVHSIPLTFNKLEGLQVPVAS

SEQ ID NO: 52417 - protein, 25 aa, synthetic construct
  source 1..25: note = Seed: VKLQTVHSIPLTINKEEALQRPVAS
VKLQTVHSIPLTFNKLEGLQYPVAS

SEQ ID NO: 52418 - protein, 25 aa, synthetic construct
  source 1..25: note = Seed: VKLQTVHSIPLTINKEEALQRPVAS
VKLQTVHSIPLTFNKLEHLQVPVAS

SEQ ID NO: 52419 - protein, 25 aa, synthetic construct
  source 1..25: note = Seed: VKLQTVHSIPLTINKEEALQRPVAS
VKLQTVHSIPLTFNKLEILQVPVAS

SEQ ID NO: 52420 - protein, 25 aa, synthetic construct
  source 1..25: note = Seed: VKLQTVHSIPLTINKEEALQRPVAS
VKLQTVHSIPLTFNKLENLQAPVAS

SEQ ID NO: 52421 - protein, 25 aa, synthetic construct
  source 1..25: note = Seed: VKLQTVHSIPLTINKEEALQRPVAS
VKLQTVHSIPLTFNKLENLQGPVAS

SEQ ID NO: 52422 - protein, 25 aa, synthetic construct
  source 1..25: note = Seed: VKLQTVHSIPLTINKEEALQRPVAS
VKLQTVHSIPLTFNKLENLQIPVAS

SEQ ID NO: 52423 - protein, 25 aa, synthetic construct
  source 1..25: note = Seed: VKLQTVHSIPLTINKEEALQRPVAS
VKLQTVHSIPLTFNKLENLQLPVAS

SEQ ID NO: 52424 - protein, 25 aa, synthetic construct
  source 1..25: note = Seed: VKLQTVHSIPLTINKEEALQRPVAS
VKLQTVHSIPLTFNKLENLQMPVAS

SEQ ID NO: 52425 - protein, 25 aa, synthetic construct
  source 1..25: note = Seed: VKLQTVHSIPLTINKEEALQRPVAS
VKLQTVHSIPLTFNKLENLQSPVAS

SEQ ID NO: 52426 - protein, 25 aa, synthetic construct
  source 1..25: note = Seed: VKLQTVHSIPLTINKEEALQRPVAS
VKLQTVHSIPLTFNKLENLQTPVAS

SEQ ID NO: 52427 - protein, 25 aa, synthetic construct
  source 1..25: note = Seed: VKLQTVHSIPLTINKEEALQRPVAS
VKLQTVHSIPLTFNKLENLQVPVAS

SEQ ID NO: 52428 - protein, 25 aa, synthetic construct
  source 1..25: note = Seed: VKLQTVHSIPLTINKEEALQRPVAS
VKLQTVHSIPLTFNKLEPLQAPVAS

SEQ ID NO: 52429 - protein, 25 aa, synthetic construct
  source 1..25: note = Seed: VKLQTVHSIPLTINKEEALQRPVAS
VKLQTVHSIPLTFNKLEPLQCPVAS

SEQ ID NO: 52430 - protein, 25 aa, synthetic construct
  source 1..25: note = Seed: VKLQTVHSIPLTINKEEALQRPVAS
VKLQTVHSIPLTFNKLEPLQFPVAS

SEQ ID NO: 52431 - protein, 25 aa, synthetic construct
  source 1..25: note = Seed: VKLQTVHSIPLTINKEEALQRPVAS
VKLQTVHSIPLTFNKLEPLQGPVAS

SEQ ID NO: 52432 - protein, 25 aa, synthetic construct
  source 1..25: note = Seed: VKLQTVHSIPLTINKEEALQRPVAS
VKLQTVHSIPLTFNKLEPLQIPVAS

SEQ ID NO: 52433 - protein, 25 aa, synthetic construct
  source 1..25: note = Seed: VKLQTVHSIPLTINKEEALQRPVAS
VKLQTVHSIPLTFNKLEPLQLPVAS

SEQ ID NO: 52434 - protein, 25 aa, synthetic construct
  source 1..25: note = Seed: VKLQTVHSIPLTINKEEALQRPVAS
VKLQTVHSIPLTFNKLEPLQMPVAS

SEQ ID NO: 52435 - protein, 25 aa, synthetic construct
  source 1..25: note = Seed: VKLQTVHSIPLTINKEEALQRPVAS
VKLQTVHSIPLTFNKLEPLQNPVAS

SEQ ID NO: 52436 - protein, 25 aa, synthetic construct
  source 1..25: note = Seed: VKLQTVHSIPLTINKEEALQRPVAS
VKLQTVHSIPLTFNKLEPLQPPVAS

SEQ ID NO: 52437 - protein, 25 aa, synthetic construct
  source 1..25: note = Seed: VKLQTVHSIPLTINKEEALQRPVAS
VKLQTVHSIPLTFNKLEPLQSPVAS

SEQ ID NO: 52438 - protein, 25 aa, synthetic construct
  source 1..25: note = Seed: VKLQTVHSIPLTINKEEALQRPVAS
VKLQTVHSIPLTFNKLEPLQTPVAS

SEQ ID NO: 52439 - protein, 25 aa, synthetic construct
  source 1..25: note = Seed: VKLQTVHSIPLTINKEEALQRPVAS
VKLQTVHSIPLTFNKLEPLQVPVAS

SEQ ID NO: 52440 - protein, 25 aa, synthetic construct
  source 1..25: note = Seed: VKLQTVHSIPLTINKEEALQRPVAS
VKLQTVHSIPLTFNKLEPLQYPVAS

SEQ ID NO: 52441 - protein, 25 aa, synthetic construct
  source 1..25: note = Seed: VKLQTVHSIPLTINKEEALQRPVAS
VKLQTVHSIPLTFNKLESLQCPVAS

SEQ ID NO: 52442 - protein, 25 aa, synthetic construct
  source 1..25: note = Seed: VKLQTVHSIPLTINKEEALQRPVAS
VKLQTVHSIPLTFNKLESLQFPVAS

SEQ ID NO: 52443 - protein, 25 aa, synthetic construct
  source 1..25: note = Seed: VKLQTVHSIPLTINKEEALQRPVAS
VKLQTVHSIPLTFNKLESLQGPVAS

SEQ ID NO: 52444 - protein, 25 aa, synthetic construct
  source 1..25: note = Seed: VKLQTVHSIPLTINKEEALQRPVAS
VKLQTVHSIPLTFNKLESLQHPVAS

SEQ ID NO: 52445 - protein, 25 aa, synthetic construct
  source 1..25: note = Seed: VKLQTVHSIPLTINKEEALQRPVAS
VKLQTVHSIPLTFNKLESLQIPVAS

SEQ ID NO: 52446 - protein, 25 aa, synthetic construct
  source 1..25: note = Seed: VKLQTVHSIPLTINKEEALQRPVAS
VKLQTVHSIPLTFNKLESLQLPVAS

SEQ ID NO: 52447 - protein, 25 aa, synthetic construct
  source 1..25: note = Seed: VKLQTVHSIPLTINKEEALQRPVAS
VKLQTVHSIPLTFNKLESLQMPVAS

SEQ ID NO: 52448 - protein, 25 aa, synthetic construct
  source 1..25: note = Seed: VKLQTVHSIPLTINKEEALQRPVAS
VKLQTVHSIPLTFNKLESLQNPVAS

SEQ ID NO: 52449 - protein, 25 aa, synthetic construct
  source 1..25: note = Seed: VKLQTVHSIPLTINKEEALQRPVAS
VKLQTVHSIPLTFNKLESLQSPVAS

SEQ ID NO: 52450 - protein, 25 aa, synthetic construct
  source 1..25: note = Seed: VKLQTVHSIPLTINKEEALQRPVAS
VKLQTVHSIPLTFNKLESLQTPVAS

SEQ ID NO: 52451 - protein, 25 aa, synthetic construct
  source 1..25: note = Seed: VKLQTVHSIPLTINKEEALQRPVAS
VKLQTVHSIPLTFNKLESLQVPVAS

SEQ ID NO: 52452 - protein, 25 aa, synthetic construct
  source 1..25: note = Seed: VKLQTVHSIPLTINKEEALQRPVAS
VKLQTVHSIPLTFNKLESLQYPVAS

SEQ ID NO: 52453 - protein, 25 aa, synthetic construct
  source 1..25: note = Seed: VKLQTVHSIPLTINKEEALQRPVAS
VKLQTVHSIPLTFNKLETLQAPVAS

SEQ ID NO: 52454 - protein, 25 aa, synthetic construct
  source 1..25: note = Seed: VKLQTVHSIPLTINKEEALQRPVAS
VKLQTVHSIPLTFNKLETLQGPVAS

SEQ ID NO: 52455 - protein, 25 aa, synthetic construct
  source 1..25: note = Seed: VKLQTVHSIPLTINKEEALQRPVAS
VKLQTVHSIPLTFNKLETLQIPVAS

SEQ ID NO: 52456 - protein, 25 aa, synthetic construct
  source 1..25: note = Seed: VKLQTVHSIPLTINKEEALQRPVAS
VKLQTVHSIPLTFNKLETLQLPVAS

SEQ ID NO: 52457 - protein, 25 aa, synthetic construct
  source 1..25: note = Seed: VKLQTVHSIPLTINKEEALQRPVAS
VKLQTVHSIPLTFNKLETLQMPVAS

SEQ ID NO: 52458 - protein, 25 aa, synthetic construct
  source 1..25: note = Seed: VKLQTVHSIPLTINKEEALQRPVAS
VKLQTVHSIPLTFNKLETLQNPVAS

SEQ ID NO: 52459 - protein, 25 aa, synthetic construct
  source 1..25: note = Seed: VKLQTVHSIPLTINKEEALQRPVAS
VKLQTVHSIPLTFNKLETLQSPVAS

SEQ ID NO: 52460 - protein, 25 aa, synthetic construct
  source 1..25: note = Seed: VKLQTVHSIPLTINKEEALQRPVAS
VKLQTVHSIPLTFNKLETLQTPVAS

SEQ ID NO: 52461 - protein, 25 aa, synthetic construct
  source 1..25: note = Seed: VKLQTVHSIPLTINKEEALQRPVAS
VKLQTVHSIPLTFNKLETLQVPVAS

SEQ ID NO: 52462 - protein, 25 aa, synthetic construct
  source 1..25: note = Seed: VKLQTVHSIPLTINKEEALQRPVAS
VKLQTVHSIPLTFNKLEVLQAPVAS

SEQ ID NO: 52463 - protein, 25 aa, synthetic construct
  source 1..25: note = Seed: VKLQTVHSIPLTINKEEALQRPVAS
VKLQTVHSIPLTFNKLEVLQIPVAS

SEQ ID NO: 52464 - protein, 25 aa, synthetic construct
  source 1..25: note = Seed: VKLQTVHSIPLTINKEEALQRPVAS
VKLQTVHSIPLTFNKLEVLQLPVAS

SEQ ID NO: 52465 - protein, 25 aa, synthetic construct
  source 1..25: note = Seed: VKLQTVHSIPLTINKEEALQRPVAS
VKLQTVHSIPLTFNKLEVLQMPVAS

SEQ ID NO: 52466 - protein, 25 aa, synthetic construct
  source 1..25: note = Seed: VKLQTVHSIPLTINKEEALQRPVAS
VKLQTVHSIPLTFNKLEVLQNPVAS

SEQ ID NO: 52467 - protein, 25 aa, synthetic construct
  source 1..25: note = Seed: VKLQTVHSIPLTINKEEALQRPVAS
VKLQTVHSIPLTFNKLEVLQSPVAS

SEQ ID NO: 52468 - protein, 25 aa, synthetic construct
  source 1..25: note = Seed: VKLQTVHSIPLTINKEEALQRPVAS
VKLQTVHSIPLTFNKLEVLQTPVAS

SEQ ID NO: 52469 - protein, 25 aa, synthetic construct
  source 1..25: note = Seed: VKLQTVHSIPLTINKEEALQRPVAS
VKLQTVHSIPLTFNKLEVLQVPVAS

SEQ ID NO: 52470 - protein, 25 aa, synthetic construct
  source 1..25: note = Seed: VKLQTVHSIPLTINKEEALQRPVAS
VKLQTVHSIPLTFNKMEALQAPVAS

SEQ ID NO: 52471 - protein, 25 aa, synthetic construct
  source 1..25: note = Seed: VKLQTVHSIPLTINKEEALQRPVAS
VKLQTVHSIPLTFNKMEALQCPVAS

SEQ ID NO: 52472 - protein, 25 aa, synthetic construct
  source 1..25: note = Seed: VKLQTVHSIPLTINKEEALQRPVAS
VKLQTVHSIPLTFNKMEALQFPVAS

SEQ ID NO: 52473 - protein, 25 aa, synthetic construct
  source 1..25: note = Seed: VKLQTVHSIPLTINKEEALQRPVAS
VKLQTVHSIPLTFNKMEALQGPVAS

SEQ ID NO: 52474 - protein, 25 aa, synthetic construct
  source 1..25: note = Seed: VKLQTVHSIPLTINKEEALQRPVAS
VKLQTVHSIPLTFNKMEALQHPVAS

SEQ ID NO: 52475 - protein, 25 aa, synthetic construct
  source 1..25: note = Seed: VKLQTVHSIPLTINKEEALQRPVAS
VKLQTVHSIPLTFNKMEALQIPVAS

SEQ ID NO: 52476 - protein, 25 aa, synthetic construct
  source 1..25: note = Seed: VKLQTVHSIPLTINKEEALQRPVAS
VKLQTVHSIPLTFNKMEALQKPVAS

SEQ ID NO: 52477 - protein, 25 aa, synthetic construct
  source 1..25: note = Seed: VKLQTVHSIPLTINKEEALQRPVAS
VKLQTVHSIPLTFNKMEALQLPVAS

SEQ ID NO: 52478 - protein, 25 aa, synthetic construct
  source 1..25: note = Seed: VKLQTVHSIPLTINKEEALQRPVAS
VKLQTVHSIPLTFNKMEALQMPVAS

SEQ ID NO: 52479 - protein, 25 aa, synthetic construct
  source 1..25: note = Seed: VKLQTVHSIPLTINKEEALQRPVAS
VKLQTVHSIPLTFNKMEALQNPVAS

SEQ ID NO: 52480 - protein, 25 aa, synthetic construct
  source 1..25: note = Seed: VKLQTVHSIPLTINKEEALQRPVAS
VKLQTVHSIPLTFNKMEALQPPVAS

SEQ ID NO: 52481 - protein, 25 aa, synthetic construct
  source 1..25: note = Seed: VKLQTVHSIPLTINKEEALQRPVAS
VKLQTVHSIPLTFNKMEALQQPVAS

SEQ ID NO: 52482 - protein, 25 aa, synthetic construct
  source 1..25: note = Seed: VKLQTVHSIPLTINKEEALQRPVAS
VKLQTVHSIPLTFNKMEALQRPVAS

SEQ ID NO: 52483 - protein, 25 aa, synthetic construct
  source 1..25: note = Seed: VKLQTVHSIPLTINKEEALQRPVAS
VKLQTVHSIPLTFNKMEALQSPVAS

SEQ ID NO: 52484 - protein, 25 aa, synthetic construct
  source 1..25: note = Seed: VKLQTVHSIPLTINKEEALQRPVAS
VKLQTVHSIPLTFNKMEALQTPVAS

SEQ ID NO: 52485 - protein, 25 aa, synthetic construct
  source 1..25: note = Seed: VKLQTVHSIPLTINKEEALQRPVAS
VKLQTVHSIPLTFNKMEALQVPVAS

SEQ ID NO: 52486 - protein, 25 aa, synthetic construct
  source 1..25: note = Seed: VKLQTVHSIPLTINKEEALQRPVAS
VKLQTVHSIPLTFNKMEALQYPVAS

SEQ ID NO: 52487 - protein, 25 aa, synthetic construct
  source 1..25: note = Seed: VKLQTVHSIPLTINKEEALQRPVAS
VKLQTVHSIPLTFNKMEGLQAPVAS

SEQ ID NO: 52488 - protein, 25 aa, synthetic construct
  source 1..25: note = Seed: VKLQTVHSIPLTINKEEALQRPVAS
VKLQTVHSIPLTFNKMEGLQCPVAS

SEQ ID NO: 52489 - protein, 25 aa, synthetic construct
  source 1..25: note = Seed: VKLQTVHSIPLTINKEEALQRPVAS
VKLQTVHSIPLTFNKMEGLQFPVAS

SEQ ID NO: 52490 - protein, 25 aa, synthetic construct
  source 1..25: note = Seed: VKLQTVHSIPLTINKEEALQRPVAS
VKLQTVHSIPLTFNKMEGLQGPVAS

SEQ ID NO: 52491 - protein, 25 aa, synthetic construct
  source 1..25: note = Seed: VKLQTVHSIPLTINKEEALQRPVAS
VKLQTVHSIPLTFNKMEGLQIPVAS

SEQ ID NO: 52492 - protein, 25 aa, synthetic construct
  source 1..25: note = Seed: VKLQTVHSIPLTINKEEALQRPVAS
VKLQTVHSIPLTFNKMEGLQLPVAS

SEQ ID NO: 52493 - protein, 25 aa, synthetic construct
  source 1..25: note = Seed: VKLQTVHSIPLTINKEEALQRPVAS
VKLQTVHSIPLTFNKMEGLQMPVAS

SEQ ID NO: 52494 - protein, 25 aa, synthetic construct
  source 1..25: note = Seed: VKLQTVHSIPLTINKEEALQRPVAS
VKLQTVHSIPLTFNKMEGLQNPVAS

SEQ ID NO: 52495 - protein, 25 aa, synthetic construct
  source 1..25: note = Seed: VKLQTVHSIPLTINKEEALQRPVAS
VKLQTVHSIPLTFNKMEGLQSPVAS

SEQ ID NO: 52496 - protein, 25 aa, synthetic construct
  source 1..25: note = Seed: VKLQTVHSIPLTINKEEALQRPVAS
VKLQTVHSIPLTFNKMEGLQTPVAS

SEQ ID NO: 52497 - protein, 25 aa, synthetic construct
  source 1..25: note = Seed: VKLQTVHSIPLTINKEEALQRPVAS
VKLQTVHSIPLTFNKMEGLQVPVAS

SEQ ID NO: 52498 - protein, 25 aa, synthetic construct
  source 1..25: note = Seed: VKLQTVHSIPLTINKEEALQRPVAS
VKLQTVHSIPLTFNKMEILQTPVAS

SEQ ID NO: 52499 - protein, 25 aa, synthetic construct
  source 1..25: note = Seed: VKLQTVHSIPLTINKEEALQRPVAS
VKLQTVHSIPLTFNKMEILQVPVAS

SEQ ID NO: 52500 - protein, 25 aa, synthetic construct
  source 1..25: note = Seed: VKLQTVHSIPLTINKEEALQRPVAS
VKLQTVHSIPLTFNKMENLQAPVAS

SEQ ID NO: 52501 - protein, 25 aa, synthetic construct
  source 1..25: note = Seed: VKLQTVHSIPLTINKEEALQRPVAS
VKLQTVHSIPLTFNKMENLQGPVAS

SEQ ID NO: 52502 - protein, 25 aa, synthetic construct
  source 1..25: note = Seed: VKLQTVHSIPLTINKEEALQRPVAS
VKLQTVHSIPLTFNKMENLQIPVAS

SEQ ID NO: 52503 - protein, 25 aa, synthetic construct
  source 1..25: note = Seed: VKLQTVHSIPLTINKEEALQRPVAS
VKLQTVHSIPLTFNKMENLQLPVAS

SEQ ID NO: 52504 - protein, 25 aa, synthetic construct
  source 1..25: note = Seed: VKLQTVHSIPLTINKEEALQRPVAS
VKLQTVHSIPLTFNKMENLQMPVAS

SEQ ID NO: 52505 - protein, 25 aa, synthetic construct
  source 1..25: note = Seed: VKLQTVHSIPLTINKEEALQRPVAS
VKLQTVHSIPLTFNKMENLQSPVAS

SEQ ID NO: 52506 - protein, 25 aa, synthetic construct
  source 1..25: note = Seed: VKLQTVHSIPLTINKEEALQRPVAS
VKLQTVHSIPLTFNKMENLQTPVAS

SEQ ID NO: 52507 - protein, 25 aa, synthetic construct
  source 1..25: note = Seed: VKLQTVHSIPLTINKEEALQRPVAS
VKLQTVHSIPLTFNKMENLQVPVAS

SEQ ID NO: 52508 - protein, 25 aa, synthetic construct
  source 1..25: note = Seed: VKLQTVHSIPLTINKEEALQRPVAS
VKLQTVHSIPLTFNKMEPLQAPVAS

SEQ ID NO: 52509 - protein, 25 aa, synthetic construct
  source 1..25: note = Seed: VKLQTVHSIPLTINKEEALQRPVAS
VKLQTVHSIPLTFNKMEPLQCPVAS

SEQ ID NO: 52510 - protein, 25 aa, synthetic construct
  source 1..25: note = Seed: VKLQTVHSIPLTINKEEALQRPVAS
VKLQTVHSIPLTFNKMEPLQFPVAS

SEQ ID NO: 52511 - protein, 25 aa, synthetic construct
  source 1..25: note = Seed: VKLQTVHSIPLTINKEEALQRPVAS
VKLQTVHSIPLTFNKMEPLQGPVAS

SEQ ID NO: 52512 - protein, 25 aa, synthetic construct
  source 1..25: note = Seed: VKLQTVHSIPLTINKEEALQRPVAS
VKLQTVHSIPLTFNKMEPLQIPVAS

SEQ ID NO: 52513 - protein, 25 aa, synthetic construct
  source 1..25: note = Seed: VKLQTVHSIPLTINKEEALQRPVAS
VKLQTVHSIPLTFNKMEPLQLPVAS

SEQ ID NO: 52514 - protein, 25 aa, synthetic construct
  source 1..25: note = Seed: VKLQTVHSIPLTINKEEALQRPVAS
VKLQTVHSIPLTFNKMEPLQMPVAS

SEQ ID NO: 52515 - protein, 25 aa, synthetic construct
  source 1..25: note = Seed: VKLQTVHSIPLTINKEEALQRPVAS
VKLQTVHSIPLTFNKMEPLQNPVAS

SEQ ID NO: 52516 - protein, 25 aa, synthetic construct
  source 1..25: note = Seed: VKLQTVHSIPLTINKEEALQRPVAS
VKLQTVHSIPLTFNKMEPLQSPVAS

SEQ ID NO: 52517 - protein, 25 aa, synthetic construct
  source 1..25: note = Seed: VKLQTVHSIPLTINKEEALQRPVAS
VKLQTVHSIPLTFNKMEPLQTPVAS

SEQ ID NO: 52518 - protein, 25 aa, synthetic construct
  source 1..25: note = Seed: VKLQTVHSIPLTINKEEALQRPVAS
VKLQTVHSIPLTFNKMEPLQVPVAS

SEQ ID NO: 52519 - protein, 25 aa, synthetic construct
  source 1..25: note = Seed: VKLQTVHSIPLTINKEEALQRPVAS
VKLQTVHSIPLTFNKMESLQAPVAS

SEQ ID NO: 52520 - protein, 25 aa, synthetic construct
  source 1..25: note = Seed: VKLQTVHSIPLTINKEEALQRPVAS
VKLQTVHSIPLTFNKMESLQCPVAS

SEQ ID NO: 52521 - protein, 25 aa, synthetic construct
  source 1..25: note = Seed: VKLQTVHSIPLTINKEEALQRPVAS
VKLQTVHSIPLTFNKMESLQFPVAS

SEQ ID NO: 52522 - protein, 25 aa, synthetic construct
  source 1..25: note = Seed: VKLQTVHSIPLTINKEEALQRPVAS
VKLQTVHSIPLTFNKMESLQGPVAS

SEQ ID NO: 52523 - protein, 25 aa, synthetic construct
  source 1..25: note = Seed: VKLQTVHSIPLTINKEEALQRPVAS
VKLQTVHSIPLTFNKMESLQIPVAS

SEQ ID NO: 52524 - protein, 25 aa, synthetic construct
  source 1..25: note = Seed: VKLQTVHSIPLTINKEEALQRPVAS
VKLQTVHSIPLTFNKMESLQLPVAS

SEQ ID NO: 52525 - protein, 25 aa, synthetic construct
  source 1..25: note = Seed: VKLQTVHSIPLTINKEEALQRPVAS
VKLQTVHSIPLTFNKMESLQMPVAS

SEQ ID NO: 52526 - protein, 25 aa, synthetic construct
  source 1..25: note = Seed: VKLQTVHSIPLTINKEEALQRPVAS
VKLQTVHSIPLTFNKMESLQNPVAS

SEQ ID NO: 52527 - protein, 25 aa, synthetic construct
  source 1..25: note = Seed: VKLQTVHSIPLTINKEEALQRPVAS
VKLQTVHSIPLTFNKMESLQPPVAS

SEQ ID NO: 52528 - protein, 25 aa, synthetic construct
  source 1..25: note = Seed: VKLQTVHSIPLTINKEEALQRPVAS
VKLQTVHSIPLTFNKMESLQSPVAS

SEQ ID NO: 52529 - protein, 25 aa, synthetic construct
  source 1..25: note = Seed: VKLQTVHSIPLTINKEEALQRPVAS
VKLQTVHSIPLTFNKMESLQTPVAS

SEQ ID NO: 52530 - protein, 25 aa, synthetic construct
  source 1..25: note = Seed: VKLQTVHSIPLTINKEEALQRPVAS
VKLQTVHSIPLTFNKMESLQVPVAS

SEQ ID NO: 52531 - protein, 25 aa, synthetic construct
  source 1..25: note = Seed: VKLQTVHSIPLTINKEEALQRPVAS
VKLQTVHSIPLTFNKMETLQAPVAS

SEQ ID NO: 52532 - protein, 25 aa, synthetic construct
  source 1..25: note = Seed: VKLQTVHSIPLTINKEEALQRPVAS
VKLQTVHSIPLTFNKMETLQGPVAS

SEQ ID NO: 52533 - protein, 25 aa, synthetic construct
  source 1..25: note = Seed: VKLQTVHSIPLTINKEEALQRPVAS
VKLQTVHSIPLTFNKMETLQIPVAS

SEQ ID NO: 52534 - protein, 25 aa, synthetic construct
  source 1..25: note = Seed: VKLQTVHSIPLTINKEEALQRPVAS
VKLQTVHSIPLTFNKMETLQLPVAS

SEQ ID NO: 52535 - protein, 25 aa, synthetic construct
  source 1..25: note = Seed: VKLQTVHSIPLTINKEEALQRPVAS
VKLQTVHSIPLTFNKMETLQMPVAS

SEQ ID NO: 52536 - protein, 25 aa, synthetic construct
  source 1..25: note = Seed: VKLQTVHSIPLTINKEEALQRPVAS
VKLQTVHSIPLTFNKMETLQNPVAS

SEQ ID NO: 52537 - protein, 25 aa, synthetic construct
  source 1..25: note = Seed: VKLQTVHSIPLTINKEEALQRPVAS
VKLQTVHSIPLTFNKMETLQQPVAS

SEQ ID NO: 52538 - protein, 25 aa, synthetic construct
  source 1..25: note = Seed: VKLQTVHSIPLTINKEEALQRPVAS
VKLQTVHSIPLTFNKMETLQSPVAS

SEQ ID NO: 52539 - protein, 25 aa, synthetic construct
  source 1..25: note = Seed: VKLQTVHSIPLTINKEEALQRPVAS
VKLQTVHSIPLTFNKMETLQTPVAS

SEQ ID NO: 52540 - protein, 25 aa, synthetic construct
  source 1..25: note = Seed: VKLQTVHSIPLTINKEEALQRPVAS
VKLQTVHSIPLTFNKMETLQVPVAS

SEQ ID NO: 52541 - protein, 25 aa, synthetic construct
  source 1..25: note = Seed: VKLQTVHSIPLTINKEEALQRPVAS
VKLQTVHSIPLTFNKMEVLQAPVAS

SEQ ID NO: 52542 - protein, 25 aa, synthetic construct
  source 1..25: note = Seed: VKLQTVHSIPLTINKEEALQRPVAS
VKLQTVHSIPLTFNKMEVLQGPVAS

SEQ ID NO: 52543 - protein, 25 aa, synthetic construct
  source 1..25: note = Seed: VKLQTVHSIPLTINKEEALQRPVAS
VKLQTVHSIPLTFNKMEVLQIPVAS

SEQ ID NO: 52544 - protein, 25 aa, synthetic construct
  source 1..25: note = Seed: VKLQTVHSIPLTINKEEALQRPVAS
VKLQTVHSIPLTFNKMEVLQLPVAS

SEQ ID NO: 52545 - protein, 25 aa, synthetic construct
  source 1..25: note = Seed: VKLQTVHSIPLTINKEEALQRPVAS
VKLQTVHSIPLTFNKMEVLQMPVAS

SEQ ID NO: 52546 - protein, 25 aa, synthetic construct
  source 1..25: note = Seed: VKLQTVHSIPLTINKEEALQRPVAS
VKLQTVHSIPLTFNKMEVLQNPVAS

SEQ ID NO: 52547 - protein, 25 aa, synthetic construct
  source 1..25: note = Seed: VKLQTVHSIPLTINKEEALQRPVAS
VKLQTVHSIPLTFNKMEVLQSPVAS

SEQ ID NO: 52548 - protein, 25 aa, synthetic construct
  source 1..25: note = Seed: VKLQTVHSIPLTINKEEALQRPVAS
VKLQTVHSIPLTFNKMEVLQTPVAS

SEQ ID NO: 52549 - protein, 25 aa, synthetic construct
  source 1..25: note = Seed: VKLQTVHSIPLTINKEEALQRPVAS
VKLQTVHSIPLTFNKMEVLQVPVAS

SEQ ID NO: 52550 - protein, 25 aa, synthetic construct
  source 1..25: note = Seed: VKLQTVHSIPLTINKEEALQRPVAS
VKLQTVHSIPLTFNKNEALQAPVAS

SEQ ID NO: 52551 - protein, 25 aa, synthetic construct
  source 1..25: note = Seed: VKLQTVHSIPLTINKEEALQRPVAS
VKLQTVHSIPLTFNKNEALQIPVAS

SEQ ID NO: 52552 - protein, 25 aa, synthetic construct
  source 1..25: note = Seed: VKLQTVHSIPLTINKEEALQRPVAS
VKLQTVHSIPLTFNKNEALQLPVAS

SEQ ID NO: 52553 - protein, 25 aa, synthetic construct
  source 1..25: note = Seed: VKLQTVHSIPLTINKEEALQRPVAS
VKLQTVHSIPLTFNKNEALQMPVAS

SEQ ID NO: 52554 - protein, 25 aa, synthetic construct
  source 1..25: note = Seed: VKLQTVHSIPLTINKEEALQRPVAS
VKLQTVHSIPLTFNKNEALQVPVAS

SEQ ID NO: 52555 - protein, 25 aa, synthetic construct
  source 1..25: note = Seed: VKLQTVHSIPLTINKEEALQRPVAS
VKLQTVHSIPLTFNKQEALQAPVAS

SEQ ID NO: 52556 - protein, 25 aa, synthetic construct
  source 1..25: note = Seed: VKLQTVHSIPLTINKEEALQRPVAS
VKLQTVHSIPLTFNKQEALQGPVAS

SEQ ID NO: 52557 - protein, 25 aa, synthetic construct
  source 1..25: note = Seed: VKLQTVHSIPLTINKEEALQRPVAS
VKLQTVHSIPLTFNKQEALQIPVAS

SEQ ID NO: 52558 - protein, 25 aa, synthetic construct
  source 1..25: note = Seed: VKLQTVHSIPLTINKEEALQRPVAS
VKLQTVHSIPLTFNKQEALQLPVAS

SEQ ID NO: 52559 - protein, 25 aa, synthetic construct
  source 1..25: note = Seed: VKLQTVHSIPLTINKEEALQRPVAS
VKLQTVHSIPLTFNKQEALQMPVAS

SEQ ID NO: 52560 - protein, 25 aa, synthetic construct
  source 1..25: note = Seed: VKLQTVHSIPLTINKEEALQRPVAS
VKLQTVHSIPLTFNKQEALQSPVAS

SEQ ID NO: 52561 - protein, 25 aa, synthetic construct
  source 1..25: note = Seed: VKLQTVHSIPLTINKEEALQRPVAS
VKLQTVHSIPLTFNKQEALQTPVAS

SEQ ID NO: 52562 - protein, 25 aa, synthetic construct
  source 1..25: note = Seed: VKLQTVHSIPLTINKEEALQRPVAS
VKLQTVHSIPLTFNKQEALQVPVAS

SEQ ID NO: 52563 - protein, 25 aa, synthetic construct
  source 1..25: note = Seed: VKLQTVHSIPLTINKEEALQRPVAS
VKLQTVHSIPLTFNKQEGLQAPVAS

SEQ ID NO: 52564 - protein, 25 aa, synthetic construct
  source 1..25: note = Seed: VKLQTVHSIPLTINKEEALQRPVAS
VKLQTVHSIPLTFNKQEGLQIPVAS

SEQ ID NO: 52565 - protein, 25 aa, synthetic construct
  source 1..25: note = Seed: VKLQTVHSIPLTINKEEALQRPVAS
VKLQTVHSIPLTFNKQEGLQLPVAS

SEQ ID NO: 52566 - protein, 25 aa, synthetic construct
  source 1..25: note = Seed: VKLQTVHSIPLTINKEEALQRPVAS
VKLQTVHSIPLTFNKQEGLQMPVAS

SEQ ID NO: 52567 - protein, 25 aa, synthetic construct
  source 1..25: note = Seed: VKLQTVHSIPLTINKEEALQRPVAS
VKLQTVHSIPLTFNKQEGLQVPVAS

SEQ ID NO: 52568 - protein, 25 aa, synthetic construct
  source 1..25: note = Seed: VKLQTVHSIPLTINKEEALQRPVAS
VKLQTVHSIPLTFNKQENLQVPVAS

SEQ ID NO: 52569 - protein, 25 aa, synthetic construct
  source 1..25: note = Seed: VKLQTVHSIPLTINKEEALQRPVAS
VKLQTVHSIPLTFNKQEPLQAPVAS

SEQ ID NO: 52570 - protein, 25 aa, synthetic construct
  source 1..25: note = Seed: VKLQTVHSIPLTINKEEALQRPVAS
VKLQTVHSIPLTFNKQEPLQIPVAS

SEQ ID NO: 52571 - protein, 25 aa, synthetic construct
  source 1..25: note = Seed: VKLQTVHSIPLTINKEEALQRPVAS
VKLQTVHSIPLTFNKQEPLQLPVAS

SEQ ID NO: 52572 - protein, 25 aa, synthetic construct
  source 1..25: note = Seed: VKLQTVHSIPLTINKEEALQRPVAS
VKLQTVHSIPLTFNKQEPLQVPVAS

SEQ ID NO: 52573 - protein, 25 aa, synthetic construct
  source 1..25: note = Seed: VKLQTVHSIPLTINKEEALQRPVAS
VKLQTVHSIPLTFNKQESLQAPVAS

SEQ ID NO: 52574 - protein, 25 aa, synthetic construct
  source 1..25: note = Seed: VKLQTVHSIPLTINKEEALQRPVAS
VKLQTVHSIPLTFNKQESLQIPVAS

SEQ ID NO: 52575 - protein, 25 aa, synthetic construct
  source 1..25: note = Seed: VKLQTVHSIPLTINKEEALQRPVAS
VKLQTVHSIPLTFNKQESLQLPVAS

SEQ ID NO: 52576 - protein, 25 aa, synthetic construct
  source 1..25: note = Seed: VKLQTVHSIPLTINKEEALQRPVAS
VKLQTVHSIPLTFNKQESLQVPVAS

SEQ ID NO: 52577 - protein, 25 aa, synthetic construct
  source 1..25: note = Seed: VKLQTVHSIPLTINKEEALQRPVAS
VKLQTVHSIPLTFNKSEALQAPVAS

SEQ ID NO: 52578 - protein, 25 aa, synthetic construct
  source 1..25: note = Seed: VKLQTVHSIPLTINKEEALQRPVAS
VKLQTVHSIPLTFNKSEALQIPVAS

SEQ ID NO: 52579 - protein, 25 aa, synthetic construct
  source 1..25: note = Seed: VKLQTVHSIPLTINKEEALQRPVAS
VKLQTVHSIPLTFNKSEALQLPVAS

SEQ ID NO: 52580 - protein, 25 aa, synthetic construct
  source 1..25: note = Seed: VKLQTVHSIPLTINKEEALQRPVAS
VKLQTVHSIPLTFNKSEALQMPVAS

SEQ ID NO: 52581 - protein, 25 aa, synthetic construct
  source 1..25: note = Seed: VKLQTVHSIPLTINKEEALQRPVAS
VKLQTVHSIPLTFNKSEALQSPVAS

SEQ ID NO: 52582 - protein, 25 aa, synthetic construct
  source 1..25: note = Seed: VKLQTVHSIPLTINKEEALQRPVAS
VKLQTVHSIPLTFNKSEALQTPVAS

SEQ ID NO: 52583 - protein, 25 aa, synthetic construct
  source 1..25: note = Seed: VKLQTVHSIPLTINKEEALQRPVAS
VKLQTVHSIPLTFNKSEALQVPVAS

SEQ ID NO: 52584 - protein, 25 aa, synthetic construct
  source 1..25: note = Seed: VKLQTVHSIPLTINKEEALQRPVAS
VKLQTVHSIPLTFNKSEFLQIPVAS

SEQ ID NO: 52585 - protein, 25 aa, synthetic construct
  source 1..25: note = Seed: VKLQTVHSIPLTINKEEALQRPVAS
VKLQTVHSIPLTFNKSEFLQLPVAS

SEQ ID NO: 52586 - protein, 25 aa, synthetic construct
  source 1..25: note = Seed: VKLQTVHSIPLTINKEEALQRPVAS
VKLQTVHSIPLTFNKSEFLQVPVAS

SEQ ID NO: 52587 - protein, 25 aa, synthetic construct
  source 1..25: note = Seed: VKLQTVHSIPLTINKEEALQRPVAS
VKLQTVHSIPLTFNKSEGLQAPVAS

SEQ ID NO: 52588 - protein, 25 aa, synthetic construct
  source 1..25: note = Seed: VKLQTVHSIPLTINKEEALQRPVAS
VKLQTVHSIPLTFNKSEGLQIPVAS

SEQ ID NO: 52589 - protein, 25 aa, synthetic construct
  source 1..25: note = Seed: VKLQTVHSIPLTINKEEALQRPVAS
VKLQTVHSIPLTFNKSEGLQLPVAS

SEQ ID NO: 52590 - protein, 25 aa, synthetic construct
  source 1..25: note = Seed: VKLQTVHSIPLTINKEEALQRPVAS
VKLQTVHSIPLTFNKSEGLQVPVAS

SEQ ID NO: 52591 - protein, 25 aa, synthetic construct
  source 1..25: note = Seed: VKLQTVHSIPLTINKEEALQRPVAS
VKLQTVHSIPLTFNKSEPLQIPVAS

SEQ ID NO: 52592 - protein, 25 aa, synthetic construct
  source 1..25: note = Seed: VKLQTVHSIPLTINKEEALQRPVAS
VKLQTVHSIPLTFNKSEPLQLPVAS

SEQ ID NO: 52593 - protein, 25 aa, synthetic construct
  source 1..25: note = Seed: VKLQTVHSIPLTINKEEALQRPVAS
VKLQTVHSIPLTFNKSEPLQVPVAS

SEQ ID NO: 52594 - protein, 25 aa, synthetic construct
  source 1..25: note = Seed: VKLQTVHSIPLTINKEEALQRPVAS
VKLQTVHSIPLTFNKSESLQAPVAS

SEQ ID NO: 52595 - protein, 25 aa, synthetic construct
  source 1..25: note = Seed: VKLQTVHSIPLTINKEEALQRPVAS
VKLQTVHSIPLTFNKSESLQIPVAS

SEQ ID NO: 52596 - protein, 25 aa, synthetic construct
  source 1..25: note = Seed: VKLQTVHSIPLTINKEEALQRPVAS
VKLQTVHSIPLTFNKSESLQLPVAS

SEQ ID NO: 52597 - protein, 25 aa, synthetic construct
  source 1..25: note = Seed: VKLQTVHSIPLTINKEEALQRPVAS
VKLQTVHSIPLTFNKSESLQVPVAS

SEQ ID NO: 52598 - protein, 25 aa, synthetic construct
  source 1..25: note = Seed: VKLQTVHSIPLTINKEEALQRPVAS
VKLQTVHSIPLTFNKTEALQAPVAS

SEQ ID NO: 52599 - protein, 25 aa, synthetic construct
  source 1..25: note = Seed: VKLQTVHSIPLTINKEEALQRPVAS
VKLQTVHSIPLTFNKTEALQIPVAS

SEQ ID NO: 52600 - protein, 25 aa, synthetic construct
  source 1..25: note = Seed: VKLQTVHSIPLTINKEEALQRPVAS
VKLQTVHSIPLTFNKTEALQLPVAS

SEQ ID NO: 52601 - protein, 25 aa, synthetic construct
  source 1..25: note = Seed: VKLQTVHSIPLTINKEEALQRPVAS
VKLQTVHSIPLTFNKTEALQVPVAS

SEQ ID NO: 52602 - protein, 25 aa, synthetic construct
  source 1..25: note = Seed: VKLQTVHSIPLTINKEEALQRPVAS
VKLQTVHSIPLTFNKTEFLQFPVAS

SEQ ID NO: 52603 - protein, 25 aa, synthetic construct
  source 1..25: note = Seed: VKLQTVHSIPLTINKEEALQRPVAS
VKLQTVHSIPLTFNKTEFLQIPVAS

SEQ ID NO: 52604 - protein, 25 aa, synthetic construct
  source 1..25: note = Seed: VKLQTVHSIPLTINKEEALQRPVAS
VKLQTVHSIPLTFNKTEFLQLPVAS

SEQ ID NO: 52605 - protein, 25 aa, synthetic construct
  source 1..25: note = Seed: VKLQTVHSIPLTINKEEALQRPVAS
VKLQTVHSIPLTFNKTEFLQMPVAS

SEQ ID NO: 52606 - protein, 25 aa, synthetic construct
  source 1..25: note = Seed: VKLQTVHSIPLTINKEEALQRPVAS
VKLQTVHSIPLTFNKTEFLQVPVAS

SEQ ID NO: 52607 - protein, 25 aa, synthetic construct
  source 1..25: note = Seed: VKLQTVHSIPLTINKEEALQRPVAS
VKLQTVHSIPLTFNKVEALQAPVAS

SEQ ID NO: 52608 - protein, 25 aa, synthetic construct
  source 1..25: note = Seed: VKLQTVHSIPLTINKEEALQRPVAS
VKLQTVHSIPLTFNKVEALQGPVAS

SEQ ID NO: 52609 - protein, 25 aa, synthetic construct
  source 1..25: note = Seed: VKLQTVHSIPLTINKEEALQRPVAS
VKLQTVHSIPLTFNKVEALQIPVAS

SEQ ID NO: 52610 - protein, 25 aa, synthetic construct
  source 1..25: note = Seed: VKLQTVHSIPLTINKEEALQRPVAS
VKLQTVHSIPLTFNKVEALQLPVAS

SEQ ID NO: 52611 - protein, 25 aa, synthetic construct
  source 1..25: note = Seed: VKLQTVHSIPLTINKEEALQRPVAS
VKLQTVHSIPLTFNKVEALQMPVAS

SEQ ID NO: 52612 - protein, 25 aa, synthetic construct
  source 1..25: note = Seed: VKLQTVHSIPLTINKEEALQRPVAS
VKLQTVHSIPLTFNKVEALQSPVAS

SEQ ID NO: 52613 - protein, 25 aa, synthetic construct
  source 1..25: note = Seed: VKLQTVHSIPLTINKEEALQRPVAS
VKLQTVHSIPLTFNKVEALQTPVAS

SEQ ID NO: 52614 - protein, 25 aa, synthetic construct
  source 1..25: note = Seed: VKLQTVHSIPLTINKEEALQRPVAS
VKLQTVHSIPLTFNKVEALQVPVAS

SEQ ID NO: 52615 - protein, 25 aa, synthetic construct
  source 1..25: note = Seed: VKLQTVHSIPLTINKEEALQRPVAS
VKLQTVHSIPLTFNKVEGLQAPVAS

SEQ ID NO: 52616 - protein, 25 aa, synthetic construct
  source 1..25: note = Seed: VKLQTVHSIPLTINKEEALQRPVAS
VKLQTVHSIPLTFNKVEGLQIPVAS

SEQ ID NO: 52617 - protein, 25 aa, synthetic construct
  source 1..25: note = Seed: VKLQTVHSIPLTINKEEALQRPVAS
VKLQTVHSIPLTFNKVEGLQLPVAS

SEQ ID NO: 52618 - protein, 25 aa, synthetic construct
  source 1..25: note = Seed: VKLQTVHSIPLTINKEEALQRPVAS
VKLQTVHSIPLTFNKVEGLQMPVAS

SEQ ID NO: 52619 - protein, 25 aa, synthetic construct
  source 1..25: note = Seed: VKLQTVHSIPLTINKEEALQRPVAS
VKLQTVHSIPLTFNKVEGLQSPVAS

SEQ ID NO: 52620 - protein, 25 aa, synthetic construct
  source 1..25: note = Seed: VKLQTVHSIPLTINKEEALQRPVAS
VKLQTVHSIPLTFNKVEGLQTPVAS

SEQ ID NO: 52621 - protein, 25 aa, synthetic construct
  source 1..25: note = Seed: VKLQTVHSIPLTINKEEALQRPVAS
VKLQTVHSIPLTFNKVEGLQVPVAS

SEQ ID NO: 52622 - protein, 25 aa, synthetic construct
  source 1..25: note = Seed: VKLQTVHSIPLTINKEEALQRPVAS
VKLQTVHSIPLTFNKVENLQAPVAS

SEQ ID NO: 52623 - protein, 25 aa, synthetic construct
  source 1..25: note = Seed: VKLQTVHSIPLTINKEEALQRPVAS
VKLQTVHSIPLTFNKVENLQSPVAS

SEQ ID NO: 52624 - protein, 25 aa, synthetic construct
  source 1..25: note = Seed: VKLQTVHSIPLTINKEEALQRPVAS
VKLQTVHSIPLTFNKVENLQVPVAS

SEQ ID NO: 52625 - protein, 25 aa, synthetic construct
  source 1..25: note = Seed: VKLQTVHSIPLTINKEEALQRPVAS
VKLQTVHSIPLTFNKVEPLQAPVAS

SEQ ID NO: 52626 - protein, 25 aa, synthetic construct
  source 1..25: note = Seed: VKLQTVHSIPLTINKEEALQRPVAS
VKLQTVHSIPLTFNKVEPLQIPVAS

SEQ ID NO: 52627 - protein, 25 aa, synthetic construct
  source 1..25: note = Seed: VKLQTVHSIPLTINKEEALQRPVAS
VKLQTVHSIPLTFNKVEPLQLPVAS

SEQ ID NO: 52628 - protein, 25 aa, synthetic construct
  source 1..25: note = Seed: VKLQTVHSIPLTINKEEALQRPVAS
VKLQTVHSIPLTFNKVEPLQMPVAS

SEQ ID NO: 52629 - protein, 25 aa, synthetic construct
  source 1..25: note = Seed: VKLQTVHSIPLTINKEEALQRPVAS
VKLQTVHSIPLTFNKVEPLQSPVAS

SEQ ID NO: 52630 - protein, 25 aa, synthetic construct
  source 1..25: note = Seed: VKLQTVHSIPLTINKEEALQRPVAS
VKLQTVHSIPLTFNKVEPLQTPVAS

SEQ ID NO: 52631 - protein, 25 aa, synthetic construct
  source 1..25: note = Seed: VKLQTVHSIPLTINKEEALQRPVAS
VKLQTVHSIPLTFNKVEPLQVPVAS

SEQ ID NO: 52632 - protein, 25 aa, synthetic construct
  source 1..25: note = Seed: VKLQTVHSIPLTINKEEALQRPVAS
VKLQTVHSIPLTFNKVESLQAPVAS

SEQ ID NO: 52633 - protein, 25 aa, synthetic construct
  source 1..25: note = Seed: VKLQTVHSIPLTINKEEALQRPVAS
VKLQTVHSIPLTFNKVESLQGPVAS

SEQ ID NO: 52634 - protein, 25 aa, synthetic construct
  source 1..25: note = Seed: VKLQTVHSIPLTINKEEALQRPVAS
VKLQTVHSIPLTFNKVESLQIPVAS

SEQ ID NO: 52635 - protein, 25 aa, synthetic construct
  source 1..25: note = Seed: VKLQTVHSIPLTINKEEALQRPVAS
VKLQTVHSIPLTFNKVESLQLPVAS

SEQ ID NO: 52636 - protein, 25 aa, synthetic construct
  source 1..25: note = Seed: VKLQTVHSIPLTINKEEALQRPVAS
VKLQTVHSIPLTFNKVESLQSPVAS

SEQ ID NO: 52637 - protein, 25 aa, synthetic construct
  source 1..25: note = Seed: VKLQTVHSIPLTINKEEALQRPVAS
VKLQTVHSIPLTFNKVESLQTPVAS

SEQ ID NO: 52638 - protein, 25 aa, synthetic construct
  source 1..25: note = Seed: VKLQTVHSIPLTINKEEALQRPVAS
VKLQTVHSIPLTFNKVESLQVPVAS

SEQ ID NO: 52639 - protein, 25 aa, synthetic construct
  source 1..25: note = Seed: VKLQTVHSIPLTINKEEALQRPVAS
VKLQTVHSIPLTFNKVETLQAPVAS

SEQ ID NO: 52640 - protein, 25 aa, synthetic construct
  source 1..25: note = Seed: VKLQTVHSIPLTINKEEALQRPVAS
VKLQTVHSIPLTFNKVETLQSPVAS

SEQ ID NO: 52641 - protein, 25 aa, synthetic construct
  source 1..25: note = Seed: VKLQTVHSIPLTINKEEALQRPVAS
VKLQTVHSIPLTFNKVETLQVPVAS

SEQ ID NO: 52642 - protein, 25 aa, synthetic construct
  source 1..25: note = Seed: VKLQTVHSIPLTINKEEALQRPVAS
VKLQTVHSIPLTFNKWEALQIPVAS

SEQ ID NO: 52643 - protein, 25 aa, synthetic construct
  source 1..25: note = Seed: VKLQTVHSIPLTINKEEALQRPVAS
VKLQTVHSIPLTFNKWEALQVPVAS

SEQ ID NO: 52644 - protein, 25 aa, synthetic construct
  source 1..25: note = Seed: VKLQTVHSIPLTINKEEALQRPVAS
VKLQTVHSIPLTFNKYEALQLPVAS

SEQ ID NO: 52645 - protein, 25 aa, synthetic construct
  source 1..25: note = Seed: VKLQTVHSIPLTINKEEALQRPVAS
VKLQTVHSIPLTFNKYENLQIPVAS

SEQ ID NO: 52646 - protein, 25 aa, synthetic construct
  source 1..25: note = Seed: VKLQTVHSIPLTINKEEALQRPVAS
VKLQTVHSIPLTFNKYENLQLPVAS

SEQ ID NO: 52647 - protein, 25 aa, synthetic construct
  source 1..25: note = Seed: VKLQTVHSIPLTINKEEALQRPVAS
VKLQTVHSIPLTFNKYENLQVPVAS

SEQ ID NO: 52648 - protein, 25 aa, synthetic construct
  source 1..25: note = Seed: VKLQTVHSIPLTINKEEALQRPVAS
VKLQTVHSIPLTFNKYESLQAPVAS

SEQ ID NO: 52649 - protein, 25 aa, synthetic construct
  source 1..25: note = Seed: VKLQTVHSIPLTINKEEALQRPVAS
VKLQTVHSIPLTFNKYESLQIPVAS

SEQ ID NO: 52650 - protein, 25 aa, synthetic construct
  source 1..25: note = Seed: VKLQTVHSIPLTINKEEALQRPVAS
VKLQTVHSIPLTFNKYESLQLPVAS

SEQ ID NO: 52651 - protein, 25 aa, synthetic construct
  source 1..25: note = Seed: VKLQTVHSIPLTINKEEALQRPVAS
VKLQTVHSIPLTFNKYESLQVPVAS

SEQ ID NO: 52652 - protein, 25 aa, synthetic construct
  source 1..25: note = Seed: VKLQTVHSIPLTINKEEALQRPVAS
VKLQTVHSIPLTINKAEALQAPVAS

SEQ ID NO: 52653 - protein, 25 aa, synthetic construct
  source 1..25: note = Seed: VKLQTVHSIPLTINKEEALQRPVAS
VKLQTVHSIPLTINKAEALQIPVAS

SEQ ID NO: 52654 - protein, 25 aa, synthetic construct
  source 1..25: note = Seed: VKLQTVHSIPLTINKEEALQRPVAS
VKLQTVHSIPLTINKAEALQLPVAS

SEQ ID NO: 52655 - protein, 25 aa, synthetic construct
  source 1..25: note = Seed: VKLQTVHSIPLTINKEEALQRPVAS
VKLQTVHSIPLTINKAEALQRPVAS

SEQ ID NO: 52656 - protein, 25 aa, synthetic construct
  source 1..25: note = Seed: VKLQTVHSIPLTINKEEALQRPVAS
VKLQTVHSIPLTINKAEALQVPVAS

SEQ ID NO: 52657 - protein, 25 aa, synthetic construct
  source 1..25: note = Seed: VKLQTVHSIPLTINKEEALQRPVAS
VKLQTVHSIPLTINKAEGLQAPVAS

SEQ ID NO: 52658 - protein, 25 aa, synthetic construct
  source 1..25: note = Seed: VKLQTVHSIPLTINKEEALQRPVAS
VKLQTVHSIPLTINKAEGLQIPVAS

SEQ ID NO: 52659 - protein, 25 aa, synthetic construct
  source 1..25: note = Seed: VKLQTVHSIPLTINKEEALQRPVAS
VKLQTVHSIPLTINKAEGLQLPVAS

SEQ ID NO: 52660 - protein, 25 aa, synthetic construct
  source 1..25: note = Seed: VKLQTVHSIPLTINKEEALQRPVAS
VKLQTVHSIPLTINKAEGLQVPVAS

SEQ ID NO: 52661 - protein, 25 aa, synthetic construct
  source 1..25: note = Seed: VKLQTVHSIPLTINKEEALQRPVAS
VKLQTVHSIPLTINKAEKLQRPVAS

SEQ ID NO: 52662 - protein, 25 aa, synthetic construct
  source 1..25: note = Seed: VKLQTVHSIPLTINKEEALQRPVAS
VKLQTVHSIPLTINKAEKLQVPVAS

SEQ ID NO: 52663 - protein, 25 aa, synthetic construct
  source 1..25: note = Seed: VKLQTVHSIPLTINKEEALQRPVAS
VKLQTVHSIPLTINKAEKLQYPVAS

SEQ ID NO: 52664 - protein, 25 aa, synthetic construct
  source 1..25: note = Seed: VKLQTVHSIPLTINKEEALQRPVAS
VKLQTVHSIPLTINKAENLQAPVAS

SEQ ID NO: 52665 - protein, 25 aa, synthetic construct
  source 1..25: note = Seed: VKLQTVHSIPLTINKEEALQRPVAS
VKLQTVHSIPLTINKAERLQAPVAS

SEQ ID NO: 52666 - protein, 25 aa, synthetic construct
  source 1..25: note = Seed: VKLQTVHSIPLTINKEEALQRPVAS
VKLQTVHSIPLTINKAERLQFPVAS

SEQ ID NO: 52667 - protein, 25 aa, synthetic construct
  source 1..25: note = Seed: VKLQTVHSIPLTINKEEALQRPVAS
VKLQTVHSIPLTINKAERLQIPVAS

SEQ ID NO: 52668 - protein, 25 aa, synthetic construct
  source 1..25: note = Seed: VKLQTVHSIPLTINKEEALQRPVAS
VKLQTVHSIPLTINKAERLQKPVAS

SEQ ID NO: 52669 - protein, 25 aa, synthetic construct
  source 1..25: note = Seed: VKLQTVHSIPLTINKEEALQRPVAS
VKLQTVHSIPLTINKAERLQLPVAS

SEQ ID NO: 52670 - protein, 25 aa, synthetic construct
  source 1..25: note = Seed: VKLQTVHSIPLTINKEEALQRPVAS
VKLQTVHSIPLTINKAERLQMPVAS

SEQ ID NO: 52671 - protein, 25 aa, synthetic construct
  source 1..25: note = Seed: VKLQTVHSIPLTINKEEALQRPVAS
VKLQTVHSIPLTINKAERLQRPVAS

SEQ ID NO: 52672 - protein, 25 aa, synthetic construct
  source 1..25: note = Seed: VKLQTVHSIPLTINKEEALQRPVAS
VKLQTVHSIPLTINKAERLQVPVAS

SEQ ID NO: 52673 - protein, 25 aa, synthetic construct
  source 1..25: note = Seed: VKLQTVHSIPLTINKEEALQRPVAS
VKLQTVHSIPLTINKAERLQYPVAS

SEQ ID NO: 52674 - protein, 25 aa, synthetic construct
  source 1..25: note = Seed: VKLQTVHSIPLTINKEEALQRPVAS
VKLQTVHSIPLTINKDEALQFPVAS

SEQ ID NO: 52675 - protein, 25 aa, synthetic construct
  source 1..25: note = Seed: VKLQTVHSIPLTINKEEALQRPVAS
VKLQTVHSIPLTINKDEALQMPVAS

SEQ ID NO: 52676 - protein, 25 aa, synthetic construct
  source 1..25: note = Seed: VKLQTVHSIPLTINKEEALQRPVAS
VKLQTVHSIPLTINKDEALQRPVAS

SEQ ID NO: 52677 - protein, 25 aa, synthetic construct
  source 1..25: note = Seed: VKLQTVHSIPLTINKEEALQRPVAS
VKLQTVHSIPLTINKDEALQYPVAS

SEQ ID NO: 52678 - protein, 25 aa, synthetic construct
  source 1..25: note = Seed: VKLQTVHSIPLTINKEEALQRPVAS
VKLQTVHSIPLTINKDEHLQYPVAS

SEQ ID NO: 52679 - protein, 25 aa, synthetic construct
  source 1..25: note = Seed: VKLQTVHSIPLTINKEEALQRPVAS
VKLQTVHSIPLTINKDEILQRPVAS

SEQ ID NO: 52680 - protein, 25 aa, synthetic construct
  source 1..25: note = Seed: VKLQTVHSIPLTINKEEALQRPVAS
VKLQTVHSIPLTINKDEILQYPVAS

SEQ ID NO: 52681 - protein, 25 aa, synthetic construct
  source 1..25: note = Seed: VKLQTVHSIPLTINKEEALQRPVAS
VKLQTVHSIPLTINKDEKLQAPVAS

SEQ ID NO: 52682 - protein, 25 aa, synthetic construct
  source 1..25: note = Seed: VKLQTVHSIPLTINKEEALQRPVAS
VKLQTVHSIPLTINKDEKLQFPVAS

SEQ ID NO: 52683 - protein, 25 aa, synthetic construct
  source 1..25: note = Seed: VKLQTVHSIPLTINKEEALQRPVAS
VKLQTVHSIPLTINKDEKLQIPVAS

SEQ ID NO: 52684 - protein, 25 aa, synthetic construct
  source 1..25: note = Seed: VKLQTVHSIPLTINKEEALQRPVAS
VKLQTVHSIPLTINKDEKLQLPVAS

SEQ ID NO: 52685 - protein, 25 aa, synthetic construct
  source 1..25: note = Seed: VKLQTVHSIPLTINKEEALQRPVAS
VKLQTVHSIPLTINKDEKLQMPVAS

SEQ ID NO: 52686 - protein, 25 aa, synthetic construct
  source 1..25: note = Seed: VKLQTVHSIPLTINKEEALQRPVAS
VKLQTVHSIPLTINKDEKLQRPVAS

SEQ ID NO: 52687 - protein, 25 aa, synthetic construct
  source 1..25: note = Seed: VKLQTVHSIPLTINKEEALQRPVAS
VKLQTVHSIPLTINKDEKLQSPVAS

SEQ ID NO: 52688 - protein, 25 aa, synthetic construct
  source 1..25: note = Seed: VKLQTVHSIPLTINKEEALQRPVAS
VKLQTVHSIPLTINKDEKLQVPVAS

SEQ ID NO: 52689 - protein, 25 aa, synthetic construct
  source 1..25: note = Seed: VKLQTVHSIPLTINKEEALQRPVAS
VKLQTVHSIPLTINKDEKLQYPVAS

SEQ ID NO: 52690 - protein, 25 aa, synthetic construct
  source 1..25: note = Seed: VKLQTVHSIPLTINKEEALQRPVAS
VKLQTVHSIPLTINKDENLQRPVAS

SEQ ID NO: 52691 - protein, 25 aa, synthetic construct
  source 1..25: note = Seed: VKLQTVHSIPLTINKEEALQRPVAS
VKLQTVHSIPLTINKDENLQYPVAS

SEQ ID NO: 52692 - protein, 25 aa, synthetic construct
  source 1..25: note = Seed: VKLQTVHSIPLTINKEEALQRPVAS
VKLQTVHSIPLTINKDEPLQFPVAS

SEQ ID NO: 52693 - protein, 25 aa, synthetic construct
  source 1..25: note = Seed: VKLQTVHSIPLTINKEEALQRPVAS
VKLQTVHSIPLTINKDEPLQRPVAS

SEQ ID NO: 52694 - protein, 25 aa, synthetic construct
  source 1..25: note = Seed: VKLQTVHSIPLTINKEEALQRPVAS
VKLQTVHSIPLTINKDEPLQYPVAS

SEQ ID NO: 52695 - protein, 25 aa, synthetic construct
  source 1..25: note = Seed: VKLQTVHSIPLTINKEEALQRPVAS
VKLQTVHSIPLTINKDERLQAPVAS

SEQ ID NO: 52696 - protein, 25 aa, synthetic construct
  source 1..25: note = Seed: VKLQTVHSIPLTINKEEALQRPVAS
VKLQTVHSIPLTINKDERLQFPVAS

SEQ ID NO: 52697 - protein, 25 aa, synthetic construct
  source 1..25: note = Seed: VKLQTVHSIPLTINKEEALQRPVAS
VKLQTVHSIPLTINKDERLQIPVAS

SEQ ID NO: 52698 - protein, 25 aa, synthetic construct
  source 1..25: note = Seed: VKLQTVHSIPLTINKEEALQRPVAS
VKLQTVHSIPLTINKDERLQLPVAS

SEQ ID NO: 52699 - protein, 25 aa, synthetic construct
  source 1..25: note = Seed: VKLQTVHSIPLTINKEEALQRPVAS
VKLQTVHSIPLTINKDERLQMPVAS

SEQ ID NO: 52700 - protein, 25 aa, synthetic construct
  source 1..25: note = Seed: VKLQTVHSIPLTINKEEALQRPVAS
VKLQTVHSIPLTINKDERLQRPVAS

SEQ ID NO: 52701 - protein, 25 aa, synthetic construct
  source 1..25: note = Seed: VKLQTVHSIPLTINKEEALQRPVAS
VKLQTVHSIPLTINKDERLQSPVAS

SEQ ID NO: 52702 - protein, 25 aa, synthetic construct
  source 1..25: note = Seed: VKLQTVHSIPLTINKEEALQRPVAS
VKLQTVHSIPLTINKDERLQVPVAS

SEQ ID NO: 52703 - protein, 25 aa, synthetic construct
  source 1..25: note = Seed: VKLQTVHSIPLTINKEEALQRPVAS
VKLQTVHSIPLTINKDERLQYPVAS

SEQ ID NO: 52704 - protein, 25 aa, synthetic construct
  source 1..25: note = Seed: VKLQTVHSIPLTINKEEALQRPVAS
VKLQTVHSIPLTINKDESLQFPVAS

SEQ ID NO: 52705 - protein, 25 aa, synthetic construct
  source 1..25: note = Seed: VKLQTVHSIPLTINKEEALQRPVAS
VKLQTVHSIPLTINKDESLQRPVAS

SEQ ID NO: 52706 - protein, 25 aa, synthetic construct
  source 1..25: note = Seed: VKLQTVHSIPLTINKEEALQRPVAS
VKLQTVHSIPLTINKDESLQYPVAS

SEQ ID NO: 52707 - protein, 25 aa, synthetic construct
  source 1..25: note = Seed: VKLQTVHSIPLTINKEEALQRPVAS
VKLQTVHSIPLTINKDETLQFPVAS

SEQ ID NO: 52708 - protein, 25 aa, synthetic construct
  source 1..25: note = Seed: VKLQTVHSIPLTINKEEALQRPVAS
VKLQTVHSIPLTINKDETLQRPVAS

SEQ ID NO: 52709 - protein, 25 aa, synthetic construct
  source 1..25: note = Seed: VKLQTVHSIPLTINKEEALQRPVAS
VKLQTVHSIPLTINKDETLQYPVAS

SEQ ID NO: 52710 - protein, 25 aa, synthetic construct
  source 1..25: note = Seed: VKLQTVHSIPLTINKEEALQRPVAS
VKLQTVHSIPLTINKDEVLQRPVAS

SEQ ID NO: 52711 - protein, 25 aa, synthetic construct
  source 1..25: note = Seed: VKLQTVHSIPLTINKEEALQRPVAS
VKLQTVHSIPLTINKDEVLQYPVAS

SEQ ID NO: 52712 - protein, 25 aa, synthetic construct
  source 1..25: note = Seed: VKLQTVHSIPLTINKEEALQRPVAS
VKLQTVHSIPLTINKFEALQAPVAS

SEQ ID NO: 52713 - protein, 25 aa, synthetic construct
  source 1..25: note = Seed: VKLQTVHSIPLTINKEEALQRPVAS
VKLQTVHSIPLTINKFEALQLPVAS

SEQ ID NO: 52714 - protein, 25 aa, synthetic construct
  source 1..25: note = Seed: VKLQTVHSIPLTINKEEALQRPVAS
VKLQTVHSIPLTINKFEALQMPVAS

SEQ ID NO: 52715 - protein, 25 aa, synthetic construct
  source 1..25: note = Seed: VKLQTVHSIPLTINKEEALQRPVAS
VKLQTVHSIPLTINKFEALQRPVAS

SEQ ID NO: 52716 - protein, 25 aa, synthetic construct
  source 1..25: note = Seed: VKLQTVHSIPLTINKEEALQRPVAS
VKLQTVHSIPLTINKFEALQVPVAS

SEQ ID NO: 52717 - protein, 25 aa, synthetic construct
  source 1..25: note = Seed: VKLQTVHSIPLTINKEEALQRPVAS
VKLQTVHSIPLTINKFEGLQAPVAS

SEQ ID NO: 52718 - protein, 25 aa, synthetic construct
  source 1..25: note = Seed: VKLQTVHSIPLTINKEEALQRPVAS
VKLQTVHSIPLTINKFEGLQIPVAS

SEQ ID NO: 52719 - protein, 25 aa, synthetic construct
  source 1..25: note = Seed: VKLQTVHSIPLTINKEEALQRPVAS
VKLQTVHSIPLTINKFEGLQLPVAS

SEQ ID NO: 52720 - protein, 25 aa, synthetic construct
  source 1..25: note = Seed: VKLQTVHSIPLTINKEEALQRPVAS
VKLQTVHSIPLTINKFEGLQVPVAS

SEQ ID NO: 52721 - protein, 25 aa, synthetic construct
  source 1..25: note = Seed: VKLQTVHSIPLTINKEEALQRPVAS
VKLQTVHSIPLTINKFENLQAPVAS

SEQ ID NO: 52722 - protein, 25 aa, synthetic construct
  source 1..25: note = Seed: VKLQTVHSIPLTINKEEALQRPVAS
VKLQTVHSIPLTINKFENLQIPVAS

SEQ ID NO: 52723 - protein, 25 aa, synthetic construct
  source 1..25: note = Seed: VKLQTVHSIPLTINKEEALQRPVAS
VKLQTVHSIPLTINKFENLQLPVAS

SEQ ID NO: 52724 - protein, 25 aa, synthetic construct
  source 1..25: note = Seed: VKLQTVHSIPLTINKEEALQRPVAS
VKLQTVHSIPLTINKFENLQMPVAS

SEQ ID NO: 52725 - protein, 25 aa, synthetic construct
  source 1..25: note = Seed: VKLQTVHSIPLTINKEEALQRPVAS
VKLQTVHSIPLTINKFENLQSPVAS

SEQ ID NO: 52726 - protein, 25 aa, synthetic construct
  source 1..25: note = Seed: VKLQTVHSIPLTINKEEALQRPVAS
VKLQTVHSIPLTINKFENLQTPVAS

SEQ ID NO: 52727 - protein, 25 aa, synthetic construct
  source 1..25: note = Seed: VKLQTVHSIPLTINKEEALQRPVAS
VKLQTVHSIPLTINKFENLQVPVAS

SEQ ID NO: 52728 - protein, 25 aa, synthetic construct
  source 1..25: note = Seed: VKLQTVHSIPLTINKEEALQRPVAS
VKLQTVHSIPLTINKFERLQRPVAS

SEQ ID NO: 52729 - protein, 25 aa, synthetic construct
  source 1..25: note = Seed: VKLQTVHSIPLTINKEEALQRPVAS
VKLQTVHSIPLTINKFESLQAPVAS

SEQ ID NO: 52730 - protein, 25 aa, synthetic construct
  source 1..25: note = Seed: VKLQTVHSIPLTINKEEALQRPVAS
VKLQTVHSIPLTINKFESLQLPVAS

SEQ ID NO: 52731 - protein, 25 aa, synthetic construct
  source 1..25: note = Seed: VKLQTVHSIPLTINKEEALQRPVAS
VKLQTVHSIPLTINKFESLQMPVAS

SEQ ID NO: 52732 - protein, 25 aa, synthetic construct
  source 1..25: note = Seed: VKLQTVHSIPLTINKEEALQRPVAS
VKLQTVHSIPLTINKFESLQSPVAS

SEQ ID NO: 52733 - protein, 25 aa, synthetic construct
  source 1..25: note = Seed: VKLQTVHSIPLTINKEEALQRPVAS
VKLQTVHSIPLTINKFESLQTPVAS

SEQ ID NO: 52734 - protein, 25 aa, synthetic construct
  source 1..25: note = Seed: VKLQTVHSIPLTINKEEALQRPVAS
VKLQTVHSIPLTINKFESLQVPVAS

SEQ ID NO: 52735 - protein, 25 aa, synthetic construct
  source 1..25: note = Seed: VKLQTVHSIPLTINKEEALQRPVAS
VKLQTVHSIPLTINKFETLQAPVAS

SEQ ID NO: 52736 - protein, 25 aa, synthetic construct
  source 1..25: note = Seed: VKLQTVHSIPLTINKEEALQRPVAS
VKLQTVHSIPLTINKFETLQIPVAS

SEQ ID NO: 52737 - protein, 25 aa, synthetic construct
  source 1..25: note = Seed: VKLQTVHSIPLTINKEEALQRPVAS
VKLQTVHSIPLTINKFETLQLPVAS

SEQ ID NO: 52738 - protein, 25 aa, synthetic construct
  source 1..25: note = Seed: VKLQTVHSIPLTINKEEALQRPVAS
VKLQTVHSIPLTINKFETLQVPVAS

SEQ ID NO: 52739 - protein, 25 aa, synthetic construct
  source 1..25: note = Seed: VKLQTVHSIPLTINKEEALQRPVAS
VKLQTVHSIPLTINKGEALQLPVAS

SEQ ID NO: 52740 - protein, 25 aa, synthetic construct
  source 1..25: note = Seed: VKLQTVHSIPLTINKEEALQRPVAS
VKLQTVHSIPLTINKGEALQRPVAS

SEQ ID NO: 52741 - protein, 25 aa, synthetic construct
  source 1..25: note = Seed: VKLQTVHSIPLTINKEEALQRPVAS
VKLQTVHSIPLTINKHEALQRPVAS

SEQ ID NO: 52742 - protein, 25 aa, synthetic construct
  source 1..25: note = Seed: VKLQTVHSIPLTINKEEALQRPVAS
VKLQTVHSIPLTINKHERLQFPVAS

SEQ ID NO: 52743 - protein, 25 aa, synthetic construct
  source 1..25: note = Seed: VKLQTVHSIPLTINKEEALQRPVAS
VKLQTVHSIPLTINKHERLQIPVAS

SEQ ID NO: 52744 - protein, 25 aa, synthetic construct
  source 1..25: note = Seed: VKLQTVHSIPLTINKEEALQRPVAS
VKLQTVHSIPLTINKHERLQLPVAS

SEQ ID NO: 52745 - protein, 25 aa, synthetic construct
  source 1..25: note = Seed: VKLQTVHSIPLTINKEEALQRPVAS
VKLQTVHSIPLTINKHERLQRPVAS

SEQ ID NO: 52746 - protein, 25 aa, synthetic construct
  source 1..25: note = Seed: VKLQTVHSIPLTINKEEALQRPVAS
VKLQTVHSIPLTINKHERLQVPVAS

SEQ ID NO: 52747 - protein, 25 aa, synthetic construct
  source 1..25: note = Seed: VKLQTVHSIPLTINKEEALQRPVAS
VKLQTVHSIPLTINKHERLQYPVAS

SEQ ID NO: 52748 - protein, 25 aa, synthetic construct
  source 1..25: note = Seed: VKLQTVHSIPLTINKEEALQRPVAS
VKLQTVHSIPLTINKHESLQRPVAS

SEQ ID NO: 52749 - protein, 25 aa, synthetic construct
  source 1..25: note = Seed: VKLQTVHSIPLTINKEEALQRPVAS
VKLQTVHSIPLTINKIEALQIPVAS

SEQ ID NO: 52750 - protein, 25 aa, synthetic construct
  source 1..25: note = Seed: VKLQTVHSIPLTINKEEALQRPVAS
VKLQTVHSIPLTINKIEALQLPVAS

SEQ ID NO: 52751 - protein, 25 aa, synthetic construct
  source 1..25: note = Seed: VKLQTVHSIPLTINKEEALQRPVAS
VKLQTVHSIPLTINKIEALQRPVAS

SEQ ID NO: 52752 - protein, 25 aa, synthetic construct
  source 1..25: note = Seed: VKLQTVHSIPLTINKEEALQRPVAS
VKLQTVHSIPLTINKIEALQTPVAS

SEQ ID NO: 52753 - protein, 25 aa, synthetic construct
  source 1..25: note = Seed: VKLQTVHSIPLTINKEEALQRPVAS
VKLQTVHSIPLTINKIEALQVPVAS

SEQ ID NO: 52754 - protein, 25 aa, synthetic construct
  source 1..25: note = Seed: VKLQTVHSIPLTINKEEALQRPVAS
VKLQTVHSIPLTINKIEGLQAPVAS

SEQ ID NO: 52755 - protein, 25 aa, synthetic construct
  source 1..25: note = Seed: VKLQTVHSIPLTINKEEALQRPVAS
VKLQTVHSIPLTINKIEGLQIPVAS

SEQ ID NO: 52756 - protein, 25 aa, synthetic construct
  source 1..25: note = Seed: VKLQTVHSIPLTINKEEALQRPVAS
VKLQTVHSIPLTINKIEGLQLPVAS

SEQ ID NO: 52757 - protein, 25 aa, synthetic construct
  source 1..25: note = Seed: VKLQTVHSIPLTINKEEALQRPVAS
VKLQTVHSIPLTINKIEGLQVPVAS

SEQ ID NO: 52758 - protein, 25 aa, synthetic construct
  source 1..25: note = Seed: VKLQTVHSIPLTINKEEALQRPVAS
VKLQTVHSIPLTINKIEKLQRPVAS

SEQ ID NO: 52759 - protein, 25 aa, synthetic construct
  source 1..25: note = Seed: VKLQTVHSIPLTINKEEALQRPVAS
VKLQTVHSIPLTINKIENLQAPVAS

SEQ ID NO: 52760 - protein, 25 aa, synthetic construct
  source 1..25: note = Seed: VKLQTVHSIPLTINKEEALQRPVAS
VKLQTVHSIPLTINKIENLQGPVAS

SEQ ID NO: 52761 - protein, 25 aa, synthetic construct
  source 1..25: note = Seed: VKLQTVHSIPLTINKEEALQRPVAS
VKLQTVHSIPLTINKIENLQSPVAS

SEQ ID NO: 52762 - protein, 25 aa, synthetic construct
  source 1..25: note = Seed: VKLQTVHSIPLTINKEEALQRPVAS
VKLQTVHSIPLTINKIEPLQIPVAS

SEQ ID NO: 52763 - protein, 25 aa, synthetic construct
  source 1..25: note = Seed: VKLQTVHSIPLTINKEEALQRPVAS
VKLQTVHSIPLTINKIEPLQVPVAS

SEQ ID NO: 52764 - protein, 25 aa, synthetic construct
  source 1..25: note = Seed: VKLQTVHSIPLTINKEEALQRPVAS
VKLQTVHSIPLTINKIERLQHPVAS

SEQ ID NO: 52765 - protein, 25 aa, synthetic construct
  source 1..25: note = Seed: VKLQTVHSIPLTINKEEALQRPVAS
VKLQTVHSIPLTINKIERLQYPVAS

SEQ ID NO: 52766 - protein, 25 aa, synthetic construct
  source 1..25: note = Seed: VKLQTVHSIPLTINKEEALQRPVAS
VKLQTVHSIPLTINKIESLQAPVAS

SEQ ID NO: 52767 - protein, 25 aa, synthetic construct
  source 1..25: note = Seed: VKLQTVHSIPLTINKEEALQRPVAS
VKLQTVHSIPLTINKIESLQSPVAS

SEQ ID NO: 52768 - protein, 25 aa, synthetic construct
  source 1..25: note = Seed: VKLQTVHSIPLTINKEEALQRPVAS
VKLQTVHSIPLTINKIESLQVPVAS

SEQ ID NO: 52769 - protein, 25 aa, synthetic construct
  source 1..25: note = Seed: VKLQTVHSIPLTINKEEALQRPVAS
VKLQTVHSIPLTINKIETLQSPVAS

SEQ ID NO: 52770 - protein, 25 aa, synthetic construct
  source 1..25: note = Seed: VKLQTVHSIPLTINKEEALQRPVAS
VKLQTVHSIPLTINKKERLQFPVAS

SEQ ID NO: 52771 - protein, 25 aa, synthetic construct
  source 1..25: note = Seed: VKLQTVHSIPLTINKEEALQRPVAS
VKLQTVHSIPLTINKLEALQAPVAS

SEQ ID NO: 52772 - protein, 25 aa, synthetic construct
  source 1..25: note = Seed: VKLQTVHSIPLTINKEEALQRPVAS
VKLQTVHSIPLTINKLEALQGPVAS

SEQ ID NO: 52773 - protein, 25 aa, synthetic construct
  source 1..25: note = Seed: VKLQTVHSIPLTINKEEALQRPVAS
VKLQTVHSIPLTINKLEALQIPVAS

SEQ ID NO: 52774 - protein, 25 aa, synthetic construct
  source 1..25: note = Seed: VKLQTVHSIPLTINKEEALQRPVAS
VKLQTVHSIPLTINKLEALQLPVAS

SEQ ID NO: 52775 - protein, 25 aa, synthetic construct
  source 1..25: note = Seed: VKLQTVHSIPLTINKEEALQRPVAS
VKLQTVHSIPLTINKLEALQMPVAS

SEQ ID NO: 52776 - protein, 25 aa, synthetic construct
  source 1..25: note = Seed: VKLQTVHSIPLTINKEEALQRPVAS
VKLQTVHSIPLTINKLEALQNPVAS

SEQ ID NO: 52777 - protein, 25 aa, synthetic construct
  source 1..25: note = Seed: VKLQTVHSIPLTINKEEALQRPVAS
VKLQTVHSIPLTINKLEALQRPVAS

SEQ ID NO: 52778 - protein, 25 aa, synthetic construct
  source 1..25: note = Seed: VKLQTVHSIPLTINKEEALQRPVAS
VKLQTVHSIPLTINKLEALQSPVAS

SEQ ID NO: 52779 - protein, 25 aa, synthetic construct
  source 1..25: note = Seed: VKLQTVHSIPLTINKEEALQRPVAS
VKLQTVHSIPLTINKLEALQTPVAS

SEQ ID NO: 52780 - protein, 25 aa, synthetic construct
  source 1..25: note = Seed: VKLQTVHSIPLTINKEEALQRPVAS
VKLQTVHSIPLTINKLEALQVPVAS

SEQ ID NO: 52781 - protein, 25 aa, synthetic construct
  source 1..25: note = Seed: VKLQTVHSIPLTINKEEALQRPVAS
VKLQTVHSIPLTINKLEGLQAPVAS

SEQ ID NO: 52782 - protein, 25 aa, synthetic construct
  source 1..25: note = Seed: VKLQTVHSIPLTINKEEALQRPVAS
VKLQTVHSIPLTINKLEGLQGPVAS

SEQ ID NO: 52783 - protein, 25 aa, synthetic construct
  source 1..25: note = Seed: VKLQTVHSIPLTINKEEALQRPVAS
VKLQTVHSIPLTINKLEGLQIPVAS

SEQ ID NO: 52784 - protein, 25 aa, synthetic construct
  source 1..25: note = Seed: VKLQTVHSIPLTINKEEALQRPVAS
VKLQTVHSIPLTINKLEGLQLPVAS

SEQ ID NO: 52785 - protein, 25 aa, synthetic construct
  source 1..25: note = Seed: VKLQTVHSIPLTINKEEALQRPVAS
VKLQTVHSIPLTINKLEGLQMPVAS

SEQ ID NO: 52786 - protein, 25 aa, synthetic construct
  source 1..25: note = Seed: VKLQTVHSIPLTINKEEALQRPVAS
VKLQTVHSIPLTINKLEGLQSPVAS

SEQ ID NO: 52787 - protein, 25 aa, synthetic construct
  source 1..25: note = Seed: VKLQTVHSIPLTINKEEALQRPVAS
VKLQTVHSIPLTINKLEGLQTPVAS

SEQ ID NO: 52788 - protein, 25 aa, synthetic construct
  source 1..25: note = Seed: VKLQTVHSIPLTINKEEALQRPVAS
VKLQTVHSIPLTINKLEGLQVPVAS

SEQ ID NO: 52789 - protein, 25 aa, synthetic construct
  source 1..25: note = Seed: VKLQTVHSIPLTINKEEALQRPVAS
VKLQTVHSIPLTINKLENLQAPVAS

SEQ ID NO: 52790 - protein, 25 aa, synthetic construct
  source 1..25: note = Seed: VKLQTVHSIPLTINKEEALQRPVAS
VKLQTVHSIPLTINKLENLQSPVAS

SEQ ID NO: 52791 - protein, 25 aa, synthetic construct
  source 1..25: note = Seed: VKLQTVHSIPLTINKEEALQRPVAS
VKLQTVHSIPLTINKLENLQVPVAS

SEQ ID NO: 52792 - protein, 25 aa, synthetic construct
  source 1..25: note = Seed: VKLQTVHSIPLTINKEEALQRPVAS
VKLQTVHSIPLTINKLEPLQAPVAS

SEQ ID NO: 52793 - protein, 25 aa, synthetic construct
  source 1..25: note = Seed: VKLQTVHSIPLTINKEEALQRPVAS
VKLQTVHSIPLTINKLEPLQGPVAS

SEQ ID NO: 52794 - protein, 25 aa, synthetic construct
  source 1..25: note = Seed: VKLQTVHSIPLTINKEEALQRPVAS
VKLQTVHSIPLTINKLEPLQIPVAS

SEQ ID NO: 52795 - protein, 25 aa, synthetic construct
  source 1..25: note = Seed: VKLQTVHSIPLTINKEEALQRPVAS
VKLQTVHSIPLTINKLEPLQLPVAS

SEQ ID NO: 52796 - protein, 25 aa, synthetic construct
  source 1..25: note = Seed: VKLQTVHSIPLTINKEEALQRPVAS
VKLQTVHSIPLTINKLEPLQMPVAS

SEQ ID NO: 52797 - protein, 25 aa, synthetic construct
  source 1..25: note = Seed: VKLQTVHSIPLTINKEEALQRPVAS
VKLQTVHSIPLTINKLEPLQSPVAS

SEQ ID NO: 52798 - protein, 25 aa, synthetic construct
  source 1..25: note = Seed: VKLQTVHSIPLTINKEEALQRPVAS
VKLQTVHSIPLTINKLEPLQTPVAS

SEQ ID NO: 52799 - protein, 25 aa, synthetic construct
  source 1..25: note = Seed: VKLQTVHSIPLTINKEEALQRPVAS
VKLQTVHSIPLTINKLEPLQVPVAS

SEQ ID NO: 52800 - protein, 25 aa, synthetic construct
  source 1..25: note = Seed: VKLQTVHSIPLTINKEEALQRPVAS
VKLQTVHSIPLTINKLERLQRPVAS

SEQ ID NO: 52801 - protein, 25 aa, synthetic construct
  source 1..25: note = Seed: VKLQTVHSIPLTINKEEALQRPVAS
VKLQTVHSIPLTINKLESLQAPVAS

SEQ ID NO: 52802 - protein, 25 aa, synthetic construct
  source 1..25: note = Seed: VKLQTVHSIPLTINKEEALQRPVAS
VKLQTVHSIPLTINKLESLQIPVAS

SEQ ID NO: 52803 - protein, 25 aa, synthetic construct
  source 1..25: note = Seed: VKLQTVHSIPLTINKEEALQRPVAS
VKLQTVHSIPLTINKLESLQLPVAS

SEQ ID NO: 52804 - protein, 25 aa, synthetic construct
  source 1..25: note = Seed: VKLQTVHSIPLTINKEEALQRPVAS
VKLQTVHSIPLTINKLESLQSPVAS

SEQ ID NO: 52805 - protein, 25 aa, synthetic construct
  source 1..25: note = Seed: VKLQTVHSIPLTINKEEALQRPVAS
VKLQTVHSIPLTINKLESLQTPVAS

SEQ ID NO: 52806 - protein, 25 aa, synthetic construct
  source 1..25: note = Seed: VKLQTVHSIPLTINKEEALQRPVAS
VKLQTVHSIPLTINKLESLQVPVAS

SEQ ID NO: 52807 - protein, 25 aa, synthetic construct
  source 1..25: note = Seed: VKLQTVHSIPLTINKEEALQRPVAS
VKLQTVHSIPLTINKLETLQAPVAS

SEQ ID NO: 52808 - protein, 25 aa, synthetic construct
  source 1..25: note = Seed: VKLQTVHSIPLTINKEEALQRPVAS
VKLQTVHSIPLTINKLETLQSPVAS

SEQ ID NO: 52809 - protein, 25 aa, synthetic construct
  source 1..25: note = Seed: VKLQTVHSIPLTINKEEALQRPVAS
VKLQTVHSIPLTINKLETLQVPVAS

SEQ ID NO: 52810 - protein, 25 aa, synthetic construct
  source 1..25: note = Seed: VKLQTVHSIPLTINKEEALQRPVAS
VKLQTVHSIPLTINKMEALQAPVAS

SEQ ID NO: 52811 - protein, 25 aa, synthetic construct
  source 1..25: note = Seed: VKLQTVHSIPLTINKEEALQRPVAS
VKLQTVHSIPLTINKMEALQGPVAS

SEQ ID NO: 52812 - protein, 25 aa, synthetic construct
  source 1..25: note = Seed: VKLQTVHSIPLTINKEEALQRPVAS
VKLQTVHSIPLTINKMEALQIPVAS

SEQ ID NO: 52813 - protein, 25 aa, synthetic construct
  source 1..25: note = Seed: VKLQTVHSIPLTINKEEALQRPVAS
VKLQTVHSIPLTINKMEALQLPVAS

SEQ ID NO: 52814 - protein, 25 aa, synthetic construct
  source 1..25: note = Seed: VKLQTVHSIPLTINKEEALQRPVAS
VKLQTVHSIPLTINKMEALQMPVAS

SEQ ID NO: 52815 - protein, 25 aa, synthetic construct
  source 1..25: note = Seed: VKLQTVHSIPLTINKEEALQRPVAS
VKLQTVHSIPLTINKMEALQRPVAS

SEQ ID NO: 52816 - protein, 25 aa, synthetic construct
  source 1..25: note = Seed: VKLQTVHSIPLTINKEEALQRPVAS
VKLQTVHSIPLTINKMEALQSPVAS

SEQ ID NO: 52817 - protein, 25 aa, synthetic construct
  source 1..25: note = Seed: VKLQTVHSIPLTINKEEALQRPVAS
VKLQTVHSIPLTINKMEALQTPVAS

SEQ ID NO: 52818 - protein, 25 aa, synthetic construct
  source 1..25: note = Seed: VKLQTVHSIPLTINKEEALQRPVAS
VKLQTVHSIPLTINKMEALQVPVAS

SEQ ID NO: 52819 - protein, 25 aa, synthetic construct
  source 1..25: note = Seed: VKLQTVHSIPLTINKEEALQRPVAS
VKLQTVHSIPLTINKMEGLQAPVAS

SEQ ID NO: 52820 - protein, 25 aa, synthetic construct
  source 1..25: note = Seed: VKLQTVHSIPLTINKEEALQRPVAS
VKLQTVHSIPLTINKMEGLQIPVAS

SEQ ID NO: 52821 - protein, 25 aa, synthetic construct
  source 1..25: note = Seed: VKLQTVHSIPLTINKEEALQRPVAS
VKLQTVHSIPLTINKMEGLQLPVAS

SEQ ID NO: 52822 - protein, 25 aa, synthetic construct
  source 1..25: note = Seed: VKLQTVHSIPLTINKEEALQRPVAS
VKLQTVHSIPLTINKMEGLQMPVAS

SEQ ID NO: 52823 - protein, 25 aa, synthetic construct
  source 1..25: note = Seed: VKLQTVHSIPLTINKEEALQRPVAS
VKLQTVHSIPLTINKMEGLQSPVAS

SEQ ID NO: 52824 - protein, 25 aa, synthetic construct
  source 1..25: note = Seed: VKLQTVHSIPLTINKEEALQRPVAS
VKLQTVHSIPLTINKMEGLQTPVAS

SEQ ID NO: 52825 - protein, 25 aa, synthetic construct
  source 1..25: note = Seed: VKLQTVHSIPLTINKEEALQRPVAS
VKLQTVHSIPLTINKMEGLQVPVAS

SEQ ID NO: 52826 - protein, 25 aa, synthetic construct
  source 1..25: note = Seed: VKLQTVHSIPLTINKEEALQRPVAS
VKLQTVHSIPLTINKMENLQAPVAS

SEQ ID NO: 52827 - protein, 25 aa, synthetic construct
  source 1..25: note = Seed: VKLQTVHSIPLTINKEEALQRPVAS
VKLQTVHSIPLTINKMENLQGPVAS

SEQ ID NO: 52828 - protein, 25 aa, synthetic construct
  source 1..25: note = Seed: VKLQTVHSIPLTINKEEALQRPVAS
VKLQTVHSIPLTINKMENLQIPVAS

SEQ ID NO: 52829 - protein, 25 aa, synthetic construct
  source 1..25: note = Seed: VKLQTVHSIPLTINKEEALQRPVAS
VKLQTVHSIPLTINKMENLQLPVAS

SEQ ID NO: 52830 - protein, 25 aa, synthetic construct
  source 1..25: note = Seed: VKLQTVHSIPLTINKEEALQRPVAS
VKLQTVHSIPLTINKMENLQSPVAS

SEQ ID NO: 52831 - protein, 25 aa, synthetic construct
  source 1..25: note = Seed: VKLQTVHSIPLTINKEEALQRPVAS
VKLQTVHSIPLTINKMENLQVPVAS

SEQ ID NO: 52832 - protein, 25 aa, synthetic construct
  source 1..25: note = Seed: VKLQTVHSIPLTINKEEALQRPVAS
VKLQTVHSIPLTINKMEPLQAPVAS

SEQ ID NO: 52833 - protein, 25 aa, synthetic construct
  source 1..25: note = Seed: VKLQTVHSIPLTINKEEALQRPVAS
VKLQTVHSIPLTINKMEPLQIPVAS

SEQ ID NO: 52834 - protein, 25 aa, synthetic construct
  source 1..25: note = Seed: VKLQTVHSIPLTINKEEALQRPVAS
VKLQTVHSIPLTINKMEPLQLPVAS

SEQ ID NO: 52835 - protein, 25 aa, synthetic construct
  source 1..25: note = Seed: VKLQTVHSIPLTINKEEALQRPVAS
VKLQTVHSIPLTINKMEPLQMPVAS

SEQ ID NO: 52836 - protein, 25 aa, synthetic construct
  source 1..25: note = Seed: VKLQTVHSIPLTINKEEALQRPVAS
VKLQTVHSIPLTINKMEPLQSPVAS

SEQ ID NO: 52837 - protein, 25 aa, synthetic construct
  source 1..25: note = Seed: VKLQTVHSIPLTINKEEALQRPVAS
VKLQTVHSIPLTINKMEPLQTPVAS

SEQ ID NO: 52838 - protein, 25 aa, synthetic construct
  source 1..25: note = Seed: VKLQTVHSIPLTINKEEALQRPVAS
VKLQTVHSIPLTINKMEPLQVPVAS

SEQ ID NO: 52839 - protein, 25 aa, synthetic construct
  source 1..25: note = Seed: VKLQTVHSIPLTINKEEALQRPVAS
VKLQTVHSIPLTINKMERLQHPVAS

SEQ ID NO: 52840 - protein, 25 aa, synthetic construct
  source 1..25: note = Seed: VKLQTVHSIPLTINKEEALQRPVAS
VKLQTVHSIPLTINKMERLQKPVAS

SEQ ID NO: 52841 - protein, 25 aa, synthetic construct
  source 1..25: note = Seed: VKLQTVHSIPLTINKEEALQRPVAS
VKLQTVHSIPLTINKMERLQRPVAS

SEQ ID NO: 52842 - protein, 25 aa, synthetic construct
  source 1..25: note = Seed: VKLQTVHSIPLTINKEEALQRPVAS
VKLQTVHSIPLTINKMERLQYPVAS

SEQ ID NO: 52843 - protein, 25 aa, synthetic construct
  source 1..25: note = Seed: VKLQTVHSIPLTINKEEALQRPVAS
VKLQTVHSIPLTINKMESLQAPVAS

SEQ ID NO: 52844 - protein, 25 aa, synthetic construct
  source 1..25: note = Seed: VKLQTVHSIPLTINKEEALQRPVAS
VKLQTVHSIPLTINKMESLQIPVAS

SEQ ID NO: 52845 - protein, 25 aa, synthetic construct
  source 1..25: note = Seed: VKLQTVHSIPLTINKEEALQRPVAS
VKLQTVHSIPLTINKMESLQLPVAS

SEQ ID NO: 52846 - protein, 25 aa, synthetic construct
  source 1..25: note = Seed: VKLQTVHSIPLTINKEEALQRPVAS
VKLQTVHSIPLTINKMESLQMPVAS

SEQ ID NO: 52847 - protein, 25 aa, synthetic construct
  source 1..25: note = Seed: VKLQTVHSIPLTINKEEALQRPVAS
VKLQTVHSIPLTINKMESLQSPVAS

SEQ ID NO: 52848 - protein, 25 aa, synthetic construct
  source 1..25: note = Seed: VKLQTVHSIPLTINKEEALQRPVAS
VKLQTVHSIPLTINKMESLQTPVAS

SEQ ID NO: 52849 - protein, 25 aa, synthetic construct
  source 1..25: note = Seed: VKLQTVHSIPLTINKEEALQRPVAS
VKLQTVHSIPLTINKMESLQVPVAS

SEQ ID NO: 52850 - protein, 25 aa, synthetic construct
  source 1..25: note = Seed: VKLQTVHSIPLTINKEEALQRPVAS
VKLQTVHSIPLTINKMETLQAPVAS

SEQ ID NO: 52851 - protein, 25 aa, synthetic construct
  source 1..25: note = Seed: VKLQTVHSIPLTINKEEALQRPVAS
VKLQTVHSIPLTINKMETLQGPVAS

SEQ ID NO: 52852 - protein, 25 aa, synthetic construct
  source 1..25: note = Seed: VKLQTVHSIPLTINKEEALQRPVAS
VKLQTVHSIPLTINKMETLQIPVAS

SEQ ID NO: 52853 - protein, 25 aa, synthetic construct
  source 1..25: note = Seed: VKLQTVHSIPLTINKEEALQRPVAS
VKLQTVHSIPLTINKMETLQSPVAS

SEQ ID NO: 52854 - protein, 25 aa, synthetic construct
  source 1..25: note = Seed: VKLQTVHSIPLTINKEEALQRPVAS
VKLQTVHSIPLTINKMETLQVPVAS

SEQ ID NO: 52855 - protein, 25 aa, synthetic construct
  source 1..25: note = Seed: VKLQTVHSIPLTINKEEALQRPVAS
VKLQTVHSIPLTINKNEALQRPVAS

SEQ ID NO: 52856 - protein, 25 aa, synthetic construct
  source 1..25: note = Seed: VKLQTVHSIPLTINKEEALQRPVAS
VKLQTVHSIPLTINKPEALQRPVAS

SEQ ID NO: 52857 - protein, 25 aa, synthetic construct
  source 1..25: note = Seed: VKLQTVHSIPLTINKEEALQRPVAS
VKLQTVHSIPLTINKQEALQAPVAS

SEQ ID NO: 52858 - protein, 25 aa, synthetic construct
  source 1..25: note = Seed: VKLQTVHSIPLTINKEEALQRPVAS
VKLQTVHSIPLTINKQEALQIPVAS

SEQ ID NO: 52859 - protein, 25 aa, synthetic construct
  source 1..25: note = Seed: VKLQTVHSIPLTINKEEALQRPVAS
VKLQTVHSIPLTINKQEALQLPVAS

SEQ ID NO: 52860 - protein, 25 aa, synthetic construct
  source 1..25: note = Seed: VKLQTVHSIPLTINKEEALQRPVAS
VKLQTVHSIPLTINKQEALQVPVAS

SEQ ID NO: 52861 - protein, 25 aa, synthetic construct
  source 1..25: note = Seed: VKLQTVHSIPLTINKEEALQRPVAS
VKLQTVHSIPLTINKRERLQYPVAS

SEQ ID NO: 52862 - protein, 25 aa, synthetic construct
  source 1..25: note = Seed: VKLQTVHSIPLTINKEEALQRPVAS
VKLQTVHSIPLTINKSEALQRPVAS

SEQ ID NO: 52863 - protein, 25 aa, synthetic construct
  source 1..25: note = Seed: VKLQTVHSIPLTINKEEALQRPVAS
VKLQTVHSIPLTINKSERLQRPVAS

SEQ ID NO: 52864 - protein, 25 aa, synthetic construct
  source 1..25: note = Seed: VKLQTVHSIPLTINKEEALQRPVAS
VKLQTVHSIPLTINKSERLQYPVAS

SEQ ID NO: 52865 - protein, 25 aa, synthetic construct
  source 1..25: note = Seed: VKLQTVHSIPLTINKEEALQRPVAS
VKLQTVHSIPLTINKTEALQRPVAS

SEQ ID NO: 52866 - protein, 25 aa, synthetic construct
  source 1..25: note = Seed: VKLQTVHSIPLTINKEEALQRPVAS
VKLQTVHSIPLTINKVEALQRPVAS

SEQ ID NO: 52867 - protein, 25 aa, synthetic construct
  source 1..25: note = Seed: VKLQTVHSIPLTINKEEALQRPVAS
VKLQTVHSIPLTINKVEALQVPVAS

SEQ ID NO: 52868 - protein, 25 aa, synthetic construct
  source 1..25: note = Seed: VKLQTVHSIPLTINKEEALQRPVAS
VKLQTVHSIPLTINKVEKLQRPVAS

SEQ ID NO: 52869 - protein, 25 aa, synthetic construct
  source 1..25: note = Seed: VKLQTVHSIPLTINKEEALQRPVAS
VKLQTVHSIPLTINKVENLQAPVAS

SEQ ID NO: 52870 - protein, 25 aa, synthetic construct
  source 1..25: note = Seed: VKLQTVHSIPLTINKEEALQRPVAS
VKLQTVHSIPLTINKVENLQSPVAS

SEQ ID NO: 52871 - protein, 25 aa, synthetic construct
  source 1..25: note = Seed: VKLQTVHSIPLTINKEEALQRPVAS
VKLQTVHSIPLTINKVERLQKPVAS

SEQ ID NO: 52872 - protein, 25 aa, synthetic construct
  source 1..25: note = Seed: VKLQTVHSIPLTINKEEALQRPVAS
VKLQTVHSIPLTINKVERLQRPVAS

SEQ ID NO: 52873 - protein, 25 aa, synthetic construct
  source 1..25: note = Seed: VKLQTVHSIPLTINKEEALQRPVAS
VKLQTVHSIPLTINKVERLQYPVAS

SEQ ID NO: 52874 - protein, 25 aa, synthetic construct
  source 1..25: note = Seed: VKLQTVHSIPLTINKEEALQRPVAS
VKLQTVHSIPLTINKVETLQAPVAS

SEQ ID NO: 52875 - protein, 25 aa, synthetic construct
  source 1..25: note = Seed: VKLQTVHSIPLTINKEEALQRPVAS
VKLQTVHSIPLTINKVETLQSPVAS

SEQ ID NO: 52876 - protein, 25 aa, synthetic construct
  source 1..25: note = Seed: VKLQTVHSIPLTINKEEALQRPVAS
VKLQTVHSIPLTINKWEALQIPVAS

SEQ ID NO: 52877 - protein, 25 aa, synthetic construct
  source 1..25: note = Seed: VKLQTVHSIPLTINKEEALQRPVAS
VKLQTVHSIPLTINKWEALQLPVAS

SEQ ID NO: 52878 - protein, 25 aa, synthetic construct
  source 1..25: note = Seed: VKLQTVHSIPLTINKEEALQRPVAS
VKLQTVHSIPLTINKWEALQRPVAS

SEQ ID NO: 52879 - protein, 25 aa, synthetic construct
  source 1..25: note = Seed: VKLQTVHSIPLTINKEEALQRPVAS
VKLQTVHSIPLTINKWEALQVPVAS

SEQ ID NO: 52880 - protein, 25 aa, synthetic construct
  source 1..25: note = Seed: VKLQTVHSIPLTINKEEALQRPVAS
VKLQTVHSIPLTINKWEGLQIPVAS

SEQ ID NO: 52881 - protein, 25 aa, synthetic construct
  source 1..25: note = Seed: VKLQTVHSIPLTINKEEALQRPVAS
VKLQTVHSIPLTINKWEGLQLPVAS

SEQ ID NO: 52882 - protein, 25 aa, synthetic construct
  source 1..25: note = Seed: VKLQTVHSIPLTINKEEALQRPVAS
VKLQTVHSIPLTINKWEGLQVPVAS

SEQ ID NO: 52883 - protein, 25 aa, synthetic construct
  source 1..25: note = Seed: VKLQTVHSIPLTINKEEALQRPVAS
VKLQTVHSIPLTINKWENLQAPVAS

SEQ ID NO: 52884 - protein, 25 aa, synthetic construct
  source 1..25: note = Seed: VKLQTVHSIPLTINKEEALQRPVAS
VKLQTVHSIPLTINKWENLQIPVAS

SEQ ID NO: 52885 - protein, 25 aa, synthetic construct
  source 1..25: note = Seed: VKLQTVHSIPLTINKEEALQRPVAS
VKLQTVHSIPLTINKWENLQLPVAS

SEQ ID NO: 52886 - protein, 25 aa, synthetic construct
  source 1..25: note = Seed: VKLQTVHSIPLTINKEEALQRPVAS
VKLQTVHSIPLTINKWENLQVPVAS

SEQ ID NO: 52887 - protein, 25 aa, synthetic construct
  source 1..25: note = Seed: VKLQTVHSIPLTINKEEALQRPVAS
VKLQTVHSIPLTINKWERLQRPVAS

SEQ ID NO: 52888 - protein, 25 aa, synthetic construct
  source 1..25: note = Seed: VKLQTVHSIPLTINKEEALQRPVAS
VKLQTVHSIPLTINKWESLQAPVAS

SEQ ID NO: 52889 - protein, 25 aa, synthetic construct
  source 1..25: note = Seed: VKLQTVHSIPLTINKEEALQRPVAS
VKLQTVHSIPLTINKWESLQIPVAS

SEQ ID NO: 52890 - protein, 25 aa, synthetic construct
  source 1..25: note = Seed: VKLQTVHSIPLTINKEEALQRPVAS
VKLQTVHSIPLTINKWESLQLPVAS

SEQ ID NO: 52891 - protein, 25 aa, synthetic construct
  source 1..25: note = Seed: VKLQTVHSIPLTINKEEALQRPVAS
VKLQTVHSIPLTINKWESLQVPVAS

SEQ ID NO: 52892 - protein, 25 aa, synthetic construct
  source 1..25: note = Seed: VKLQTVHSIPLTINKEEALQRPVAS
VKLQTVHSIPLTINKYEALQAPVAS

SEQ ID NO: 52893 - protein, 25 aa, synthetic construct
  source 1..25: note = Seed: VKLQTVHSIPLTINKEEALQRPVAS
VKLQTVHSIPLTINKYEALQIPVAS

SEQ ID NO: 52894 - protein, 25 aa, synthetic construct
  source 1..25: note = Seed: VKLQTVHSIPLTINKEEALQRPVAS
VKLQTVHSIPLTINKYEALQLPVAS

SEQ ID NO: 52895 - protein, 25 aa, synthetic construct
  source 1..25: note = Seed: VKLQTVHSIPLTINKEEALQRPVAS
VKLQTVHSIPLTINKYEALQMPVAS

SEQ ID NO: 52896 - protein, 25 aa, synthetic construct
  source 1..25: note = Seed: VKLQTVHSIPLTINKEEALQRPVAS
VKLQTVHSIPLTINKYEALQRPVAS

SEQ ID NO: 52897 - protein, 25 aa, synthetic construct
  source 1..25: note = Seed: VKLQTVHSIPLTINKEEALQRPVAS
VKLQTVHSIPLTINKYEALQSPVAS

SEQ ID NO: 52898 - protein, 25 aa, synthetic construct
  source 1..25: note = Seed: VKLQTVHSIPLTINKEEALQRPVAS
VKLQTVHSIPLTINKYEALQTPVAS

SEQ ID NO: 52899 - protein, 25 aa, synthetic construct
  source 1..25: note = Seed: VKLQTVHSIPLTINKEEALQRPVAS
VKLQTVHSIPLTINKYEALQVPVAS

SEQ ID NO: 52900 - protein, 25 aa, synthetic construct
  source 1..25: note = Seed: VKLQTVHSIPLTINKEEALQRPVAS
VKLQTVHSIPLTINKYEGLQAPVAS

SEQ ID NO: 52901 - protein, 25 aa, synthetic construct
  source 1..25: note = Seed: VKLQTVHSIPLTINKEEALQRPVAS
VKLQTVHSIPLTINKYEGLQIPVAS

SEQ ID NO: 52902 - protein, 25 aa, synthetic construct
  source 1..25: note = Seed: VKLQTVHSIPLTINKEEALQRPVAS
VKLQTVHSIPLTINKYEGLQLPVAS

SEQ ID NO: 52903 - protein, 25 aa, synthetic construct
  source 1..25: note = Seed: VKLQTVHSIPLTINKEEALQRPVAS
VKLQTVHSIPLTINKYEGLQMPVAS

SEQ ID NO: 52904 - protein, 25 aa, synthetic construct
  source 1..25: note = Seed: VKLQTVHSIPLTINKEEALQRPVAS
VKLQTVHSIPLTINKYEGLQSPVAS

SEQ ID NO: 52905 - protein, 25 aa, synthetic construct
  source 1..25: note = Seed: VKLQTVHSIPLTINKEEALQRPVAS
VKLQTVHSIPLTINKYEGLQTPVAS

SEQ ID NO: 52906 - protein, 25 aa, synthetic construct
  source 1..25: note = Seed: VKLQTVHSIPLTINKEEALQRPVAS
VKLQTVHSIPLTINKYEGLQVPVAS

SEQ ID NO: 52907 - protein, 25 aa, synthetic construct
  source 1..25: note = Seed: VKLQTVHSIPLTINKEEALQRPVAS
VKLQTVHSIPLTINKYENLQAPVAS

SEQ ID NO: 52908 - protein, 25 aa, synthetic construct
  source 1..25: note = Seed: VKLQTVHSIPLTINKEEALQRPVAS
VKLQTVHSIPLTINKYENLQFPVAS

SEQ ID NO: 52909 - protein, 25 aa, synthetic construct
  source 1..25: note = Seed: VKLQTVHSIPLTINKEEALQRPVAS
VKLQTVHSIPLTINKYENLQIPVAS

SEQ ID NO: 52910 - protein, 25 aa, synthetic construct
  source 1..25: note = Seed: VKLQTVHSIPLTINKEEALQRPVAS
VKLQTVHSIPLTINKYENLQLPVAS

SEQ ID NO: 52911 - protein, 25 aa, synthetic construct
  source 1..25: note = Seed: VKLQTVHSIPLTINKEEALQRPVAS
VKLQTVHSIPLTINKYENLQMPVAS

SEQ ID NO: 52912 - protein, 25 aa, synthetic construct
  source 1..25: note = Seed: VKLQTVHSIPLTINKEEALQRPVAS
VKLQTVHSIPLTINKYENLQSPVAS

SEQ ID NO: 52913 - protein, 25 aa, synthetic construct
  source 1..25: note = Seed: VKLQTVHSIPLTINKEEALQRPVAS
VKLQTVHSIPLTINKYENLQTPVAS

SEQ ID NO: 52914 - protein, 25 aa, synthetic construct
  source 1..25: note = Seed: VKLQTVHSIPLTINKEEALQRPVAS
VKLQTVHSIPLTINKYENLQVPVAS

SEQ ID NO: 52915 - protein, 25 aa, synthetic construct
  source 1..25: note = Seed: VKLQTVHSIPLTINKEEALQRPVAS
VKLQTVHSIPLTINKYESLQAPVAS

SEQ ID NO: 52916 - protein, 25 aa, synthetic construct
  source 1..25: note = Seed: VKLQTVHSIPLTINKEEALQRPVAS
VKLQTVHSIPLTINKYESLQFPVAS

SEQ ID NO: 52917 - protein, 25 aa, synthetic construct
  source 1..25: note = Seed: VKLQTVHSIPLTINKEEALQRPVAS
VKLQTVHSIPLTINKYESLQGPVAS

SEQ ID NO: 52918 - protein, 25 aa, synthetic construct
  source 1..25: note = Seed: VKLQTVHSIPLTINKEEALQRPVAS
VKLQTVHSIPLTINKYESLQIPVAS

SEQ ID NO: 52919 - protein, 25 aa, synthetic construct
  source 1..25: note = Seed: VKLQTVHSIPLTINKEEALQRPVAS
VKLQTVHSIPLTINKYESLQLPVAS

SEQ ID NO: 52920 - protein, 25 aa, synthetic construct
  source 1..25: note = Seed: VKLQTVHSIPLTINKEEALQRPVAS
VKLQTVHSIPLTINKYESLQMPVAS

SEQ ID NO: 52921 - protein, 25 aa, synthetic construct
  source 1..25: note = Seed: VKLQTVHSIPLTINKEEALQRPVAS
VKLQTVHSIPLTINKYESLQSPVAS

SEQ ID NO: 52922 - protein, 25 aa, synthetic construct
  source 1..25: note = Seed: VKLQTVHSIPLTINKEEALQRPVAS
VKLQTVHSIPLTINKYESLQTPVAS

SEQ ID NO: 52923 - protein, 25 aa, synthetic construct
  source 1..25: note = Seed: VKLQTVHSIPLTINKEEALQRPVAS
VKLQTVHSIPLTINKYESLQVPVAS

SEQ ID NO: 52924 - protein, 25 aa, synthetic construct
  source 1..25: note = Seed: VKLQTVHSIPLTINKEEALQRPVAS
VKLQTVHSIPLTINKYETLQAPVAS

SEQ ID NO: 52925 - protein, 25 aa, synthetic construct
  source 1..25: note = Seed: VKLQTVHSIPLTINKEEALQRPVAS
VKLQTVHSIPLTINKYETLQIPVAS

SEQ ID NO: 52926 - protein, 25 aa, synthetic construct
  source 1..25: note = Seed: VKLQTVHSIPLTINKEEALQRPVAS
VKLQTVHSIPLTINKYETLQLPVAS

SEQ ID NO: 52927 - protein, 25 aa, synthetic construct
  source 1..25: note = Seed: VKLQTVHSIPLTINKEEALQRPVAS
VKLQTVHSIPLTINKYETLQVPVAS

SEQ ID NO: 52928 - protein, 25 aa, synthetic construct
  source 1..25: note = Seed: VKLQTVHSIPLTINKEEALQRPVAS
VKLQTVHSIPLTLNKAEALQAPVAS

SEQ ID NO: 52929 - protein, 25 aa, synthetic construct
  source 1..25: note = Seed: VKLQTVHSIPLTINKEEALQRPVAS
VKLQTVHSIPLTLNKAEALQIPVAS

SEQ ID NO: 52930 - protein, 25 aa, synthetic construct
  source 1..25: note = Seed: VKLQTVHSIPLTINKEEALQRPVAS
VKLQTVHSIPLTLNKAEALQLPVAS

SEQ ID NO: 52931 - protein, 25 aa, synthetic construct
  source 1..25: note = Seed: VKLQTVHSIPLTINKEEALQRPVAS
VKLQTVHSIPLTLNKAEALQVPVAS

SEQ ID NO: 52932 - protein, 25 aa, synthetic construct
  source 1..25: note = Seed: VKLQTVHSIPLTINKEEALQRPVAS
VKLQTVHSIPLTLNKAEGLQIPVAS

SEQ ID NO: 52933 - protein, 25 aa, synthetic construct
  source 1..25: note = Seed: VKLQTVHSIPLTINKEEALQRPVAS
VKLQTVHSIPLTLNKAEGLQLPVAS

SEQ ID NO: 52934 - protein, 25 aa, synthetic construct
  source 1..25: note = Seed: VKLQTVHSIPLTINKEEALQRPVAS
VKLQTVHSIPLTLNKAEGLQVPVAS

SEQ ID NO: 52935 - protein, 25 aa, synthetic construct
  source 1..25: note = Seed: VKLQTVHSIPLTINKEEALQRPVAS
VKLQTVHSIPLTLNKAEKLQRPVAS

SEQ ID NO: 52936 - protein, 25 aa, synthetic construct
  source 1..25: note = Seed: VKLQTVHSIPLTINKEEALQRPVAS
VKLQTVHSIPLTLNKAERLQMPVAS

SEQ ID NO: 52937 - protein, 25 aa, synthetic construct
  source 1..25: note = Seed: VKLQTVHSIPLTINKEEALQRPVAS
VKLQTVHSIPLTLNKAERLQRPVAS

SEQ ID NO: 52938 - protein, 25 aa, synthetic construct
  source 1..25: note = Seed: VKLQTVHSIPLTINKEEALQRPVAS
VKLQTVHSIPLTLNKAERLQYPVAS

SEQ ID NO: 52939 - protein, 25 aa, synthetic construct
  source 1..25: note = Seed: VKLQTVHSIPLTINKEEALQRPVAS
VKLQTVHSIPLTLNKDEALQRPVAS

SEQ ID NO: 52940 - protein, 25 aa, synthetic construct
  source 1..25: note = Seed: VKLQTVHSIPLTINKEEALQRPVAS
VKLQTVHSIPLTLNKDEALQYPVAS

SEQ ID NO: 52941 - protein, 25 aa, synthetic construct
  source 1..25: note = Seed: VKLQTVHSIPLTINKEEALQRPVAS
VKLQTVHSIPLTLNKDEILQRPVAS

SEQ ID NO: 52942 - protein, 25 aa, synthetic construct
  source 1..25: note = Seed: VKLQTVHSIPLTINKEEALQRPVAS
VKLQTVHSIPLTLNKDEKLQFPVAS

SEQ ID NO: 52943 - protein, 25 aa, synthetic construct
  source 1..25: note = Seed: VKLQTVHSIPLTINKEEALQRPVAS
VKLQTVHSIPLTLNKDEKLQLPVAS

SEQ ID NO: 52944 - protein, 25 aa, synthetic construct
  source 1..25: note = Seed: VKLQTVHSIPLTINKEEALQRPVAS
VKLQTVHSIPLTLNKDEKLQMPVAS

SEQ ID NO: 52945 - protein, 25 aa, synthetic construct
  source 1..25: note = Seed: VKLQTVHSIPLTINKEEALQRPVAS
VKLQTVHSIPLTLNKDEKLQRPVAS

SEQ ID NO: 52946 - protein, 25 aa, synthetic construct
  source 1..25: note = Seed: VKLQTVHSIPLTINKEEALQRPVAS
VKLQTVHSIPLTLNKDEKLQVPVAS

SEQ ID NO: 52947 - protein, 25 aa, synthetic construct
  source 1..25: note = Seed: VKLQTVHSIPLTINKEEALQRPVAS
VKLQTVHSIPLTLNKDEKLQYPVAS

SEQ ID NO: 52948 - protein, 25 aa, synthetic construct
  source 1..25: note = Seed: VKLQTVHSIPLTINKEEALQRPVAS
VKLQTVHSIPLTLNKDEPLQRPVAS

SEQ ID NO: 52949 - protein, 25 aa, synthetic construct
  source 1..25: note = Seed: VKLQTVHSIPLTINKEEALQRPVAS
VKLQTVHSIPLTLNKDEPLQYPVAS

SEQ ID NO: 52950 - protein, 25 aa, synthetic construct
  source 1..25: note = Seed: VKLQTVHSIPLTINKEEALQRPVAS
VKLQTVHSIPLTLNKDERLQFPVAS

SEQ ID NO: 52951 - protein, 25 aa, synthetic construct
  source 1..25: note = Seed: VKLQTVHSIPLTINKEEALQRPVAS
VKLQTVHSIPLTLNKDERLQLPVAS

SEQ ID NO: 52952 - protein, 25 aa, synthetic construct
  source 1..25: note = Seed: VKLQTVHSIPLTINKEEALQRPVAS
VKLQTVHSIPLTLNKDERLQMPVAS

SEQ ID NO: 52953 - protein, 25 aa, synthetic construct
  source 1..25: note = Seed: VKLQTVHSIPLTINKEEALQRPVAS
VKLQTVHSIPLTLNKDERLQRPVAS

SEQ ID NO: 52954 - protein, 25 aa, synthetic construct
  source 1..25: note = Seed: VKLQTVHSIPLTINKEEALQRPVAS
VKLQTVHSIPLTLNKDERLQYPVAS

SEQ ID NO: 52955 - protein, 25 aa, synthetic construct
  source 1..25: note = Seed: VKLQTVHSIPLTINKEEALQRPVAS
VKLQTVHSIPLTLNKDESLQRPVAS

SEQ ID NO: 52956 - protein, 25 aa, synthetic construct
  source 1..25: note = Seed: VKLQTVHSIPLTINKEEALQRPVAS
VKLQTVHSIPLTLNKDESLQYPVAS

SEQ ID NO: 52957 - protein, 25 aa, synthetic construct
  source 1..25: note = Seed: VKLQTVHSIPLTINKEEALQRPVAS
VKLQTVHSIPLTLNKDETLQRPVAS

SEQ ID NO: 52958 - protein, 25 aa, synthetic construct
  source 1..25: note = Seed: VKLQTVHSIPLTINKEEALQRPVAS
VKLQTVHSIPLTLNKDETLQYPVAS

SEQ ID NO: 52959 - protein, 25 aa, synthetic construct
  source 1..25: note = Seed: VKLQTVHSIPLTINKEEALQRPVAS
VKLQTVHSIPLTLNKDEVLQRPVAS

SEQ ID NO: 52960 - protein, 25 aa, synthetic construct
  source 1..25: note = Seed: VKLQTVHSIPLTINKEEALQRPVAS
VKLQTVHSIPLTLNKDEVLQYPVAS

SEQ ID NO: 52961 - protein, 25 aa, synthetic construct
  source 1..25: note = Seed: VKLQTVHSIPLTINKEEALQRPVAS
VKLQTVHSIPLTLNKFEGLQVPVAS

SEQ ID NO: 52962 - protein, 25 aa, synthetic construct
  source 1..25: note = Seed: VKLQTVHSIPLTINKEEALQRPVAS
VKLQTVHSIPLTLNKFENLQAPVAS

SEQ ID NO: 52963 - protein, 25 aa, synthetic construct
  source 1..25: note = Seed: VKLQTVHSIPLTINKEEALQRPVAS
VKLQTVHSIPLTLNKFENLQIPVAS

SEQ ID NO: 52964 - protein, 25 aa, synthetic construct
  source 1..25: note = Seed: VKLQTVHSIPLTINKEEALQRPVAS
VKLQTVHSIPLTLNKFENLQLPVAS

SEQ ID NO: 52965 - protein, 25 aa, synthetic construct
  source 1..25: note = Seed: VKLQTVHSIPLTINKEEALQRPVAS
VKLQTVHSIPLTLNKFENLQVPVAS

SEQ ID NO: 52966 - protein, 25 aa, synthetic construct
  source 1..25: note = Seed: VKLQTVHSIPLTINKEEALQRPVAS
VKLQTVHSIPLTLNKFERLQRPVAS

SEQ ID NO: 52967 - protein, 25 aa, synthetic construct
  source 1..25: note = Seed: VKLQTVHSIPLTINKEEALQRPVAS
VKLQTVHSIPLTLNKFESLQAPVAS

SEQ ID NO: 52968 - protein, 25 aa, synthetic construct
  source 1..25: note = Seed: VKLQTVHSIPLTINKEEALQRPVAS
VKLQTVHSIPLTLNKFESLQIPVAS

SEQ ID NO: 52969 - protein, 25 aa, synthetic construct
  source 1..25: note = Seed: VKLQTVHSIPLTINKEEALQRPVAS
VKLQTVHSIPLTLNKFESLQLPVAS

SEQ ID NO: 52970 - protein, 25 aa, synthetic construct
  source 1..25: note = Seed: VKLQTVHSIPLTINKEEALQRPVAS
VKLQTVHSIPLTLNKFESLQVPVAS

SEQ ID NO: 52971 - protein, 25 aa, synthetic construct
  source 1..25: note = Seed: VKLQTVHSIPLTINKEEALQRPVAS
VKLQTVHSIPLTLNKHEALQRPVAS

SEQ ID NO: 52972 - protein, 25 aa, synthetic construct
  source 1..25: note = Seed: VKLQTVHSIPLTINKEEALQRPVAS
VKLQTVHSIPLTLNKHERLQRPVAS

SEQ ID NO: 52973 - protein, 25 aa, synthetic construct
  source 1..25: note = Seed: VKLQTVHSIPLTINKEEALQRPVAS
VKLQTVHSIPLTLNKIEALQIPVAS

SEQ ID NO: 52974 - protein, 25 aa, synthetic construct
  source 1..25: note = Seed: VKLQTVHSIPLTINKEEALQRPVAS
VKLQTVHSIPLTLNKIEALQLPVAS

SEQ ID NO: 52975 - protein, 25 aa, synthetic construct
  source 1..25: note = Seed: VKLQTVHSIPLTINKEEALQRPVAS
VKLQTVHSIPLTLNKIEALQVPVAS

SEQ ID NO: 52976 - protein, 25 aa, synthetic construct
  source 1..25: note = Seed: VKLQTVHSIPLTINKEEALQRPVAS
VKLQTVHSIPLTLNKIEGLQVPVAS

SEQ ID NO: 52977 - protein, 25 aa, synthetic construct
  source 1..25: note = Seed: VKLQTVHSIPLTINKEEALQRPVAS
VKLQTVHSIPLTLNKIEKLQRPVAS

SEQ ID NO: 52978 - protein, 25 aa, synthetic construct
  source 1..25: note = Seed: VKLQTVHSIPLTINKEEALQRPVAS
VKLQTVHSIPLTLNKIENLQAPVAS

SEQ ID NO: 52979 - protein, 25 aa, synthetic construct
  source 1..25: note = Seed: VKLQTVHSIPLTINKEEALQRPVAS
VKLQTVHSIPLTLNKIENLQSPVAS

SEQ ID NO: 52980 - protein, 25 aa, synthetic construct
  source 1..25: note = Seed: VKLQTVHSIPLTINKEEALQRPVAS
VKLQTVHSIPLTLNKIERLQKPVAS

SEQ ID NO: 52981 - protein, 25 aa, synthetic construct
  source 1..25: note = Seed: VKLQTVHSIPLTINKEEALQRPVAS
VKLQTVHSIPLTLNKIERLQRPVAS

SEQ ID NO: 52982 - protein, 25 aa, synthetic construct
  source 1..25: note = Seed: VKLQTVHSIPLTINKEEALQRPVAS
VKLQTVHSIPLTLNKIERLQYPVAS

SEQ ID NO: 52983 - protein, 25 aa, synthetic construct
  source 1..25: note = Seed: VKLQTVHSIPLTINKEEALQRPVAS
VKLQTVHSIPLTLNKIETLQAPVAS

SEQ ID NO: 52984 - protein, 25 aa, synthetic construct
  source 1..25: note = Seed: VKLQTVHSIPLTINKEEALQRPVAS
VKLQTVHSIPLTLNKIETLQSPVAS

SEQ ID NO: 52985 - protein, 25 aa, synthetic construct
  source 1..25: note = Seed: VKLQTVHSIPLTINKEEALQRPVAS
VKLQTVHSIPLTLNKLEALQAPVAS

SEQ ID NO: 52986 - protein, 25 aa, synthetic construct
  source 1..25: note = Seed: VKLQTVHSIPLTINKEEALQRPVAS
VKLQTVHSIPLTLNKLEALQIPVAS

SEQ ID NO: 52987 - protein, 25 aa, synthetic construct
  source 1..25: note = Seed: VKLQTVHSIPLTINKEEALQRPVAS
VKLQTVHSIPLTLNKLEALQLPVAS

SEQ ID NO: 52988 - protein, 25 aa, synthetic construct
  source 1..25: note = Seed: VKLQTVHSIPLTINKEEALQRPVAS
VKLQTVHSIPLTLNKLEALQMPVAS

SEQ ID NO: 52989 - protein, 25 aa, synthetic construct
  source 1..25: note = Seed: VKLQTVHSIPLTINKEEALQRPVAS
VKLQTVHSIPLTLNKLEALQSPVAS

SEQ ID NO: 52990 - protein, 25 aa, synthetic construct
  source 1..25: note = Seed: VKLQTVHSIPLTINKEEALQRPVAS
VKLQTVHSIPLTLNKLEALQTPVAS

SEQ ID NO: 52991 - protein, 25 aa, synthetic construct
  source 1..25: note = Seed: VKLQTVHSIPLTINKEEALQRPVAS
VKLQTVHSIPLTLNKLEALQVPVAS

SEQ ID NO: 52992 - protein, 25 aa, synthetic construct
  source 1..25: note = Seed: VKLQTVHSIPLTINKEEALQRPVAS
VKLQTVHSIPLTLNKLEGLQAPVAS

SEQ ID NO: 52993 - protein, 25 aa, synthetic construct
  source 1..25: note = Seed: VKLQTVHSIPLTINKEEALQRPVAS
VKLQTVHSIPLTLNKLEGLQIPVAS

SEQ ID NO: 52994 - protein, 25 aa, synthetic construct
  source 1..25: note = Seed: VKLQTVHSIPLTINKEEALQRPVAS
VKLQTVHSIPLTLNKLEGLQLPVAS

SEQ ID NO: 52995 - protein, 25 aa, synthetic construct
  source 1..25: note = Seed: VKLQTVHSIPLTINKEEALQRPVAS
VKLQTVHSIPLTLNKLEGLQMPVAS

SEQ ID NO: 52996 - protein, 25 aa, synthetic construct
  source 1..25: note = Seed: VKLQTVHSIPLTINKEEALQRPVAS
VKLQTVHSIPLTLNKLEGLQSPVAS

SEQ ID NO: 52997 - protein, 25 aa, synthetic construct
  source 1..25: note = Seed: VKLQTVHSIPLTINKEEALQRPVAS
VKLQTVHSIPLTLNKLEGLQTPVAS

SEQ ID NO: 52998 - protein, 25 aa, synthetic construct
  source 1..25: note = Seed: VKLQTVHSIPLTINKEEALQRPVAS
VKLQTVHSIPLTLNKLEGLQVPVAS

SEQ ID NO: 52999 - protein, 25 aa, synthetic construct
  source 1..25: note = Seed: VKLQTVHSIPLTINKEEALQRPVAS
VKLQTVHSIPLTLNKLENLQAPVAS

SEQ ID NO: 53000 - protein, 25 aa, synthetic construct
  source 1..25: note = Seed: VKLQTVHSIPLTINKEEALQRPVAS
VKLQTVHSIPLTLNKLEPLQAPVAS

SEQ ID NO: 53001 - protein, 25 aa, synthetic construct
  source 1..25: note = Seed: VKLQTVHSIPLTINKEEALQRPVAS
VKLQTVHSIPLTLNKLEPLQIPVAS

SEQ ID NO: 53002 - protein, 25 aa, synthetic construct
  source 1..25: note = Seed: VKLQTVHSIPLTINKEEALQRPVAS
VKLQTVHSIPLTLNKLEPLQLPVAS

SEQ ID NO: 53003 - protein, 25 aa, synthetic construct
  source 1..25: note = Seed: VKLQTVHSIPLTINKEEALQRPVAS
VKLQTVHSIPLTLNKLEPLQVPVAS

SEQ ID NO: 53004 - protein, 25 aa, synthetic construct
  source 1..25: note = Seed: VKLQTVHSIPLTINKEEALQRPVAS
VKLQTVHSIPLTLNKLESLQAPVAS

SEQ ID NO: 53005 - protein, 25 aa, synthetic construct
  source 1..25: note = Seed: VKLQTVHSIPLTINKEEALQRPVAS
VKLQTVHSIPLTLNKLESLQIPVAS

SEQ ID NO: 53006 - protein, 25 aa, synthetic construct
  source 1..25: note = Seed: VKLQTVHSIPLTINKEEALQRPVAS
VKLQTVHSIPLTLNKLESLQLPVAS

SEQ ID NO: 53007 - protein, 25 aa, synthetic construct
  source 1..25: note = Seed: VKLQTVHSIPLTINKEEALQRPVAS
VKLQTVHSIPLTLNKLESLQSPVAS

SEQ ID NO: 53008 - protein, 25 aa, synthetic construct
  source 1..25: note = Seed: VKLQTVHSIPLTINKEEALQRPVAS
VKLQTVHSIPLTLNKLESLQTPVAS

SEQ ID NO: 53009 - protein, 25 aa, synthetic construct
  source 1..25: note = Seed: VKLQTVHSIPLTINKEEALQRPVAS
VKLQTVHSIPLTLNKLESLQVPVAS

SEQ ID NO: 53010 - protein, 25 aa, synthetic construct
  source 1..25: note = Seed: VKLQTVHSIPLTINKEEALQRPVAS
VKLQTVHSIPLTLNKLETLQAPVAS

SEQ ID NO: 53011 - protein, 25 aa, synthetic construct
  source 1..25: note = Seed: VKLQTVHSIPLTINKEEALQRPVAS
VKLQTVHSIPLTLNKMEALQAPVAS

SEQ ID NO: 53012 - protein, 25 aa, synthetic construct
  source 1..25: note = Seed: VKLQTVHSIPLTINKEEALQRPVAS
VKLQTVHSIPLTLNKMEALQGPVAS

SEQ ID NO: 53013 - protein, 25 aa, synthetic construct
  source 1..25: note = Seed: VKLQTVHSIPLTINKEEALQRPVAS
VKLQTVHSIPLTLNKMEALQIPVAS

SEQ ID NO: 53014 - protein, 25 aa, synthetic construct
  source 1..25: note = Seed: VKLQTVHSIPLTINKEEALQRPVAS
VKLQTVHSIPLTLNKMEALQLPVAS

SEQ ID NO: 53015 - protein, 25 aa, synthetic construct
  source 1..25: note = Seed: VKLQTVHSIPLTINKEEALQRPVAS
VKLQTVHSIPLTLNKMEALQMPVAS

SEQ ID NO: 53016 - protein, 25 aa, synthetic construct
  source 1..25: note = Seed: VKLQTVHSIPLTINKEEALQRPVAS
VKLQTVHSIPLTLNKMEALQSPVAS

SEQ ID NO: 53017 - protein, 25 aa, synthetic construct
  source 1..25: note = Seed: VKLQTVHSIPLTINKEEALQRPVAS
VKLQTVHSIPLTLNKMEALQTPVAS

SEQ ID NO: 53018 - protein, 25 aa, synthetic construct
  source 1..25: note = Seed: VKLQTVHSIPLTINKEEALQRPVAS
VKLQTVHSIPLTLNKMEALQVPVAS

SEQ ID NO: 53019 - protein, 25 aa, synthetic construct
  source 1..25: note = Seed: VKLQTVHSIPLTINKEEALQRPVAS
VKLQTVHSIPLTLNKMEGLQAPVAS

SEQ ID NO: 53020 - protein, 25 aa, synthetic construct
  source 1..25: note = Seed: VKLQTVHSIPLTINKEEALQRPVAS
VKLQTVHSIPLTLNKMEGLQIPVAS

SEQ ID NO: 53021 - protein, 25 aa, synthetic construct
  source 1..25: note = Seed: VKLQTVHSIPLTINKEEALQRPVAS
VKLQTVHSIPLTLNKMEGLQLPVAS

SEQ ID NO: 53022 - protein, 25 aa, synthetic construct
  source 1..25: note = Seed: VKLQTVHSIPLTINKEEALQRPVAS
VKLQTVHSIPLTLNKMEGLQMPVAS

SEQ ID NO: 53023 - protein, 25 aa, synthetic construct
  source 1..25: note = Seed: VKLQTVHSIPLTINKEEALQRPVAS
VKLQTVHSIPLTLNKMEGLQSPVAS

SEQ ID NO: 53024 - protein, 25 aa, synthetic construct
  source 1..25: note = Seed: VKLQTVHSIPLTINKEEALQRPVAS
VKLQTVHSIPLTLNKMEGLQTPVAS

SEQ ID NO: 53025 - protein, 25 aa, synthetic construct
  source 1..25: note = Seed: VKLQTVHSIPLTINKEEALQRPVAS
VKLQTVHSIPLTLNKMEGLQVPVAS

SEQ ID NO: 53026 - protein, 25 aa, synthetic construct
  source 1..25: note = Seed: VKLQTVHSIPLTINKEEALQRPVAS
VKLQTVHSIPLTLNKMENLQAPVAS

SEQ ID NO: 53027 - protein, 25 aa, synthetic construct
  source 1..25: note = Seed: VKLQTVHSIPLTINKEEALQRPVAS
VKLQTVHSIPLTLNKMENLQSPVAS

SEQ ID NO: 53028 - protein, 25 aa, synthetic construct
  source 1..25: note = Seed: VKLQTVHSIPLTINKEEALQRPVAS
VKLQTVHSIPLTLNKMEPLQAPVAS

SEQ ID NO: 53029 - protein, 25 aa, synthetic construct
  source 1..25: note = Seed: VKLQTVHSIPLTINKEEALQRPVAS
VKLQTVHSIPLTLNKMEPLQIPVAS

SEQ ID NO: 53030 - protein, 25 aa, synthetic construct
  source 1..25: note = Seed: VKLQTVHSIPLTINKEEALQRPVAS
VKLQTVHSIPLTLNKMEPLQLPVAS

SEQ ID NO: 53031 - protein, 25 aa, synthetic construct
  source 1..25: note = Seed: VKLQTVHSIPLTINKEEALQRPVAS
VKLQTVHSIPLTLNKMEPLQVPVAS

SEQ ID NO: 53032 - protein, 25 aa, synthetic construct
  source 1..25: note = Seed: VKLQTVHSIPLTINKEEALQRPVAS
VKLQTVHSIPLTLNKMERLQRPVAS

SEQ ID NO: 53033 - protein, 25 aa, synthetic construct
  source 1..25: note = Seed: VKLQTVHSIPLTINKEEALQRPVAS
VKLQTVHSIPLTLNKMESLQAPVAS

SEQ ID NO: 53034 - protein, 25 aa, synthetic construct
  source 1..25: note = Seed: VKLQTVHSIPLTINKEEALQRPVAS
VKLQTVHSIPLTLNKMESLQIPVAS

SEQ ID NO: 53035 - protein, 25 aa, synthetic construct
  source 1..25: note = Seed: VKLQTVHSIPLTINKEEALQRPVAS
VKLQTVHSIPLTLNKMESLQLPVAS

SEQ ID NO: 53036 - protein, 25 aa, synthetic construct
  source 1..25: note = Seed: VKLQTVHSIPLTINKEEALQRPVAS
VKLQTVHSIPLTLNKMESLQVPVAS

SEQ ID NO: 53037 - protein, 25 aa, synthetic construct
  source 1..25: note = Seed: VKLQTVHSIPLTINKEEALQRPVAS
VKLQTVHSIPLTLNKMETLQAPVAS

SEQ ID NO: 53038 - protein, 25 aa, synthetic construct
  source 1..25: note = Seed: VKLQTVHSIPLTINKEEALQRPVAS
VKLQTVHSIPLTLNKMETLQSPVAS

SEQ ID NO: 53039 - protein, 25 aa, synthetic construct
  source 1..25: note = Seed: VKLQTVHSIPLTINKEEALQRPVAS
VKLQTVHSIPLTLNKSERLQRPVAS

SEQ ID NO: 53040 - protein, 25 aa, synthetic construct
  source 1..25: note = Seed: VKLQTVHSIPLTINKEEALQRPVAS
VKLQTVHSIPLTLNKVERLQRPVAS

SEQ ID NO: 53041 - protein, 25 aa, synthetic construct
  source 1..25: note = Seed: VKLQTVHSIPLTINKEEALQRPVAS
VKLQTVHSIPLTLNKVERLQYPVAS

SEQ ID NO: 53042 - protein, 25 aa, synthetic construct
  source 1..25: note = Seed: VKLQTVHSIPLTINKEEALQRPVAS
VKLQTVHSIPLTLNKWERLQRPVAS

SEQ ID NO: 53043 - protein, 25 aa, synthetic construct
  source 1..25: note = Seed: VKLQTVHSIPLTINKEEALQRPVAS
VKLQTVHSIPLTLNKWESLQLPVAS

SEQ ID NO: 53044 - protein, 25 aa, synthetic construct
  source 1..25: note = Seed: VKLQTVHSIPLTINKEEALQRPVAS
VKLQTVHSIPLTLNKWESLQVPVAS

SEQ ID NO: 53045 - protein, 25 aa, synthetic construct
  source 1..25: note = Seed: VKLQTVHSIPLTINKEEALQRPVAS
VKLQTVHSIPLTLNKYEALQAPVAS

SEQ ID NO: 53046 - protein, 25 aa, synthetic construct
  source 1..25: note = Seed: VKLQTVHSIPLTINKEEALQRPVAS
VKLQTVHSIPLTLNKYEALQIPVAS

SEQ ID NO: 53047 - protein, 25 aa, synthetic construct
  source 1..25: note = Seed: VKLQTVHSIPLTINKEEALQRPVAS
VKLQTVHSIPLTLNKYEALQLPVAS

SEQ ID NO: 53048 - protein, 25 aa, synthetic construct
  source 1..25: note = Seed: VKLQTVHSIPLTINKEEALQRPVAS
VKLQTVHSIPLTLNKYEALQVPVAS

SEQ ID NO: 53049 - protein, 25 aa, synthetic construct
  source 1..25: note = Seed: VKLQTVHSIPLTINKEEALQRPVAS
VKLQTVHSIPLTLNKYEGLQAPVAS

SEQ ID NO: 53050 - protein, 25 aa, synthetic construct
  source 1..25: note = Seed: VKLQTVHSIPLTINKEEALQRPVAS
VKLQTVHSIPLTLNKYEGLQIPVAS

SEQ ID NO: 53051 - protein, 25 aa, synthetic construct
  source 1..25: note = Seed: VKLQTVHSIPLTINKEEALQRPVAS
VKLQTVHSIPLTLNKYEGLQLPVAS

SEQ ID NO: 53052 - protein, 25 aa, synthetic construct
  source 1..25: note = Seed: VKLQTVHSIPLTINKEEALQRPVAS
VKLQTVHSIPLTLNKYEGLQVPVAS

SEQ ID NO: 53053 - protein, 25 aa, synthetic construct
  source 1..25: note = Seed: VKLQTVHSIPLTINKEEALQRPVAS
VKLQTVHSIPLTLNKYENLQAPVAS

SEQ ID NO: 53054 - protein, 25 aa, synthetic construct
  source 1..25: note = Seed: VKLQTVHSIPLTINKEEALQRPVAS
VKLQTVHSIPLTLNKYENLQIPVAS

SEQ ID NO: 53055 - protein, 25 aa, synthetic construct
  source 1..25: note = Seed: VKLQTVHSIPLTINKEEALQRPVAS
VKLQTVHSIPLTLNKYENLQLPVAS

SEQ ID NO: 53056 - protein, 25 aa, synthetic construct
  source 1..25: note = Seed: VKLQTVHSIPLTINKEEALQRPVAS
VKLQTVHSIPLTLNKYENLQVPVAS

SEQ ID NO: 53057 - protein, 25 aa, synthetic construct
  source 1..25: note = Seed: VKLQTVHSIPLTINKEEALQRPVAS
VKLQTVHSIPLTLNKYESLQAPVAS

SEQ ID NO: 53058 - protein, 25 aa, synthetic construct
  source 1..25: note = Seed: VKLQTVHSIPLTINKEEALQRPVAS
VKLQTVHSIPLTLNKYESLQIPVAS

SEQ ID NO: 53059 - protein, 25 aa, synthetic construct
  source 1..25: note = Seed: VKLQTVHSIPLTINKEEALQRPVAS
VKLQTVHSIPLTLNKYESLQLPVAS

SEQ ID NO: 53060 - protein, 25 aa, synthetic construct
  source 1..25: note = Seed: VKLQTVHSIPLTINKEEALQRPVAS
VKLQTVHSIPLTLNKYESLQMPVAS

SEQ ID NO: 53061 - protein, 25 aa, synthetic construct
  source 1..25: note = Seed: VKLQTVHSIPLTINKEEALQRPVAS
VKLQTVHSIPLTLNKYESLQTPVAS

SEQ ID NO: 53062 - protein, 25 aa, synthetic construct
  source 1..25: note = Seed: VKLQTVHSIPLTINKEEALQRPVAS
VKLQTVHSIPLTLNKYESLQVPVAS

SEQ ID NO: 53063 - protein, 25 aa, synthetic construct
  source 1..25: note = Seed: VKLQTVHSIPLTINKEEALQRPVAS
VKLQTVHSIPLTMNKAERLQRPVAS

SEQ ID NO: 53064 - protein, 25 aa, synthetic construct
  source 1..25: note = Seed: VKLQTVHSIPLTINKEEALQRPVAS
VKLQTVHSIPLTMNKDEKLQFPVAS

SEQ ID NO: 53065 - protein, 25 aa, synthetic construct
  source 1..25: note = Seed: VKLQTVHSIPLTINKEEALQRPVAS
VKLQTVHSIPLTMNKDEKLQYPVAS

SEQ ID NO: 53066 - protein, 25 aa, synthetic construct
  source 1..25: note = Seed: VKLQTVHSIPLTINKEEALQRPVAS
VKLQTVHSIPLTMNKDERLQFPVAS

SEQ ID NO: 53067 - protein, 25 aa, synthetic construct
  source 1..25: note = Seed: VKLQTVHSIPLTINKEEALQRPVAS
VKLQTVHSIPLTMNKDERLQYPVAS

SEQ ID NO: 53068 - protein, 25 aa, synthetic construct
  source 1..25: note = Seed: VKLQTVHSIPLTINKEEALQRPVAS
VKLQTVHSIPLTMNKDEVLQRPVAS

SEQ ID NO: 53069 - protein, 25 aa, synthetic construct
  source 1..25: note = Seed: VKLQTVHSIPLTINKEEALQRPVAS
VKLQTVHSIPLTMNKIEALQVPVAS

SEQ ID NO: 53070 - protein, 25 aa, synthetic construct
  source 1..25: note = Seed: VKLQTVHSIPLTINKEEALQRPVAS
VKLQTVHSIPLTMNKIERLQRPVAS

SEQ ID NO: 53071 - protein, 25 aa, synthetic construct
  source 1..25: note = Seed: VKLQTVHSIPLTINKEEALQRPVAS
VKLQTVHSIPLTMNKLEALQIPVAS

SEQ ID NO: 53072 - protein, 25 aa, synthetic construct
  source 1..25: note = Seed: VKLQTVHSIPLTINKEEALQRPVAS
VKLQTVHSIPLTMNKLEALQLPVAS

SEQ ID NO: 53073 - protein, 25 aa, synthetic construct
  source 1..25: note = Seed: VKLQTVHSIPLTINKEEALQRPVAS
VKLQTVHSIPLTMNKLEALQMPVAS

SEQ ID NO: 53074 - protein, 25 aa, synthetic construct
  source 1..25: note = Seed: VKLQTVHSIPLTINKEEALQRPVAS
VKLQTVHSIPLTMNKLEALQSPVAS

SEQ ID NO: 53075 - protein, 25 aa, synthetic construct
  source 1..25: note = Seed: VKLQTVHSIPLTINKEEALQRPVAS
VKLQTVHSIPLTMNKLEALQTPVAS

SEQ ID NO: 53076 - protein, 25 aa, synthetic construct
  source 1..25: note = Seed: VKLQTVHSIPLTINKEEALQRPVAS
VKLQTVHSIPLTMNKLEALQVPVAS

SEQ ID NO: 53077 - protein, 25 aa, synthetic construct
  source 1..25: note = Seed: VKLQTVHSIPLTINKEEALQRPVAS
VKLQTVHSIPLTMNKLEGLQAPVAS

SEQ ID NO: 53078 - protein, 25 aa, synthetic construct
  source 1..25: note = Seed: VKLQTVHSIPLTINKEEALQRPVAS
VKLQTVHSIPLTMNKLEGLQIPVAS

SEQ ID NO: 53079 - protein, 25 aa, synthetic construct
  source 1..25: note = Seed: VKLQTVHSIPLTINKEEALQRPVAS
VKLQTVHSIPLTMNKLEGLQLPVAS

SEQ ID NO: 53080 - protein, 25 aa, synthetic construct
  source 1..25: note = Seed: VKLQTVHSIPLTINKEEALQRPVAS
VKLQTVHSIPLTMNKLEGLQVPVAS

SEQ ID NO: 53081 - protein, 25 aa, synthetic construct
  source 1..25: note = Seed: VKLQTVHSIPLTINKEEALQRPVAS
VKLQTVHSIPLTMNKLEPLQAPVAS

SEQ ID NO: 53082 - protein, 25 aa, synthetic construct
  source 1..25: note = Seed: VKLQTVHSIPLTINKEEALQRPVAS
VKLQTVHSIPLTMNKLEPLQIPVAS

SEQ ID NO: 53083 - protein, 25 aa, synthetic construct
  source 1..25: note = Seed: VKLQTVHSIPLTINKEEALQRPVAS
VKLQTVHSIPLTMNKLEPLQLPVAS

SEQ ID NO: 53084 - protein, 25 aa, synthetic construct
  source 1..25: note = Seed: VKLQTVHSIPLTINKEEALQRPVAS
VKLQTVHSIPLTMNKLEPLQVPVAS

SEQ ID NO: 53085 - protein, 25 aa, synthetic construct
  source 1..25: note = Seed: VKLQTVHSIPLTINKEEALQRPVAS
VKLQTVHSIPLTMNKLESLQVPVAS

SEQ ID NO: 53086 - protein, 25 aa, synthetic construct
  source 1..25: note = Seed: VKLQTVHSIPLTINKEEALQRPVAS
VKLQTVHSIPLTMNKMEALQAPVAS

SEQ ID NO: 53087 - protein, 25 aa, synthetic construct
  source 1..25: note = Seed: VKLQTVHSIPLTINKEEALQRPVAS
VKLQTVHSIPLTMNKMEALQIPVAS

SEQ ID NO: 53088 - protein, 25 aa, synthetic construct
  source 1..25: note = Seed: VKLQTVHSIPLTINKEEALQRPVAS
VKLQTVHSIPLTMNKMEALQLPVAS

SEQ ID NO: 53089 - protein, 25 aa, synthetic construct
  source 1..25: note = Seed: VKLQTVHSIPLTINKEEALQRPVAS
VKLQTVHSIPLTMNKMEALQMPVAS

SEQ ID NO: 53090 - protein, 25 aa, synthetic construct
  source 1..25: note = Seed: VKLQTVHSIPLTINKEEALQRPVAS
VKLQTVHSIPLTMNKMEALQSPVAS

SEQ ID NO: 53091 - protein, 25 aa, synthetic construct
  source 1..25: note = Seed: VKLQTVHSIPLTINKEEALQRPVAS
VKLQTVHSIPLTMNKMEALQTPVAS

SEQ ID NO: 53092 - protein, 25 aa, synthetic construct
  source 1..25: note = Seed: VKLQTVHSIPLTINKEEALQRPVAS
VKLQTVHSIPLTMNKMEALQVPVAS

SEQ ID NO: 53093 - protein, 25 aa, synthetic construct
  source 1..25: note = Seed: VKLQTVHSIPLTINKEEALQRPVAS
VKLQTVHSIPLTMNKMEGLQAPVAS

SEQ ID NO: 53094 - protein, 25 aa, synthetic construct
  source 1..25: note = Seed: VKLQTVHSIPLTINKEEALQRPVAS
VKLQTVHSIPLTMNKMEGLQIPVAS

SEQ ID NO: 53095 - protein, 25 aa, synthetic construct
  source 1..25: note = Seed: VKLQTVHSIPLTINKEEALQRPVAS
VKLQTVHSIPLTMNKMEGLQLPVAS

SEQ ID NO: 53096 - protein, 25 aa, synthetic construct
  source 1..25: note = Seed: VKLQTVHSIPLTINKEEALQRPVAS
VKLQTVHSIPLTMNKMEGLQVPVAS

SEQ ID NO: 53097 - protein, 25 aa, synthetic construct
  source 1..25: note = Seed: VKLQTVHSIPLTINKEEALQRPVAS
VKLQTVHSIPLTMNKMEPLQAPVAS

SEQ ID NO: 53098 - protein, 25 aa, synthetic construct
  source 1..25: note = Seed: VKLQTVHSIPLTINKEEALQRPVAS
VKLQTVHSIPLTMNKMEPLQVPVAS

SEQ ID NO: 53099 - protein, 25 aa, synthetic construct
  source 1..25: note = Seed: VKLQTVHSIPLTINKEEALQRPVAS
VKLQTVHSIPLTMNKMESLQVPVAS

SEQ ID NO: 53100 - protein, 25 aa, synthetic construct
  source 1..25: note = Seed: VKLQTVHSIPLTINKEEALQRPVAS
VKLQTVHSIPLTMNKVERLQRPVAS

SEQ ID NO: 53101 - protein, 25 aa, synthetic construct
  source 1..25: note = Seed: VKLQTVHSIPLTINKEEALQRPVAS
VKLQTVHSIPLTVNKDEALQRPVAS

SEQ ID NO: 53102 - protein, 25 aa, synthetic construct
  source 1..25: note = Seed: VKLQTVHSIPLTINKEEALQRPVAS
VKLQTVHSIPLTVNKDEKLQFPVAS

SEQ ID NO: 53103 - protein, 25 aa, synthetic construct
  source 1..25: note = Seed: VKLQTVHSIPLTINKEEALQRPVAS
VKLQTVHSIPLTVNKDEKLQMPVAS

SEQ ID NO: 53104 - protein, 25 aa, synthetic construct
  source 1..25: note = Seed: VKLQTVHSIPLTINKEEALQRPVAS
VKLQTVHSIPLTVNKDEKLQYPVAS

SEQ ID NO: 53105 - protein, 25 aa, synthetic construct
  source 1..25: note = Seed: VKLQTVHSIPLTINKEEALQRPVAS
VKLQTVHSIPLTVNKDERLQFPVAS

SEQ ID NO: 53106 - protein, 25 aa, synthetic construct
  source 1..25: note = Seed: VKLQTVHSIPLTINKEEALQRPVAS
VKLQTVHSIPLTVNKDERLQMPVAS

SEQ ID NO: 53107 - protein, 25 aa, synthetic construct
  source 1..25: note = Seed: VKLQTVHSIPLTINKEEALQRPVAS
VKLQTVHSIPLTVNKDERLQYPVAS

SEQ ID NO: 53108 - protein, 25 aa, synthetic construct
  source 1..25: note = Seed: VKLQTVHSIPLTINKEEALQRPVAS
VKLQTVHSIPLTVNKDEVLQRPVAS

SEQ ID NO: 53109 - protein, 25 aa, synthetic construct
  source 1..25: note = Seed: VKLQTVHSIPLTINKEEALQRPVAS
VKLQTVHSIPLTVNKFENLQIPVAS

SEQ ID NO: 53110 - protein, 25 aa, synthetic construct
  source 1..25: note = Seed: VKLQTVHSIPLTINKEEALQRPVAS
VKLQTVHSIPLTVNKFENLQLPVAS

SEQ ID NO: 53111 - protein, 25 aa, synthetic construct
  source 1..25: note = Seed: VKLQTVHSIPLTINKEEALQRPVAS
VKLQTVHSIPLTVNKFENLQVPVAS

SEQ ID NO: 53112 - protein, 25 aa, synthetic construct
  source 1..25: note = Seed: VKLQTVHSIPLTINKEEALQRPVAS
VKLQTVHSIPLTVNKFESLQAPVAS

SEQ ID NO: 53113 - protein, 25 aa, synthetic construct
  source 1..25: note = Seed: VKLQTVHSIPLTINKEEALQRPVAS
VKLQTVHSIPLTVNKFESLQIPVAS

SEQ ID NO: 53114 - protein, 25 aa, synthetic construct
  source 1..25: note = Seed: VKLQTVHSIPLTINKEEALQRPVAS
VKLQTVHSIPLTVNKFESLQLPVAS

SEQ ID NO: 53115 - protein, 25 aa, synthetic construct
  source 1..25: note = Seed: VKLQTVHSIPLTINKEEALQRPVAS
VKLQTVHSIPLTVNKFESLQVPVAS

SEQ ID NO: 53116 - protein, 25 aa, synthetic construct
  source 1..25: note = Seed: VKLQTVHSIPLTINKEEALQRPVAS
VKLQTVHSIPLTVNKIEALQIPVAS

SEQ ID NO: 53117 - protein, 25 aa, synthetic construct
  source 1..25: note = Seed: VKLQTVHSIPLTINKEEALQRPVAS
VKLQTVHSIPLTVNKIEALQLPVAS

SEQ ID NO: 53118 - protein, 25 aa, synthetic construct
  source 1..25: note = Seed: VKLQTVHSIPLTINKEEALQRPVAS
VKLQTVHSIPLTVNKIEALQVPVAS

SEQ ID NO: 53119 - protein, 25 aa, synthetic construct
  source 1..25: note = Seed: VKLQTVHSIPLTINKEEALQRPVAS
VKLQTVHSIPLTVNKIERLQRPVAS

SEQ ID NO: 53120 - protein, 25 aa, synthetic construct
  source 1..25: note = Seed: VKLQTVHSIPLTINKEEALQRPVAS
VKLQTVHSIPLTVNKLEALQAPVAS

SEQ ID NO: 53121 - protein, 25 aa, synthetic construct
  source 1..25: note = Seed: VKLQTVHSIPLTINKEEALQRPVAS
VKLQTVHSIPLTVNKLEALQIPVAS

SEQ ID NO: 53122 - protein, 25 aa, synthetic construct
  source 1..25: note = Seed: VKLQTVHSIPLTINKEEALQRPVAS
VKLQTVHSIPLTVNKLEALQLPVAS

SEQ ID NO: 53123 - protein, 25 aa, synthetic construct
  source 1..25: note = Seed: VKLQTVHSIPLTINKEEALQRPVAS
VKLQTVHSIPLTVNKLEALQMPVAS

SEQ ID NO: 53124 - protein, 25 aa, synthetic construct
  source 1..25: note = Seed: VKLQTVHSIPLTINKEEALQRPVAS
VKLQTVHSIPLTVNKLEALQSPVAS

SEQ ID NO: 53125 - protein, 25 aa, synthetic construct
  source 1..25: note = Seed: VKLQTVHSIPLTINKEEALQRPVAS
VKLQTVHSIPLTVNKLEALQTPVAS

SEQ ID NO: 53126 - protein, 25 aa, synthetic construct
  source 1..25: note = Seed: VKLQTVHSIPLTINKEEALQRPVAS
VKLQTVHSIPLTVNKLEALQVPVAS

SEQ ID NO: 53127 - protein, 25 aa, synthetic construct
  source 1..25: note = Seed: VKLQTVHSIPLTINKEEALQRPVAS
VKLQTVHSIPLTVNKLEGLQAPVAS

SEQ ID NO: 53128 - protein, 25 aa, synthetic construct
  source 1..25: note = Seed: VKLQTVHSIPLTINKEEALQRPVAS
VKLQTVHSIPLTVNKLEGLQIPVAS

SEQ ID NO: 53129 - protein, 25 aa, synthetic construct
  source 1..25: note = Seed: VKLQTVHSIPLTINKEEALQRPVAS
VKLQTVHSIPLTVNKLEGLQLPVAS

SEQ ID NO: 53130 - protein, 25 aa, synthetic construct
  source 1..25: note = Seed: VKLQTVHSIPLTINKEEALQRPVAS
VKLQTVHSIPLTVNKLEGLQVPVAS

SEQ ID NO: 53131 - protein, 25 aa, synthetic construct
  source 1..25: note = Seed: VKLQTVHSIPLTINKEEALQRPVAS
VKLQTVHSIPLTVNKLEPLQIPVAS

SEQ ID NO: 53132 - protein, 25 aa, synthetic construct
  source 1..25: note = Seed: VKLQTVHSIPLTINKEEALQRPVAS
VKLQTVHSIPLTVNKLEPLQLPVAS

SEQ ID NO: 53133 - protein, 25 aa, synthetic construct
  source 1..25: note = Seed: VKLQTVHSIPLTINKEEALQRPVAS
VKLQTVHSIPLTVNKLEPLQVPVAS

SEQ ID NO: 53134 - protein, 25 aa, synthetic construct
  source 1..25: note = Seed: VKLQTVHSIPLTINKEEALQRPVAS
VKLQTVHSIPLTVNKLESLQIPVAS

SEQ ID NO: 53135 - protein, 25 aa, synthetic construct
  source 1..25: note = Seed: VKLQTVHSIPLTINKEEALQRPVAS
VKLQTVHSIPLTVNKLESLQLPVAS

SEQ ID NO: 53136 - protein, 25 aa, synthetic construct
  source 1..25: note = Seed: VKLQTVHSIPLTINKEEALQRPVAS
VKLQTVHSIPLTVNKLESLQVPVAS

SEQ ID NO: 53137 - protein, 25 aa, synthetic construct
  source 1..25: note = Seed: VKLQTVHSIPLTINKEEALQRPVAS
VKLQTVHSIPLTVNKMEALQAPVAS

SEQ ID NO: 53138 - protein, 25 aa, synthetic construct
  source 1..25: note = Seed: VKLQTVHSIPLTINKEEALQRPVAS
VKLQTVHSIPLTVNKMEALQIPVAS

SEQ ID NO: 53139 - protein, 25 aa, synthetic construct
  source 1..25: note = Seed: VKLQTVHSIPLTINKEEALQRPVAS
VKLQTVHSIPLTVNKMEALQLPVAS

SEQ ID NO: 53140 - protein, 25 aa, synthetic construct
  source 1..25: note = Seed: VKLQTVHSIPLTINKEEALQRPVAS
VKLQTVHSIPLTVNKMEALQMPVAS

SEQ ID NO: 53141 - protein, 25 aa, synthetic construct
  source 1..25: note = Seed: VKLQTVHSIPLTINKEEALQRPVAS
VKLQTVHSIPLTVNKMEALQSPVAS

SEQ ID NO: 53142 - protein, 25 aa, synthetic construct
  source 1..25: note = Seed: VKLQTVHSIPLTINKEEALQRPVAS
VKLQTVHSIPLTVNKMEALQTPVAS

SEQ ID NO: 53143 - protein, 25 aa, synthetic construct
  source 1..25: note = Seed: VKLQTVHSIPLTINKEEALQRPVAS
VKLQTVHSIPLTVNKMEALQVPVAS

SEQ ID NO: 53144 - protein, 25 aa, synthetic construct
  source 1..25: note = Seed: VKLQTVHSIPLTINKEEALQRPVAS
VKLQTVHSIPLTVNKMEGLQAPVAS

SEQ ID NO: 53145 - protein, 25 aa, synthetic construct
  source 1..25: note = Seed: VKLQTVHSIPLTINKEEALQRPVAS
VKLQTVHSIPLTVNKMEGLQIPVAS

SEQ ID NO: 53146 - protein, 25 aa, synthetic construct
  source 1..25: note = Seed: VKLQTVHSIPLTINKEEALQRPVAS
VKLQTVHSIPLTVNKMEGLQLPVAS

SEQ ID NO: 53147 - protein, 25 aa, synthetic construct
  source 1..25: note = Seed: VKLQTVHSIPLTINKEEALQRPVAS
VKLQTVHSIPLTVNKMEGLQVPVAS

SEQ ID NO: 53148 - protein, 25 aa, synthetic construct
  source 1..25: note = Seed: VKLQTVHSIPLTINKEEALQRPVAS
VKLQTVHSIPLTVNKMENLQAPVAS

SEQ ID NO: 53149 - protein, 25 aa, synthetic construct
  source 1..25: note = Seed: VKLQTVHSIPLTINKEEALQRPVAS
VKLQTVHSIPLTVNKMEPLQAPVAS

SEQ ID NO: 53150 - protein, 25 aa, synthetic construct
  source 1..25: note = Seed: VKLQTVHSIPLTINKEEALQRPVAS
VKLQTVHSIPLTVNKMEPLQIPVAS

SEQ ID NO: 53151 - protein, 25 aa, synthetic construct
  source 1..25: note = Seed: VKLQTVHSIPLTINKEEALQRPVAS
VKLQTVHSIPLTVNKMEPLQLPVAS

SEQ ID NO: 53152 - protein, 25 aa, synthetic construct
  source 1..25: note = Seed: VKLQTVHSIPLTINKEEALQRPVAS
VKLQTVHSIPLTVNKMEPLQVPVAS

SEQ ID NO: 53153 - protein, 25 aa, synthetic construct
  source 1..25: note = Seed: VKLQTVHSIPLTINKEEALQRPVAS
VKLQTVHSIPLTVNKMESLQLPVAS

SEQ ID NO: 53154 - protein, 25 aa, synthetic construct
  source 1..25: note = Seed: VKLQTVHSIPLTINKEEALQRPVAS
VKLQTVHSIPLTVNKMESLQVPVAS

SEQ ID NO: 53155 - protein, 25 aa, synthetic construct
  source 1..25: note = Seed: VKLQTVHSIPLTINKEEALQRPVAS
VKLQTVHSIPLTVNKYEALQIPVAS

SEQ ID NO: 53156 - protein, 25 aa, synthetic construct
  source 1..25: note = Seed: VKLQTVHSIPLTINKEEALQRPVAS
VKLQTVHSIPLTVNKYEALQLPVAS

SEQ ID NO: 53157 - protein, 25 aa, synthetic construct
  source 1..25: note = Seed: VKLQTVHSIPLTINKEEALQRPVAS
VKLQTVHSIPLTVNKYEALQVPVAS

SEQ ID NO: 53158 - protein, 25 aa, synthetic construct
  source 1..25: note = Seed: VKLQTVHSIPLTINKEEALQRPVAS
VKLQTVHSIPLTVNKYEGLQAPVAS

SEQ ID NO: 53159 - protein, 25 aa, synthetic construct
  source 1..25: note = Seed: VKLQTVHSIPLTINKEEALQRPVAS
VKLQTVHSIPLTVNKYEGLQLPVAS

SEQ ID NO: 53160 - protein, 25 aa, synthetic construct
  source 1..25: note = Seed: VKLQTVHSIPLTINKEEALQRPVAS
VKLQTVHSIPLTVNKYEGLQVPVAS

SEQ ID NO: 53161 - protein, 25 aa, synthetic construct
  source 1..25: note = Seed: VKLQTVHSIPLTINKEEALQRPVAS
VKLQTVHSIPLTVNKYENLQAPVAS

SEQ ID NO: 53162 - protein, 25 aa, synthetic construct
  source 1..25: note = Seed: VKLQTVHSIPLTINKEEALQRPVAS
VKLQTVHSIPLTVNKYENLQIPVAS

SEQ ID NO: 53163 - protein, 25 aa, synthetic construct
  source 1..25: note = Seed: VKLQTVHSIPLTINKEEALQRPVAS
VKLQTVHSIPLTVNKYENLQLPVAS

SEQ ID NO: 53164 - protein, 25 aa, synthetic construct
  source 1..25: note = Seed: VKLQTVHSIPLTINKEEALQRPVAS
VKLQTVHSIPLTVNKYENLQVPVAS

SEQ ID NO: 53165 - protein, 25 aa, synthetic construct
  source 1..25: note = Seed: VKLQTVHSIPLTINKEEALQRPVAS
VKLQTVHSIPLTVNKYESLQAPVAS

SEQ ID NO: 53166 - protein, 25 aa, synthetic construct
  source 1..25: note = Seed: VKLQTVHSIPLTINKEEALQRPVAS
VKLQTVHSIPLTVNKYESLQIPVAS

SEQ ID NO: 53167 - protein, 25 aa, synthetic construct
  source 1..25: note = Seed: VKLQTVHSIPLTINKEEALQRPVAS
VKLQTVHSIPLTVNKYESLQLPVAS

SEQ ID NO: 53168 - protein, 25 aa, synthetic construct
  source 1..25: note = Seed: VKLQTVHSIPLTINKEEALQRPVAS
VKLQTVHSIPLTVNKYESLQVPVAS

SEQ ID NO: 53169 - protein, 25 aa, synthetic construct
  source 1..25: note = Seed: VKLQTVHSIPLTINKEEALQRPVAS
VKLQTVHSIPLTWNKAEALQAPVAS

SEQ ID NO: 53170 - protein, 25 aa, synthetic construct
  source 1..25: note = Seed: VKLQTVHSIPLTINKEEALQRPVAS
VKLQTVHSIPLTWNKAEALQIPVAS

SEQ ID NO: 53171 - protein, 25 aa, synthetic construct
  source 1..25: note = Seed: VKLQTVHSIPLTINKEEALQRPVAS
VKLQTVHSIPLTWNKAEALQLPVAS

SEQ ID NO: 53172 - protein, 25 aa, synthetic construct
  source 1..25: note = Seed: VKLQTVHSIPLTINKEEALQRPVAS
VKLQTVHSIPLTWNKAEALQMPVAS

SEQ ID NO: 53173 - protein, 25 aa, synthetic construct
  source 1..25: note = Seed: VKLQTVHSIPLTINKEEALQRPVAS
VKLQTVHSIPLTWNKAEALQSPVAS

SEQ ID NO: 53174 - protein, 25 aa, synthetic construct
  source 1..25: note = Seed: VKLQTVHSIPLTINKEEALQRPVAS
VKLQTVHSIPLTWNKAEALQTPVAS

SEQ ID NO: 53175 - protein, 25 aa, synthetic construct
  source 1..25: note = Seed: VKLQTVHSIPLTINKEEALQRPVAS
VKLQTVHSIPLTWNKAEALQVPVAS

SEQ ID NO: 53176 - protein, 25 aa, synthetic construct
  source 1..25: note = Seed: VKLQTVHSIPLTINKEEALQRPVAS
VKLQTVHSIPLTWNKAEGLQAPVAS

SEQ ID NO: 53177 - protein, 25 aa, synthetic construct
  source 1..25: note = Seed: VKLQTVHSIPLTINKEEALQRPVAS
VKLQTVHSIPLTWNKAEGLQIPVAS

SEQ ID NO: 53178 - protein, 25 aa, synthetic construct
  source 1..25: note = Seed: VKLQTVHSIPLTINKEEALQRPVAS
VKLQTVHSIPLTWNKAEGLQLPVAS

SEQ ID NO: 53179 - protein, 25 aa, synthetic construct
  source 1..25: note = Seed: VKLQTVHSIPLTINKEEALQRPVAS
VKLQTVHSIPLTWNKAEGLQVPVAS

SEQ ID NO: 53180 - protein, 25 aa, synthetic construct
  source 1..25: note = Seed: VKLQTVHSIPLTINKEEALQRPVAS
VKLQTVHSIPLTWNKAEPLQAPVAS

SEQ ID NO: 53181 - protein, 25 aa, synthetic construct
  source 1..25: note = Seed: VKLQTVHSIPLTINKEEALQRPVAS
VKLQTVHSIPLTWNKAEPLQIPVAS

SEQ ID NO: 53182 - protein, 25 aa, synthetic construct
  source 1..25: note = Seed: VKLQTVHSIPLTINKEEALQRPVAS
VKLQTVHSIPLTWNKAEPLQLPVAS

SEQ ID NO: 53183 - protein, 25 aa, synthetic construct
  source 1..25: note = Seed: VKLQTVHSIPLTINKEEALQRPVAS
VKLQTVHSIPLTWNKAEPLQVPVAS

SEQ ID NO: 53184 - protein, 25 aa, synthetic construct
  source 1..25: note = Seed: VKLQTVHSIPLTINKEEALQRPVAS
VKLQTVHSIPLTWNKAESLQAPVAS

SEQ ID NO: 53185 - protein, 25 aa, synthetic construct
  source 1..25: note = Seed: VKLQTVHSIPLTINKEEALQRPVAS
VKLQTVHSIPLTWNKAESLQIPVAS

SEQ ID NO: 53186 - protein, 25 aa, synthetic construct
  source 1..25: note = Seed: VKLQTVHSIPLTINKEEALQRPVAS
VKLQTVHSIPLTWNKAESLQLPVAS

SEQ ID NO: 53187 - protein, 25 aa, synthetic construct
  source 1..25: note = Seed: VKLQTVHSIPLTINKEEALQRPVAS
VKLQTVHSIPLTWNKAESLQVPVAS

SEQ ID NO: 53188 - protein, 25 aa, synthetic construct
  source 1..25: note = Seed: VKLQTVHSIPLTINKEEALQRPVAS
VKLQTVHSIPLTWNKFEALQIPVAS

SEQ ID NO: 53189 - protein, 25 aa, synthetic construct
  source 1..25: note = Seed: VKLQTVHSIPLTINKEEALQRPVAS
VKLQTVHSIPLTWNKFEALQVPVAS

SEQ ID NO: 53190 - protein, 25 aa, synthetic construct
  source 1..25: note = Seed: VKLQTVHSIPLTINKEEALQRPVAS
VKLQTVHSIPLTWNKFEPLQVPVAS

SEQ ID NO: 53191 - protein, 25 aa, synthetic construct
  source 1..25: note = Seed: VKLQTVHSIPLTINKEEALQRPVAS
VKLQTVHSIPLTWNKFESLQVPVAS

SEQ ID NO: 53192 - protein, 25 aa, synthetic construct
  source 1..25: note = Seed: VKLQTVHSIPLTINKEEALQRPVAS
VKLQTVHSIPLTWNKIEALQAPVAS

SEQ ID NO: 53193 - protein, 25 aa, synthetic construct
  source 1..25: note = Seed: VKLQTVHSIPLTINKEEALQRPVAS
VKLQTVHSIPLTWNKIEALQIPVAS

SEQ ID NO: 53194 - protein, 25 aa, synthetic construct
  source 1..25: note = Seed: VKLQTVHSIPLTINKEEALQRPVAS
VKLQTVHSIPLTWNKIEALQLPVAS

SEQ ID NO: 53195 - protein, 25 aa, synthetic construct
  source 1..25: note = Seed: VKLQTVHSIPLTINKEEALQRPVAS
VKLQTVHSIPLTWNKIEALQMPVAS

SEQ ID NO: 53196 - protein, 25 aa, synthetic construct
  source 1..25: note = Seed: VKLQTVHSIPLTINKEEALQRPVAS
VKLQTVHSIPLTWNKIEALQSPVAS

SEQ ID NO: 53197 - protein, 25 aa, synthetic construct
  source 1..25: note = Seed: VKLQTVHSIPLTINKEEALQRPVAS
VKLQTVHSIPLTWNKIEALQTPVAS

SEQ ID NO: 53198 - protein, 25 aa, synthetic construct
  source 1..25: note = Seed: VKLQTVHSIPLTINKEEALQRPVAS
VKLQTVHSIPLTWNKIEALQVPVAS

SEQ ID NO: 53199 - protein, 25 aa, synthetic construct
  source 1..25: note = Seed: VKLQTVHSIPLTINKEEALQRPVAS
VKLQTVHSIPLTWNKIEGLQAPVAS

SEQ ID NO: 53200 - protein, 25 aa, synthetic construct
  source 1..25: note = Seed: VKLQTVHSIPLTINKEEALQRPVAS
VKLQTVHSIPLTWNKIEGLQIPVAS

SEQ ID NO: 53201 - protein, 25 aa, synthetic construct
  source 1..25: note = Seed: VKLQTVHSIPLTINKEEALQRPVAS
VKLQTVHSIPLTWNKIEGLQLPVAS

SEQ ID NO: 53202 - protein, 25 aa, synthetic construct
  source 1..25: note = Seed: VKLQTVHSIPLTINKEEALQRPVAS
VKLQTVHSIPLTWNKIEGLQVPVAS

SEQ ID NO: 53203 - protein, 25 aa, synthetic construct
  source 1..25: note = Seed: VKLQTVHSIPLTINKEEALQRPVAS
VKLQTVHSIPLTWNKIEPLQIPVAS

SEQ ID NO: 53204 - protein, 25 aa, synthetic construct
  source 1..25: note = Seed: VKLQTVHSIPLTINKEEALQRPVAS
VKLQTVHSIPLTWNKIEPLQLPVAS

SEQ ID NO: 53205 - protein, 25 aa, synthetic construct
  source 1..25: note = Seed: VKLQTVHSIPLTINKEEALQRPVAS
VKLQTVHSIPLTWNKIEPLQVPVAS

SEQ ID NO: 53206 - protein, 25 aa, synthetic construct
  source 1..25: note = Seed: VKLQTVHSIPLTINKEEALQRPVAS
VKLQTVHSIPLTWNKIESLQIPVAS

SEQ ID NO: 53207 - protein, 25 aa, synthetic construct
  source 1..25: note = Seed: VKLQTVHSIPLTINKEEALQRPVAS
VKLQTVHSIPLTWNKIESLQLPVAS

SEQ ID NO: 53208 - protein, 25 aa, synthetic construct
  source 1..25: note = Seed: VKLQTVHSIPLTINKEEALQRPVAS
VKLQTVHSIPLTWNKIESLQVPVAS

SEQ ID NO: 53209 - protein, 25 aa, synthetic construct
  source 1..25: note = Seed: VKLQTVHSIPLTINKEEALQRPVAS
VKLQTVHSIPLTWNKLEALQAPVAS

SEQ ID NO: 53210 - protein, 25 aa, synthetic construct
  source 1..25: note = Seed: VKLQTVHSIPLTINKEEALQRPVAS
VKLQTVHSIPLTWNKLEALQGPVAS

SEQ ID NO: 53211 - protein, 25 aa, synthetic construct
  source 1..25: note = Seed: VKLQTVHSIPLTINKEEALQRPVAS
VKLQTVHSIPLTWNKLEALQIPVAS

SEQ ID NO: 53212 - protein, 25 aa, synthetic construct
  source 1..25: note = Seed: VKLQTVHSIPLTINKEEALQRPVAS
VKLQTVHSIPLTWNKLEALQLPVAS

SEQ ID NO: 53213 - protein, 25 aa, synthetic construct
  source 1..25: note = Seed: VKLQTVHSIPLTINKEEALQRPVAS
VKLQTVHSIPLTWNKLEALQMPVAS

SEQ ID NO: 53214 - protein, 25 aa, synthetic construct
  source 1..25: note = Seed: VKLQTVHSIPLTINKEEALQRPVAS
VKLQTVHSIPLTWNKLEALQSPVAS

SEQ ID NO: 53215 - protein, 25 aa, synthetic construct
  source 1..25: note = Seed: VKLQTVHSIPLTINKEEALQRPVAS
VKLQTVHSIPLTWNKLEALQTPVAS

SEQ ID NO: 53216 - protein, 25 aa, synthetic construct
  source 1..25: note = Seed: VKLQTVHSIPLTINKEEALQRPVAS
VKLQTVHSIPLTWNKLEALQVPVAS

SEQ ID NO: 53217 - protein, 25 aa, synthetic construct
  source 1..25: note = Seed: VKLQTVHSIPLTINKEEALQRPVAS
VKLQTVHSIPLTWNKLEGLQAPVAS

SEQ ID NO: 53218 - protein, 25 aa, synthetic construct
  source 1..25: note = Seed: VKLQTVHSIPLTINKEEALQRPVAS
VKLQTVHSIPLTWNKLEGLQIPVAS

SEQ ID NO: 53219 - protein, 25 aa, synthetic construct
  source 1..25: note = Seed: VKLQTVHSIPLTINKEEALQRPVAS
VKLQTVHSIPLTWNKLEGLQLPVAS

SEQ ID NO: 53220 - protein, 25 aa, synthetic construct
  source 1..25: note = Seed: VKLQTVHSIPLTINKEEALQRPVAS
VKLQTVHSIPLTWNKLEGLQMPVAS

SEQ ID NO: 53221 - protein, 25 aa, synthetic construct
  source 1..25: note = Seed: VKLQTVHSIPLTINKEEALQRPVAS
VKLQTVHSIPLTWNKLEGLQSPVAS

SEQ ID NO: 53222 - protein, 25 aa, synthetic construct
  source 1..25: note = Seed: VKLQTVHSIPLTINKEEALQRPVAS
VKLQTVHSIPLTWNKLEGLQTPVAS

SEQ ID NO: 53223 - protein, 25 aa, synthetic construct
  source 1..25: note = Seed: VKLQTVHSIPLTINKEEALQRPVAS
VKLQTVHSIPLTWNKLEGLQVPVAS

SEQ ID NO: 53224 - protein, 25 aa, synthetic construct
  source 1..25: note = Seed: VKLQTVHSIPLTINKEEALQRPVAS
VKLQTVHSIPLTWNKLENLQAPVAS

SEQ ID NO: 53225 - protein, 25 aa, synthetic construct
  source 1..25: note = Seed: VKLQTVHSIPLTINKEEALQRPVAS
VKLQTVHSIPLTWNKLENLQLPVAS

SEQ ID NO: 53226 - protein, 25 aa, synthetic construct
  source 1..25: note = Seed: VKLQTVHSIPLTINKEEALQRPVAS
VKLQTVHSIPLTWNKLENLQVPVAS

SEQ ID NO: 53227 - protein, 25 aa, synthetic construct
  source 1..25: note = Seed: VKLQTVHSIPLTINKEEALQRPVAS
VKLQTVHSIPLTWNKLEPLQAPVAS

SEQ ID NO: 53228 - protein, 25 aa, synthetic construct
  source 1..25: note = Seed: VKLQTVHSIPLTINKEEALQRPVAS
VKLQTVHSIPLTWNKLEPLQIPVAS

SEQ ID NO: 53229 - protein, 25 aa, synthetic construct
  source 1..25: note = Seed: VKLQTVHSIPLTINKEEALQRPVAS
VKLQTVHSIPLTWNKLEPLQLPVAS

SEQ ID NO: 53230 - protein, 25 aa, synthetic construct
  source 1..25: note = Seed: VKLQTVHSIPLTINKEEALQRPVAS
VKLQTVHSIPLTWNKLEPLQMPVAS

SEQ ID NO: 53231 - protein, 25 aa, synthetic construct
  source 1..25: note = Seed: VKLQTVHSIPLTINKEEALQRPVAS
VKLQTVHSIPLTWNKLEPLQSPVAS

SEQ ID NO: 53232 - protein, 25 aa, synthetic construct
  source 1..25: note = Seed: VKLQTVHSIPLTINKEEALQRPVAS
VKLQTVHSIPLTWNKLEPLQTPVAS

SEQ ID NO: 53233 - protein, 25 aa, synthetic construct
  source 1..25: note = Seed: VKLQTVHSIPLTINKEEALQRPVAS
VKLQTVHSIPLTWNKLEPLQVPVAS

SEQ ID NO: 53234 - protein, 25 aa, synthetic construct
  source 1..25: note = Seed: VKLQTVHSIPLTINKEEALQRPVAS
VKLQTVHSIPLTWNKLESLQAPVAS

SEQ ID NO: 53235 - protein, 25 aa, synthetic construct
  source 1..25: note = Seed: VKLQTVHSIPLTINKEEALQRPVAS
VKLQTVHSIPLTWNKLESLQGPVAS

SEQ ID NO: 53236 - protein, 25 aa, synthetic construct
  source 1..25: note = Seed: VKLQTVHSIPLTINKEEALQRPVAS
VKLQTVHSIPLTWNKLESLQIPVAS

SEQ ID NO: 53237 - protein, 25 aa, synthetic construct
  source 1..25: note = Seed: VKLQTVHSIPLTINKEEALQRPVAS
VKLQTVHSIPLTWNKLESLQLPVAS

SEQ ID NO: 53238 - protein, 25 aa, synthetic construct
  source 1..25: note = Seed: VKLQTVHSIPLTINKEEALQRPVAS
VKLQTVHSIPLTWNKLESLQMPVAS

SEQ ID NO: 53239 - protein, 25 aa, synthetic construct
  source 1..25: note = Seed: VKLQTVHSIPLTINKEEALQRPVAS
VKLQTVHSIPLTWNKLESLQSPVAS

SEQ ID NO: 53240 - protein, 25 aa, synthetic construct
  source 1..25: note = Seed: VKLQTVHSIPLTINKEEALQRPVAS
VKLQTVHSIPLTWNKLESLQTPVAS

SEQ ID NO: 53241 - protein, 25 aa, synthetic construct
  source 1..25: note = Seed: VKLQTVHSIPLTINKEEALQRPVAS
VKLQTVHSIPLTWNKLESLQVPVAS

SEQ ID NO: 53242 - protein, 25 aa, synthetic construct
  source 1..25: note = Seed: VKLQTVHSIPLTINKEEALQRPVAS
VKLQTVHSIPLTWNKLETLQAPVAS

SEQ ID NO: 53243 - protein, 25 aa, synthetic construct
  source 1..25: note = Seed: VKLQTVHSIPLTINKEEALQRPVAS
VKLQTVHSIPLTWNKLETLQIPVAS

SEQ ID NO: 53244 - protein, 25 aa, synthetic construct
  source 1..25: note = Seed: VKLQTVHSIPLTINKEEALQRPVAS
VKLQTVHSIPLTWNKLETLQLPVAS

SEQ ID NO: 53245 - protein, 25 aa, synthetic construct
  source 1..25: note = Seed: VKLQTVHSIPLTINKEEALQRPVAS
VKLQTVHSIPLTWNKLETLQVPVAS

SEQ ID NO: 53246 - protein, 25 aa, synthetic construct
  source 1..25: note = Seed: VKLQTVHSIPLTINKEEALQRPVAS
VKLQTVHSIPLTWNKMEALQAPVAS

SEQ ID NO: 53247 - protein, 25 aa, synthetic construct
  source 1..25: note = Seed: VKLQTVHSIPLTINKEEALQRPVAS
VKLQTVHSIPLTWNKMEALQGPVAS

SEQ ID NO: 53248 - protein, 25 aa, synthetic construct
  source 1..25: note = Seed: VKLQTVHSIPLTINKEEALQRPVAS
VKLQTVHSIPLTWNKMEALQIPVAS

SEQ ID NO: 53249 - protein, 25 aa, synthetic construct
  source 1..25: note = Seed: VKLQTVHSIPLTINKEEALQRPVAS
VKLQTVHSIPLTWNKMEALQLPVAS

SEQ ID NO: 53250 - protein, 25 aa, synthetic construct
  source 1..25: note = Seed: VKLQTVHSIPLTINKEEALQRPVAS
VKLQTVHSIPLTWNKMEALQMPVAS

SEQ ID NO: 53251 - protein, 25 aa, synthetic construct
  source 1..25: note = Seed: VKLQTVHSIPLTINKEEALQRPVAS
VKLQTVHSIPLTWNKMEALQSPVAS

SEQ ID NO: 53252 - protein, 25 aa, synthetic construct
  source 1..25: note = Seed: VKLQTVHSIPLTINKEEALQRPVAS
VKLQTVHSIPLTWNKMEALQTPVAS

SEQ ID NO: 53253 - protein, 25 aa, synthetic construct
  source 1..25: note = Seed: VKLQTVHSIPLTINKEEALQRPVAS
VKLQTVHSIPLTWNKMEALQVPVAS

SEQ ID NO: 53254 - protein, 25 aa, synthetic construct
  source 1..25: note = Seed: VKLQTVHSIPLTINKEEALQRPVAS
VKLQTVHSIPLTWNKMEGLQAPVAS

SEQ ID NO: 53255 - protein, 25 aa, synthetic construct
  source 1..25: note = Seed: VKLQTVHSIPLTINKEEALQRPVAS
VKLQTVHSIPLTWNKMEGLQIPVAS

SEQ ID NO: 53256 - protein, 25 aa, synthetic construct
  source 1..25: note = Seed: VKLQTVHSIPLTINKEEALQRPVAS
VKLQTVHSIPLTWNKMEGLQLPVAS

SEQ ID NO: 53257 - protein, 25 aa, synthetic construct
  source 1..25: note = Seed: VKLQTVHSIPLTINKEEALQRPVAS
VKLQTVHSIPLTWNKMEGLQMPVAS

SEQ ID NO: 53258 - protein, 25 aa, synthetic construct
  source 1..25: note = Seed: VKLQTVHSIPLTINKEEALQRPVAS
VKLQTVHSIPLTWNKMEGLQSPVAS

SEQ ID NO: 53259 - protein, 25 aa, synthetic construct
  source 1..25: note = Seed: VKLQTVHSIPLTINKEEALQRPVAS
VKLQTVHSIPLTWNKMEGLQTPVAS

SEQ ID NO: 53260 - protein, 25 aa, synthetic construct
  source 1..25: note = Seed: VKLQTVHSIPLTINKEEALQRPVAS
VKLQTVHSIPLTWNKMEGLQVPVAS

SEQ ID NO: 53261 - protein, 25 aa, synthetic construct
  source 1..25: note = Seed: VKLQTVHSIPLTINKEEALQRPVAS
VKLQTVHSIPLTWNKMENLQAPVAS

SEQ ID NO: 53262 - protein, 25 aa, synthetic construct
  source 1..25: note = Seed: VKLQTVHSIPLTINKEEALQRPVAS
VKLQTVHSIPLTWNKMENLQIPVAS

SEQ ID NO: 53263 - protein, 25 aa, synthetic construct
  source 1..25: note = Seed: VKLQTVHSIPLTINKEEALQRPVAS
VKLQTVHSIPLTWNKMENLQLPVAS

SEQ ID NO: 53264 - protein, 25 aa, synthetic construct
  source 1..25: note = Seed: VKLQTVHSIPLTINKEEALQRPVAS
VKLQTVHSIPLTWNKMENLQVPVAS

SEQ ID NO: 53265 - protein, 25 aa, synthetic construct
  source 1..25: note = Seed: VKLQTVHSIPLTINKEEALQRPVAS
VKLQTVHSIPLTWNKMEPLQAPVAS

SEQ ID NO: 53266 - protein, 25 aa, synthetic construct
  source 1..25: note = Seed: VKLQTVHSIPLTINKEEALQRPVAS
VKLQTVHSIPLTWNKMEPLQIPVAS

SEQ ID NO: 53267 - protein, 25 aa, synthetic construct
  source 1..25: note = Seed: VKLQTVHSIPLTINKEEALQRPVAS
VKLQTVHSIPLTWNKMEPLQLPVAS

SEQ ID NO: 53268 - protein, 25 aa, synthetic construct
  source 1..25: note = Seed: VKLQTVHSIPLTINKEEALQRPVAS
VKLQTVHSIPLTWNKMEPLQMPVAS

SEQ ID NO: 53269 - protein, 25 aa, synthetic construct
  source 1..25: note = Seed: VKLQTVHSIPLTINKEEALQRPVAS
VKLQTVHSIPLTWNKMEPLQVPVAS

SEQ ID NO: 53270 - protein, 25 aa, synthetic construct
  source 1..25: note = Seed: VKLQTVHSIPLTINKEEALQRPVAS
VKLQTVHSIPLTWNKMESLQAPVAS

SEQ ID NO: 53271 - protein, 25 aa, synthetic construct
  source 1..25: note = Seed: VKLQTVHSIPLTINKEEALQRPVAS
VKLQTVHSIPLTWNKMESLQIPVAS

SEQ ID NO: 53272 - protein, 25 aa, synthetic construct
  source 1..25: note = Seed: VKLQTVHSIPLTINKEEALQRPVAS
VKLQTVHSIPLTWNKMESLQLPVAS

SEQ ID NO: 53273 - protein, 25 aa, synthetic construct
  source 1..25: note = Seed: VKLQTVHSIPLTINKEEALQRPVAS
VKLQTVHSIPLTWNKMESLQMPVAS

SEQ ID NO: 53274 - protein, 25 aa, synthetic construct
  source 1..25: note = Seed: VKLQTVHSIPLTINKEEALQRPVAS
VKLQTVHSIPLTWNKMESLQSPVAS

SEQ ID NO: 53275 - protein, 25 aa, synthetic construct
  source 1..25: note = Seed: VKLQTVHSIPLTINKEEALQRPVAS
VKLQTVHSIPLTWNKMESLQTPVAS

SEQ ID NO: 53276 - protein, 25 aa, synthetic construct
  source 1..25: note = Seed: VKLQTVHSIPLTINKEEALQRPVAS
VKLQTVHSIPLTWNKMESLQVPVAS

SEQ ID NO: 53277 - protein, 25 aa, synthetic construct
  source 1..25: note = Seed: VKLQTVHSIPLTINKEEALQRPVAS
VKLQTVHSIPLTWNKMETLQAPVAS

SEQ ID NO: 53278 - protein, 25 aa, synthetic construct
  source 1..25: note = Seed: VKLQTVHSIPLTINKEEALQRPVAS
VKLQTVHSIPLTWNKMETLQIPVAS

SEQ ID NO: 53279 - protein, 25 aa, synthetic construct
  source 1..25: note = Seed: VKLQTVHSIPLTINKEEALQRPVAS
VKLQTVHSIPLTWNKMETLQLPVAS

SEQ ID NO: 53280 - protein, 25 aa, synthetic construct
  source 1..25: note = Seed: VKLQTVHSIPLTINKEEALQRPVAS
VKLQTVHSIPLTWNKMETLQVPVAS

SEQ ID NO: 53281 - protein, 25 aa, synthetic construct
  source 1..25: note = Seed: VKLQTVHSIPLTINKEEALQRPVAS
VKLQTVHSIPLTWNKMEVLQAPVAS

SEQ ID NO: 53282 - protein, 25 aa, synthetic construct
  source 1..25: note = Seed: VKLQTVHSIPLTINKEEALQRPVAS
VKLQTVHSIPLTWNKQEALQAPVAS

SEQ ID NO: 53283 - protein, 25 aa, synthetic construct
  source 1..25: note = Seed: VKLQTVHSIPLTINKEEALQRPVAS
VKLQTVHSIPLTWNKQEALQIPVAS

SEQ ID NO: 53284 - protein, 25 aa, synthetic construct
  source 1..25: note = Seed: VKLQTVHSIPLTINKEEALQRPVAS
VKLQTVHSIPLTWNKQEALQLPVAS

SEQ ID NO: 53285 - protein, 25 aa, synthetic construct
  source 1..25: note = Seed: VKLQTVHSIPLTINKEEALQRPVAS
VKLQTVHSIPLTWNKQEALQVPVAS

SEQ ID NO: 53286 - protein, 25 aa, synthetic construct
  source 1..25: note = Seed: VKLQTVHSIPLTINKEEALQRPVAS
VKLQTVHSIPLTWNKVEALQAPVAS

SEQ ID NO: 53287 - protein, 25 aa, synthetic construct
  source 1..25: note = Seed: VKLQTVHSIPLTINKEEALQRPVAS
VKLQTVHSIPLTWNKVEALQIPVAS

SEQ ID NO: 53288 - protein, 25 aa, synthetic construct
  source 1..25: note = Seed: VKLQTVHSIPLTINKEEALQRPVAS
VKLQTVHSIPLTWNKVEALQLPVAS

SEQ ID NO: 53289 - protein, 25 aa, synthetic construct
  source 1..25: note = Seed: VKLQTVHSIPLTINKEEALQRPVAS
VKLQTVHSIPLTWNKVEALQVPVAS

SEQ ID NO: 53290 - protein, 25 aa, synthetic construct
  source 1..25: note = Seed: VKLQTVHSIPLTINKEEALQRPVAS
VKLQTVHSIPLTYNKAEALQAPVAS

SEQ ID NO: 53291 - protein, 25 aa, synthetic construct
  source 1..25: note = Seed: VKLQTVHSIPLTINKEEALQRPVAS
VKLQTVHSIPLTYNKAEALQCPVAS

SEQ ID NO: 53292 - protein, 25 aa, synthetic construct
  source 1..25: note = Seed: VKLQTVHSIPLTINKEEALQRPVAS
VKLQTVHSIPLTYNKAEALQGPVAS

SEQ ID NO: 53293 - protein, 25 aa, synthetic construct
  source 1..25: note = Seed: VKLQTVHSIPLTINKEEALQRPVAS
VKLQTVHSIPLTYNKAEALQIPVAS

SEQ ID NO: 53294 - protein, 25 aa, synthetic construct
  source 1..25: note = Seed: VKLQTVHSIPLTINKEEALQRPVAS
VKLQTVHSIPLTYNKAEALQLPVAS

SEQ ID NO: 53295 - protein, 25 aa, synthetic construct
  source 1..25: note = Seed: VKLQTVHSIPLTINKEEALQRPVAS
VKLQTVHSIPLTYNKAEALQMPVAS

SEQ ID NO: 53296 - protein, 25 aa, synthetic construct
  source 1..25: note = Seed: VKLQTVHSIPLTINKEEALQRPVAS
VKLQTVHSIPLTYNKAEALQNPVAS

SEQ ID NO: 53297 - protein, 25 aa, synthetic construct
  source 1..25: note = Seed: VKLQTVHSIPLTINKEEALQRPVAS
VKLQTVHSIPLTYNKAEALQSPVAS

SEQ ID NO: 53298 - protein, 25 aa, synthetic construct
  source 1..25: note = Seed: VKLQTVHSIPLTINKEEALQRPVAS
VKLQTVHSIPLTYNKAEALQTPVAS

SEQ ID NO: 53299 - protein, 25 aa, synthetic construct
  source 1..25: note = Seed: VKLQTVHSIPLTINKEEALQRPVAS
VKLQTVHSIPLTYNKAEALQVPVAS

SEQ ID NO: 53300 - protein, 25 aa, synthetic construct
  source 1..25: note = Seed: VKLQTVHSIPLTINKEEALQRPVAS
VKLQTVHSIPLTYNKAEGLQAPVAS

SEQ ID NO: 53301 - protein, 25 aa, synthetic construct
  source 1..25: note = Seed: VKLQTVHSIPLTINKEEALQRPVAS
VKLQTVHSIPLTYNKAEGLQIPVAS

SEQ ID NO: 53302 - protein, 25 aa, synthetic construct
  source 1..25: note = Seed: VKLQTVHSIPLTINKEEALQRPVAS
VKLQTVHSIPLTYNKAEGLQLPVAS

SEQ ID NO: 53303 - protein, 25 aa, synthetic construct
  source 1..25: note = Seed: VKLQTVHSIPLTINKEEALQRPVAS
VKLQTVHSIPLTYNKAEGLQMPVAS

SEQ ID NO: 53304 - protein, 25 aa, synthetic construct
  source 1..25: note = Seed: VKLQTVHSIPLTINKEEALQRPVAS
VKLQTVHSIPLTYNKAEGLQSPVAS

SEQ ID NO: 53305 - protein, 25 aa, synthetic construct
  source 1..25: note = Seed: VKLQTVHSIPLTINKEEALQRPVAS
VKLQTVHSIPLTYNKAEGLQTPVAS

SEQ ID NO: 53306 - protein, 25 aa, synthetic construct
  source 1..25: note = Seed: VKLQTVHSIPLTINKEEALQRPVAS
VKLQTVHSIPLTYNKAEGLQVPVAS

SEQ ID NO: 53307 - protein, 25 aa, synthetic construct
  source 1..25: note = Seed: VKLQTVHSIPLTINKEEALQRPVAS
VKLQTVHSIPLTYNKAENLQAPVAS

SEQ ID NO: 53308 - protein, 25 aa, synthetic construct
  source 1..25: note = Seed: VKLQTVHSIPLTINKEEALQRPVAS
VKLQTVHSIPLTYNKAENLQIPVAS

SEQ ID NO: 53309 - protein, 25 aa, synthetic construct
  source 1..25: note = Seed: VKLQTVHSIPLTINKEEALQRPVAS
VKLQTVHSIPLTYNKAENLQLPVAS

SEQ ID NO: 53310 - protein, 25 aa, synthetic construct
  source 1..25: note = Seed: VKLQTVHSIPLTINKEEALQRPVAS
VKLQTVHSIPLTYNKAENLQVPVAS

SEQ ID NO: 53311 - protein, 25 aa, synthetic construct
  source 1..25: note = Seed: VKLQTVHSIPLTINKEEALQRPVAS
VKLQTVHSIPLTYNKAEPLQAPVAS

SEQ ID NO: 53312 - protein, 25 aa, synthetic construct
  source 1..25: note = Seed: VKLQTVHSIPLTINKEEALQRPVAS
VKLQTVHSIPLTYNKAEPLQIPVAS

SEQ ID NO: 53313 - protein, 25 aa, synthetic construct
  source 1..25: note = Seed: VKLQTVHSIPLTINKEEALQRPVAS
VKLQTVHSIPLTYNKAEPLQLPVAS

SEQ ID NO: 53314 - protein, 25 aa, synthetic construct
  source 1..25: note = Seed: VKLQTVHSIPLTINKEEALQRPVAS
VKLQTVHSIPLTYNKAEPLQMPVAS

SEQ ID NO: 53315 - protein, 25 aa, synthetic construct
  source 1..25: note = Seed: VKLQTVHSIPLTINKEEALQRPVAS
VKLQTVHSIPLTYNKAEPLQVPVAS

SEQ ID NO: 53316 - protein, 25 aa, synthetic construct
  source 1..25: note = Seed: VKLQTVHSIPLTINKEEALQRPVAS
VKLQTVHSIPLTYNKAESLQAPVAS

SEQ ID NO: 53317 - protein, 25 aa, synthetic construct
  source 1..25: note = Seed: VKLQTVHSIPLTINKEEALQRPVAS
VKLQTVHSIPLTYNKAESLQIPVAS

SEQ ID NO: 53318 - protein, 25 aa, synthetic construct
  source 1..25: note = Seed: VKLQTVHSIPLTINKEEALQRPVAS
VKLQTVHSIPLTYNKAESLQLPVAS

SEQ ID NO: 53319 - protein, 25 aa, synthetic construct
  source 1..25: note = Seed: VKLQTVHSIPLTINKEEALQRPVAS
VKLQTVHSIPLTYNKAESLQMPVAS

SEQ ID NO: 53320 - protein, 25 aa, synthetic construct
  source 1..25: note = Seed: VKLQTVHSIPLTINKEEALQRPVAS
VKLQTVHSIPLTYNKAESLQSPVAS

SEQ ID NO: 53321 - protein, 25 aa, synthetic construct
  source 1..25: note = Seed: VKLQTVHSIPLTINKEEALQRPVAS
VKLQTVHSIPLTYNKAESLQTPVAS

SEQ ID NO: 53322 - protein, 25 aa, synthetic construct
  source 1..25: note = Seed: VKLQTVHSIPLTINKEEALQRPVAS
VKLQTVHSIPLTYNKAESLQVPVAS

SEQ ID NO: 53323 - protein, 25 aa, synthetic construct
  source 1..25: note = Seed: VKLQTVHSIPLTINKEEALQRPVAS
VKLQTVHSIPLTYNKAETLQAPVAS

SEQ ID NO: 53324 - protein, 25 aa, synthetic construct
  source 1..25: note = Seed: VKLQTVHSIPLTINKEEALQRPVAS
VKLQTVHSIPLTYNKAETLQIPVAS

SEQ ID NO: 53325 - protein, 25 aa, synthetic construct
  source 1..25: note = Seed: VKLQTVHSIPLTINKEEALQRPVAS
VKLQTVHSIPLTYNKAETLQLPVAS

SEQ ID NO: 53326 - protein, 25 aa, synthetic construct
  source 1..25: note = Seed: VKLQTVHSIPLTINKEEALQRPVAS
VKLQTVHSIPLTYNKAETLQVPVAS

SEQ ID NO: 53327 - protein, 25 aa, synthetic construct
  source 1..25: note = Seed: VKLQTVHSIPLTINKEEALQRPVAS
VKLQTVHSIPLTYNKEEALQAPVAS

SEQ ID NO: 53328 - protein, 25 aa, synthetic construct
  source 1..25: note = Seed: VKLQTVHSIPLTINKEEALQRPVAS
VKLQTVHSIPLTYNKEEALQIPVAS

SEQ ID NO: 53329 - protein, 25 aa, synthetic construct
  source 1..25: note = Seed: VKLQTVHSIPLTINKEEALQRPVAS
VKLQTVHSIPLTYNKEEALQLPVAS

SEQ ID NO: 53330 - protein, 25 aa, synthetic construct
  source 1..25: note = Seed: VKLQTVHSIPLTINKEEALQRPVAS
VKLQTVHSIPLTYNKEEALQVPVAS

SEQ ID NO: 53331 - protein, 25 aa, synthetic construct
  source 1..25: note = Seed: VKLQTVHSIPLTINKEEALQRPVAS
VKLQTVHSIPLTYNKFEALQAPVAS

SEQ ID NO: 53332 - protein, 25 aa, synthetic construct
  source 1..25: note = Seed: VKLQTVHSIPLTINKEEALQRPVAS
VKLQTVHSIPLTYNKFEALQIPVAS

SEQ ID NO: 53333 - protein, 25 aa, synthetic construct
  source 1..25: note = Seed: VKLQTVHSIPLTINKEEALQRPVAS
VKLQTVHSIPLTYNKFEALQLPVAS

SEQ ID NO: 53334 - protein, 25 aa, synthetic construct
  source 1..25: note = Seed: VKLQTVHSIPLTINKEEALQRPVAS
VKLQTVHSIPLTYNKFEALQMPVAS

SEQ ID NO: 53335 - protein, 25 aa, synthetic construct
  source 1..25: note = Seed: VKLQTVHSIPLTINKEEALQRPVAS
VKLQTVHSIPLTYNKFEALQVPVAS

SEQ ID NO: 53336 - protein, 25 aa, synthetic construct
  source 1..25: note = Seed: VKLQTVHSIPLTINKEEALQRPVAS
VKLQTVHSIPLTYNKFEGLQIPVAS

SEQ ID NO: 53337 - protein, 25 aa, synthetic construct
  source 1..25: note = Seed: VKLQTVHSIPLTINKEEALQRPVAS
VKLQTVHSIPLTYNKFEGLQTPVAS

SEQ ID NO: 53338 - protein, 25 aa, synthetic construct
  source 1..25: note = Seed: VKLQTVHSIPLTINKEEALQRPVAS
VKLQTVHSIPLTYNKFEGLQVPVAS

SEQ ID NO: 53339 - protein, 25 aa, synthetic construct
  source 1..25: note = Seed: VKLQTVHSIPLTINKEEALQRPVAS
VKLQTVHSIPLTYNKFENLQSPVAS

SEQ ID NO: 53340 - protein, 25 aa, synthetic construct
  source 1..25: note = Seed: VKLQTVHSIPLTINKEEALQRPVAS
VKLQTVHSIPLTYNKFENLQVPVAS

SEQ ID NO: 53341 - protein, 25 aa, synthetic construct
  source 1..25: note = Seed: VKLQTVHSIPLTINKEEALQRPVAS
VKLQTVHSIPLTYNKFEPLQIPVAS

SEQ ID NO: 53342 - protein, 25 aa, synthetic construct
  source 1..25: note = Seed: VKLQTVHSIPLTINKEEALQRPVAS
VKLQTVHSIPLTYNKFEPLQVPVAS

SEQ ID NO: 53343 - protein, 25 aa, synthetic construct
  source 1..25: note = Seed: VKLQTVHSIPLTINKEEALQRPVAS
VKLQTVHSIPLTYNKFESLQAPVAS

SEQ ID NO: 53344 - protein, 25 aa, synthetic construct
  source 1..25: note = Seed: VKLQTVHSIPLTINKEEALQRPVAS
VKLQTVHSIPLTYNKFESLQIPVAS

SEQ ID NO: 53345 - protein, 25 aa, synthetic construct
  source 1..25: note = Seed: VKLQTVHSIPLTINKEEALQRPVAS
VKLQTVHSIPLTYNKFESLQLPVAS

SEQ ID NO: 53346 - protein, 25 aa, synthetic construct
  source 1..25: note = Seed: VKLQTVHSIPLTINKEEALQRPVAS
VKLQTVHSIPLTYNKFESLQSPVAS

SEQ ID NO: 53347 - protein, 25 aa, synthetic construct
  source 1..25: note = Seed: VKLQTVHSIPLTINKEEALQRPVAS
VKLQTVHSIPLTYNKFESLQVPVAS

SEQ ID NO: 53348 - protein, 25 aa, synthetic construct
  source 1..25: note = Seed: VKLQTVHSIPLTINKEEALQRPVAS
VKLQTVHSIPLTYNKFETLQAPVAS

SEQ ID NO: 53349 - protein, 25 aa, synthetic construct
  source 1..25: note = Seed: VKLQTVHSIPLTINKEEALQRPVAS
VKLQTVHSIPLTYNKFETLQSPVAS

SEQ ID NO: 53350 - protein, 25 aa, synthetic construct
  source 1..25: note = Seed: VKLQTVHSIPLTINKEEALQRPVAS
VKLQTVHSIPLTYNKFETLQVPVAS

SEQ ID NO: 53351 - protein, 25 aa, synthetic construct
  source 1..25: note = Seed: VKLQTVHSIPLTINKEEALQRPVAS
VKLQTVHSIPLTYNKGEALQAPVAS

SEQ ID NO: 53352 - protein, 25 aa, synthetic construct
  source 1..25: note = Seed: VKLQTVHSIPLTINKEEALQRPVAS
VKLQTVHSIPLTYNKGEALQIPVAS

SEQ ID NO: 53353 - protein, 25 aa, synthetic construct
  source 1..25: note = Seed: VKLQTVHSIPLTINKEEALQRPVAS
VKLQTVHSIPLTYNKGEALQLPVAS

SEQ ID NO: 53354 - protein, 25 aa, synthetic construct
  source 1..25: note = Seed: VKLQTVHSIPLTINKEEALQRPVAS
VKLQTVHSIPLTYNKGEALQMPVAS

SEQ ID NO: 53355 - protein, 25 aa, synthetic construct
  source 1..25: note = Seed: VKLQTVHSIPLTINKEEALQRPVAS
VKLQTVHSIPLTYNKGEALQVPVAS

SEQ ID NO: 53356 - protein, 25 aa, synthetic construct
  source 1..25: note = Seed: VKLQTVHSIPLTINKEEALQRPVAS
VKLQTVHSIPLTYNKGEGLQLPVAS

SEQ ID NO: 53357 - protein, 25 aa, synthetic construct
  source 1..25: note = Seed: VKLQTVHSIPLTINKEEALQRPVAS
VKLQTVHSIPLTYNKGESLQIPVAS

SEQ ID NO: 53358 - protein, 25 aa, synthetic construct
  source 1..25: note = Seed: VKLQTVHSIPLTINKEEALQRPVAS
VKLQTVHSIPLTYNKGESLQLPVAS

SEQ ID NO: 53359 - protein, 25 aa, synthetic construct
  source 1..25: note = Seed: VKLQTVHSIPLTINKEEALQRPVAS
VKLQTVHSIPLTYNKGESLQVPVAS

SEQ ID NO: 53360 - protein, 25 aa, synthetic construct
  source 1..25: note = Seed: VKLQTVHSIPLTINKEEALQRPVAS
VKLQTVHSIPLTYNKIEALQAPVAS

SEQ ID NO: 53361 - protein, 25 aa, synthetic construct
  source 1..25: note = Seed: VKLQTVHSIPLTINKEEALQRPVAS
VKLQTVHSIPLTYNKIEALQCPVAS

SEQ ID NO: 53362 - protein, 25 aa, synthetic construct
  source 1..25: note = Seed: VKLQTVHSIPLTINKEEALQRPVAS
VKLQTVHSIPLTYNKIEALQFPVAS

SEQ ID NO: 53363 - protein, 25 aa, synthetic construct
  source 1..25: note = Seed: VKLQTVHSIPLTINKEEALQRPVAS
VKLQTVHSIPLTYNKIEALQGPVAS

SEQ ID NO: 53364 - protein, 25 aa, synthetic construct
  source 1..25: note = Seed: VKLQTVHSIPLTINKEEALQRPVAS
VKLQTVHSIPLTYNKIEALQIPVAS

SEQ ID NO: 53365 - protein, 25 aa, synthetic construct
  source 1..25: note = Seed: VKLQTVHSIPLTINKEEALQRPVAS
VKLQTVHSIPLTYNKIEALQLPVAS

SEQ ID NO: 53366 - protein, 25 aa, synthetic construct
  source 1..25: note = Seed: VKLQTVHSIPLTINKEEALQRPVAS
VKLQTVHSIPLTYNKIEALQMPVAS

SEQ ID NO: 53367 - protein, 25 aa, synthetic construct
  source 1..25: note = Seed: VKLQTVHSIPLTINKEEALQRPVAS
VKLQTVHSIPLTYNKIEALQNPVAS

SEQ ID NO: 53368 - protein, 25 aa, synthetic construct
  source 1..25: note = Seed: VKLQTVHSIPLTINKEEALQRPVAS
VKLQTVHSIPLTYNKIEALQSPVAS

SEQ ID NO: 53369 - protein, 25 aa, synthetic construct
  source 1..25: note = Seed: VKLQTVHSIPLTINKEEALQRPVAS
VKLQTVHSIPLTYNKIEALQTPVAS

SEQ ID NO: 53370 - protein, 25 aa, synthetic construct
  source 1..25: note = Seed: VKLQTVHSIPLTINKEEALQRPVAS
VKLQTVHSIPLTYNKIEALQVPVAS

SEQ ID NO: 53371 - protein, 25 aa, synthetic construct
  source 1..25: note = Seed: VKLQTVHSIPLTINKEEALQRPVAS
VKLQTVHSIPLTYNKIEGLQAPVAS

SEQ ID NO: 53372 - protein, 25 aa, synthetic construct
  source 1..25: note = Seed: VKLQTVHSIPLTINKEEALQRPVAS
VKLQTVHSIPLTYNKIEGLQGPVAS

SEQ ID NO: 53373 - protein, 25 aa, synthetic construct
  source 1..25: note = Seed: VKLQTVHSIPLTINKEEALQRPVAS
VKLQTVHSIPLTYNKIEGLQIPVAS

SEQ ID NO: 53374 - protein, 25 aa, synthetic construct
  source 1..25: note = Seed: VKLQTVHSIPLTINKEEALQRPVAS
VKLQTVHSIPLTYNKIEGLQLPVAS

SEQ ID NO: 53375 - protein, 25 aa, synthetic construct
  source 1..25: note = Seed: VKLQTVHSIPLTINKEEALQRPVAS
VKLQTVHSIPLTYNKIEGLQMPVAS

SEQ ID NO: 53376 - protein, 25 aa, synthetic construct
  source 1..25: note = Seed: VKLQTVHSIPLTINKEEALQRPVAS
VKLQTVHSIPLTYNKIEGLQSPVAS

SEQ ID NO: 53377 - protein, 25 aa, synthetic construct
  source 1..25: note = Seed: VKLQTVHSIPLTINKEEALQRPVAS
VKLQTVHSIPLTYNKIEGLQTPVAS

SEQ ID NO: 53378 - protein, 25 aa, synthetic construct
  source 1..25: note = Seed: VKLQTVHSIPLTINKEEALQRPVAS
VKLQTVHSIPLTYNKIEGLQVPVAS

SEQ ID NO: 53379 - protein, 25 aa, synthetic construct
  source 1..25: note = Seed: VKLQTVHSIPLTINKEEALQRPVAS
VKLQTVHSIPLTYNKIENLQAPVAS

SEQ ID NO: 53380 - protein, 25 aa, synthetic construct
  source 1..25: note = Seed: VKLQTVHSIPLTINKEEALQRPVAS
VKLQTVHSIPLTYNKIENLQIPVAS

SEQ ID NO: 53381 - protein, 25 aa, synthetic construct
  source 1..25: note = Seed: VKLQTVHSIPLTINKEEALQRPVAS
VKLQTVHSIPLTYNKIENLQLPVAS

SEQ ID NO: 53382 - protein, 25 aa, synthetic construct
  source 1..25: note = Seed: VKLQTVHSIPLTINKEEALQRPVAS
VKLQTVHSIPLTYNKIENLQSPVAS

SEQ ID NO: 53383 - protein, 25 aa, synthetic construct
  source 1..25: note = Seed: VKLQTVHSIPLTINKEEALQRPVAS
VKLQTVHSIPLTYNKIENLQVPVAS

SEQ ID NO: 53384 - protein, 25 aa, synthetic construct
  source 1..25: note = Seed: VKLQTVHSIPLTINKEEALQRPVAS
VKLQTVHSIPLTYNKIEPLQAPVAS

SEQ ID NO: 53385 - protein, 25 aa, synthetic construct
  source 1..25: note = Seed: VKLQTVHSIPLTINKEEALQRPVAS
VKLQTVHSIPLTYNKIEPLQIPVAS

SEQ ID NO: 53386 - protein, 25 aa, synthetic construct
  source 1..25: note = Seed: VKLQTVHSIPLTINKEEALQRPVAS
VKLQTVHSIPLTYNKIEPLQLPVAS

SEQ ID NO: 53387 - protein, 25 aa, synthetic construct
  source 1..25: note = Seed: VKLQTVHSIPLTINKEEALQRPVAS
VKLQTVHSIPLTYNKIEPLQMPVAS

SEQ ID NO: 53388 - protein, 25 aa, synthetic construct
  source 1..25: note = Seed: VKLQTVHSIPLTINKEEALQRPVAS
VKLQTVHSIPLTYNKIEPLQSPVAS

SEQ ID NO: 53389 - protein, 25 aa, synthetic construct
  source 1..25: note = Seed: VKLQTVHSIPLTINKEEALQRPVAS
VKLQTVHSIPLTYNKIEPLQTPVAS

SEQ ID NO: 53390 - protein, 25 aa, synthetic construct
  source 1..25: note = Seed: VKLQTVHSIPLTINKEEALQRPVAS
VKLQTVHSIPLTYNKIEPLQVPVAS

SEQ ID NO: 53391 - protein, 25 aa, synthetic construct
  source 1..25: note = Seed: VKLQTVHSIPLTINKEEALQRPVAS
VKLQTVHSIPLTYNKIESLQAPVAS

SEQ ID NO: 53392 - protein, 25 aa, synthetic construct
  source 1..25: note = Seed: VKLQTVHSIPLTINKEEALQRPVAS
VKLQTVHSIPLTYNKIESLQIPVAS

SEQ ID NO: 53393 - protein, 25 aa, synthetic construct
  source 1..25: note = Seed: VKLQTVHSIPLTINKEEALQRPVAS
VKLQTVHSIPLTYNKIESLQLPVAS

SEQ ID NO: 53394 - protein, 25 aa, synthetic construct
  source 1..25: note = Seed: VKLQTVHSIPLTINKEEALQRPVAS
VKLQTVHSIPLTYNKIESLQMPVAS

SEQ ID NO: 53395 - protein, 25 aa, synthetic construct
  source 1..25: note = Seed: VKLQTVHSIPLTINKEEALQRPVAS
VKLQTVHSIPLTYNKIESLQNPVAS

SEQ ID NO: 53396 - protein, 25 aa, synthetic construct
  source 1..25: note = Seed: VKLQTVHSIPLTINKEEALQRPVAS
VKLQTVHSIPLTYNKIESLQSPVAS

SEQ ID NO: 53397 - protein, 25 aa, synthetic construct
  source 1..25: note = Seed: VKLQTVHSIPLTINKEEALQRPVAS
VKLQTVHSIPLTYNKIESLQTPVAS

SEQ ID NO: 53398 - protein, 25 aa, synthetic construct
  source 1..25: note = Seed: VKLQTVHSIPLTINKEEALQRPVAS
VKLQTVHSIPLTYNKIESLQVPVAS

SEQ ID NO: 53399 - protein, 25 aa, synthetic construct
  source 1..25: note = Seed: VKLQTVHSIPLTINKEEALQRPVAS
VKLQTVHSIPLTYNKIETLQAPVAS

SEQ ID NO: 53400 - protein, 25 aa, synthetic construct
  source 1..25: note = Seed: VKLQTVHSIPLTINKEEALQRPVAS
VKLQTVHSIPLTYNKIETLQIPVAS

SEQ ID NO: 53401 - protein, 25 aa, synthetic construct
  source 1..25: note = Seed: VKLQTVHSIPLTINKEEALQRPVAS
VKLQTVHSIPLTYNKIETLQLPVAS

SEQ ID NO: 53402 - protein, 25 aa, synthetic construct
  source 1..25: note = Seed: VKLQTVHSIPLTINKEEALQRPVAS
VKLQTVHSIPLTYNKIETLQSPVAS

SEQ ID NO: 53403 - protein, 25 aa, synthetic construct
  source 1..25: note = Seed: VKLQTVHSIPLTINKEEALQRPVAS
VKLQTVHSIPLTYNKIETLQVPVAS

SEQ ID NO: 53404 - protein, 25 aa, synthetic construct
  source 1..25: note = Seed: VKLQTVHSIPLTINKEEALQRPVAS
VKLQTVHSIPLTYNKIEVLQVPVAS

SEQ ID NO: 53405 - protein, 25 aa, synthetic construct
  source 1..25: note = Seed: VKLQTVHSIPLTINKEEALQRPVAS
VKLQTVHSIPLTYNKLEALQAPVAS

SEQ ID NO: 53406 - protein, 25 aa, synthetic construct
  source 1..25: note = Seed: VKLQTVHSIPLTINKEEALQRPVAS
VKLQTVHSIPLTYNKLEALQCPVAS

SEQ ID NO: 53407 - protein, 25 aa, synthetic construct
  source 1..25: note = Seed: VKLQTVHSIPLTINKEEALQRPVAS
VKLQTVHSIPLTYNKLEALQFPVAS

SEQ ID NO: 53408 - protein, 25 aa, synthetic construct
  source 1..25: note = Seed: VKLQTVHSIPLTINKEEALQRPVAS
VKLQTVHSIPLTYNKLEALQGPVAS

SEQ ID NO: 53409 - protein, 25 aa, synthetic construct
  source 1..25: note = Seed: VKLQTVHSIPLTINKEEALQRPVAS
VKLQTVHSIPLTYNKLEALQHPVAS

SEQ ID NO: 53410 - protein, 25 aa, synthetic construct
  source 1..25: note = Seed: VKLQTVHSIPLTINKEEALQRPVAS
VKLQTVHSIPLTYNKLEALQIPVAS

SEQ ID NO: 53411 - protein, 25 aa, synthetic construct
  source 1..25: note = Seed: VKLQTVHSIPLTINKEEALQRPVAS
VKLQTVHSIPLTYNKLEALQLPVAS

SEQ ID NO: 53412 - protein, 25 aa, synthetic construct
  source 1..25: note = Seed: VKLQTVHSIPLTINKEEALQRPVAS
VKLQTVHSIPLTYNKLEALQMPVAS

SEQ ID NO: 53413 - protein, 25 aa, synthetic construct
  source 1..25: note = Seed: VKLQTVHSIPLTINKEEALQRPVAS
VKLQTVHSIPLTYNKLEALQNPVAS

SEQ ID NO: 53414 - protein, 25 aa, synthetic construct
  source 1..25: note = Seed: VKLQTVHSIPLTINKEEALQRPVAS
VKLQTVHSIPLTYNKLEALQPPVAS

SEQ ID NO: 53415 - protein, 25 aa, synthetic construct
  source 1..25: note = Seed: VKLQTVHSIPLTINKEEALQRPVAS
VKLQTVHSIPLTYNKLEALQRPVAS

SEQ ID NO: 53416 - protein, 25 aa, synthetic construct
  source 1..25: note = Seed: VKLQTVHSIPLTINKEEALQRPVAS
VKLQTVHSIPLTYNKLEALQSPVAS

SEQ ID NO: 53417 - protein, 25 aa, synthetic construct
  source 1..25: note = Seed: VKLQTVHSIPLTINKEEALQRPVAS
VKLQTVHSIPLTYNKLEALQTPVAS

SEQ ID NO: 53418 - protein, 25 aa, synthetic construct
  source 1..25: note = Seed: VKLQTVHSIPLTINKEEALQRPVAS
VKLQTVHSIPLTYNKLEALQVPVAS

SEQ ID NO: 53419 - protein, 25 aa, synthetic construct
  source 1..25: note = Seed: VKLQTVHSIPLTINKEEALQRPVAS
VKLQTVHSIPLTYNKLEALQYPVAS

SEQ ID NO: 53420 - protein, 25 aa, synthetic construct
  source 1..25: note = Seed: VKLQTVHSIPLTINKEEALQRPVAS
VKLQTVHSIPLTYNKLEGLQAPVAS

SEQ ID NO: 53421 - protein, 25 aa, synthetic construct
  source 1..25: note = Seed: VKLQTVHSIPLTINKEEALQRPVAS
VKLQTVHSIPLTYNKLEGLQCPVAS

SEQ ID NO: 53422 - protein, 25 aa, synthetic construct
  source 1..25: note = Seed: VKLQTVHSIPLTINKEEALQRPVAS
VKLQTVHSIPLTYNKLEGLQFPVAS

SEQ ID NO: 53423 - protein, 25 aa, synthetic construct
  source 1..25: note = Seed: VKLQTVHSIPLTINKEEALQRPVAS
VKLQTVHSIPLTYNKLEGLQGPVAS

SEQ ID NO: 53424 - protein, 25 aa, synthetic construct
  source 1..25: note = Seed: VKLQTVHSIPLTINKEEALQRPVAS
VKLQTVHSIPLTYNKLEGLQIPVAS

SEQ ID NO: 53425 - protein, 25 aa, synthetic construct
  source 1..25: note = Seed: VKLQTVHSIPLTINKEEALQRPVAS
VKLQTVHSIPLTYNKLEGLQLPVAS

SEQ ID NO: 53426 - protein, 25 aa, synthetic construct
  source 1..25: note = Seed: VKLQTVHSIPLTINKEEALQRPVAS
VKLQTVHSIPLTYNKLEGLQMPVAS

SEQ ID NO: 53427 - protein, 25 aa, synthetic construct
  source 1..25: note = Seed: VKLQTVHSIPLTINKEEALQRPVAS
VKLQTVHSIPLTYNKLEGLQNPVAS

SEQ ID NO: 53428 - protein, 25 aa, synthetic construct
  source 1..25: note = Seed: VKLQTVHSIPLTINKEEALQRPVAS
VKLQTVHSIPLTYNKLEGLQSPVAS

SEQ ID NO: 53429 - protein, 25 aa, synthetic construct
  source 1..25: note = Seed: VKLQTVHSIPLTINKEEALQRPVAS
VKLQTVHSIPLTYNKLEGLQTPVAS

SEQ ID NO: 53430 - protein, 25 aa, synthetic construct
  source 1..25: note = Seed: VKLQTVHSIPLTINKEEALQRPVAS
VKLQTVHSIPLTYNKLEGLQVPVAS

SEQ ID NO: 53431 - protein, 25 aa, synthetic construct
  source 1..25: note = Seed: VKLQTVHSIPLTINKEEALQRPVAS
VKLQTVHSIPLTYNKLEILQVPVAS

SEQ ID NO: 53432 - protein, 25 aa, synthetic construct
  source 1..25: note = Seed: VKLQTVHSIPLTINKEEALQRPVAS
VKLQTVHSIPLTYNKLEMLQVPVAS

SEQ ID NO: 53433 - protein, 25 aa, synthetic construct
  source 1..25: note = Seed: VKLQTVHSIPLTINKEEALQRPVAS
VKLQTVHSIPLTYNKLENLQAPVAS

SEQ ID NO: 53434 - protein, 25 aa, synthetic construct
  source 1..25: note = Seed: VKLQTVHSIPLTINKEEALQRPVAS
VKLQTVHSIPLTYNKLENLQGPVAS

SEQ ID NO: 53435 - protein, 25 aa, synthetic construct
  source 1..25: note = Seed: VKLQTVHSIPLTINKEEALQRPVAS
VKLQTVHSIPLTYNKLENLQIPVAS

SEQ ID NO: 53436 - protein, 25 aa, synthetic construct
  source 1..25: note = Seed: VKLQTVHSIPLTINKEEALQRPVAS
VKLQTVHSIPLTYNKLENLQLPVAS

SEQ ID NO: 53437 - protein, 25 aa, synthetic construct
  source 1..25: note = Seed: VKLQTVHSIPLTINKEEALQRPVAS
VKLQTVHSIPLTYNKLENLQMPVAS

SEQ ID NO: 53438 - protein, 25 aa, synthetic construct
  source 1..25: note = Seed: VKLQTVHSIPLTINKEEALQRPVAS
VKLQTVHSIPLTYNKLENLQSPVAS

SEQ ID NO: 53439 - protein, 25 aa, synthetic construct
  source 1..25: note = Seed: VKLQTVHSIPLTINKEEALQRPVAS
VKLQTVHSIPLTYNKLENLQTPVAS

SEQ ID NO: 53440 - protein, 25 aa, synthetic construct
  source 1..25: note = Seed: VKLQTVHSIPLTINKEEALQRPVAS
VKLQTVHSIPLTYNKLENLQVPVAS

SEQ ID NO: 53441 - protein, 25 aa, synthetic construct
  source 1..25: note = Seed: VKLQTVHSIPLTINKEEALQRPVAS
VKLQTVHSIPLTYNKLEPLQAPVAS

SEQ ID NO: 53442 - protein, 25 aa, synthetic construct
  source 1..25: note = Seed: VKLQTVHSIPLTINKEEALQRPVAS
VKLQTVHSIPLTYNKLEPLQFPVAS

SEQ ID NO: 53443 - protein, 25 aa, synthetic construct
  source 1..25: note = Seed: VKLQTVHSIPLTINKEEALQRPVAS
VKLQTVHSIPLTYNKLEPLQGPVAS

SEQ ID NO: 53444 - protein, 25 aa, synthetic construct
  source 1..25: note = Seed: VKLQTVHSIPLTINKEEALQRPVAS
VKLQTVHSIPLTYNKLEPLQIPVAS

SEQ ID NO: 53445 - protein, 25 aa, synthetic construct
  source 1..25: note = Seed: VKLQTVHSIPLTINKEEALQRPVAS
VKLQTVHSIPLTYNKLEPLQLPVAS

SEQ ID NO: 53446 - protein, 25 aa, synthetic construct
  source 1..25: note = Seed: VKLQTVHSIPLTINKEEALQRPVAS
VKLQTVHSIPLTYNKLEPLQMPVAS

SEQ ID NO: 53447 - protein, 25 aa, synthetic construct
  source 1..25: note = Seed: VKLQTVHSIPLTINKEEALQRPVAS
VKLQTVHSIPLTYNKLEPLQNPVAS

SEQ ID NO: 53448 - protein, 25 aa, synthetic construct
  source 1..25: note = Seed: VKLQTVHSIPLTINKEEALQRPVAS
VKLQTVHSIPLTYNKLEPLQSPVAS

SEQ ID NO: 53449 - protein, 25 aa, synthetic construct
  source 1..25: note = Seed: VKLQTVHSIPLTINKEEALQRPVAS
VKLQTVHSIPLTYNKLEPLQTPVAS

SEQ ID NO: 53450 - protein, 25 aa, synthetic construct
  source 1..25: note = Seed: VKLQTVHSIPLTINKEEALQRPVAS
VKLQTVHSIPLTYNKLEPLQVPVAS

SEQ ID NO: 53451 - protein, 25 aa, synthetic construct
  source 1..25: note = Seed: VKLQTVHSIPLTINKEEALQRPVAS
VKLQTVHSIPLTYNKLESLQAPVAS

SEQ ID NO: 53452 - protein, 25 aa, synthetic construct
  source 1..25: note = Seed: VKLQTVHSIPLTINKEEALQRPVAS
VKLQTVHSIPLTYNKLESLQCPVAS

SEQ ID NO: 53453 - protein, 25 aa, synthetic construct
  source 1..25: note = Seed: VKLQTVHSIPLTINKEEALQRPVAS
VKLQTVHSIPLTYNKLESLQFPVAS

SEQ ID NO: 53454 - protein, 25 aa, synthetic construct
  source 1..25: note = Seed: VKLQTVHSIPLTINKEEALQRPVAS
VKLQTVHSIPLTYNKLESLQGPVAS

SEQ ID NO: 53455 - protein, 25 aa, synthetic construct
  source 1..25: note = Seed: VKLQTVHSIPLTINKEEALQRPVAS
VKLQTVHSIPLTYNKLESLQIPVAS

SEQ ID NO: 53456 - protein, 25 aa, synthetic construct
  source 1..25: note = Seed: VKLQTVHSIPLTINKEEALQRPVAS
VKLQTVHSIPLTYNKLESLQLPVAS

SEQ ID NO: 53457 - protein, 25 aa, synthetic construct
  source 1..25: note = Seed: VKLQTVHSIPLTINKEEALQRPVAS
VKLQTVHSIPLTYNKLESLQMPVAS

SEQ ID NO: 53458 - protein, 25 aa, synthetic construct
  source 1..25: note = Seed: VKLQTVHSIPLTINKEEALQRPVAS
VKLQTVHSIPLTYNKLESLQNPVAS

SEQ ID NO: 53459 - protein, 25 aa, synthetic construct
  source 1..25: note = Seed: VKLQTVHSIPLTINKEEALQRPVAS
VKLQTVHSIPLTYNKLESLQSPVAS

SEQ ID NO: 53460 - protein, 25 aa, synthetic construct
  source 1..25: note = Seed: VKLQTVHSIPLTINKEEALQRPVAS
VKLQTVHSIPLTYNKLESLQTPVAS

SEQ ID NO: 53461 - protein, 25 aa, synthetic construct
  source 1..25: note = Seed: VKLQTVHSIPLTINKEEALQRPVAS
VKLQTVHSIPLTYNKLESLQVPVAS

SEQ ID NO: 53462 - protein, 25 aa, synthetic construct
  source 1..25: note = Seed: VKLQTVHSIPLTINKEEALQRPVAS
VKLQTVHSIPLTYNKLETLQAPVAS

SEQ ID NO: 53463 - protein, 25 aa, synthetic construct
  source 1..25: note = Seed: VKLQTVHSIPLTINKEEALQRPVAS
VKLQTVHSIPLTYNKLETLQGPVAS

SEQ ID NO: 53464 - protein, 25 aa, synthetic construct
  source 1..25: note = Seed: VKLQTVHSIPLTINKEEALQRPVAS
VKLQTVHSIPLTYNKLETLQIPVAS

SEQ ID NO: 53465 - protein, 25 aa, synthetic construct
  source 1..25: note = Seed: VKLQTVHSIPLTINKEEALQRPVAS
VKLQTVHSIPLTYNKLETLQLPVAS

SEQ ID NO: 53466 - protein, 25 aa, synthetic construct
  source 1..25: note = Seed: VKLQTVHSIPLTINKEEALQRPVAS
VKLQTVHSIPLTYNKLETLQMPVAS

SEQ ID NO: 53467 - protein, 25 aa, synthetic construct
  source 1..25: note = Seed: VKLQTVHSIPLTINKEEALQRPVAS
VKLQTVHSIPLTYNKLETLQSPVAS

SEQ ID NO: 53468 - protein, 25 aa, synthetic construct
  source 1..25: note = Seed: VKLQTVHSIPLTINKEEALQRPVAS
VKLQTVHSIPLTYNKLETLQTPVAS

SEQ ID NO: 53469 - protein, 25 aa, synthetic construct
  source 1..25: note = Seed: VKLQTVHSIPLTINKEEALQRPVAS
VKLQTVHSIPLTYNKLETLQVPVAS

SEQ ID NO: 53470 - protein, 25 aa, synthetic construct
  source 1..25: note = Seed: VKLQTVHSIPLTINKEEALQRPVAS
VKLQTVHSIPLTYNKLEVLQAPVAS

SEQ ID NO: 53471 - protein, 25 aa, synthetic construct
  source 1..25: note = Seed: VKLQTVHSIPLTINKEEALQRPVAS
VKLQTVHSIPLTYNKLEVLQIPVAS

SEQ ID NO: 53472 - protein, 25 aa, synthetic construct
  source 1..25: note = Seed: VKLQTVHSIPLTINKEEALQRPVAS
VKLQTVHSIPLTYNKLEVLQLPVAS

SEQ ID NO: 53473 - protein, 25 aa, synthetic construct
  source 1..25: note = Seed: VKLQTVHSIPLTINKEEALQRPVAS
VKLQTVHSIPLTYNKLEVLQMPVAS

SEQ ID NO: 53474 - protein, 25 aa, synthetic construct
  source 1..25: note = Seed: VKLQTVHSIPLTINKEEALQRPVAS
VKLQTVHSIPLTYNKLEVLQNPVAS

SEQ ID NO: 53475 - protein, 25 aa, synthetic construct
  source 1..25: note = Seed: VKLQTVHSIPLTINKEEALQRPVAS
VKLQTVHSIPLTYNKLEVLQSPVAS

SEQ ID NO: 53476 - protein, 25 aa, synthetic construct
  source 1..25: note = Seed: VKLQTVHSIPLTINKEEALQRPVAS
VKLQTVHSIPLTYNKLEVLQTPVAS

SEQ ID NO: 53477 - protein, 25 aa, synthetic construct
  source 1..25: note = Seed: VKLQTVHSIPLTINKEEALQRPVAS
VKLQTVHSIPLTYNKLEVLQVPVAS

SEQ ID NO: 53478 - protein, 25 aa, synthetic construct
  source 1..25: note = Seed: VKLQTVHSIPLTINKEEALQRPVAS
VKLQTVHSIPLTYNKMEALQAPVAS

SEQ ID NO: 53479 - protein, 25 aa, synthetic construct
  source 1..25: note = Seed: VKLQTVHSIPLTINKEEALQRPVAS
VKLQTVHSIPLTYNKMEALQCPVAS

SEQ ID NO: 53480 - protein, 25 aa, synthetic construct
  source 1..25: note = Seed: VKLQTVHSIPLTINKEEALQRPVAS
VKLQTVHSIPLTYNKMEALQFPVAS

SEQ ID NO: 53481 - protein, 25 aa, synthetic construct
  source 1..25: note = Seed: VKLQTVHSIPLTINKEEALQRPVAS
VKLQTVHSIPLTYNKMEALQGPVAS

SEQ ID NO: 53482 - protein, 25 aa, synthetic construct
  source 1..25: note = Seed: VKLQTVHSIPLTINKEEALQRPVAS
VKLQTVHSIPLTYNKMEALQHPVAS

SEQ ID NO: 53483 - protein, 25 aa, synthetic construct
  source 1..25: note = Seed: VKLQTVHSIPLTINKEEALQRPVAS
VKLQTVHSIPLTYNKMEALQIPVAS

SEQ ID NO: 53484 - protein, 25 aa, synthetic construct
  source 1..25: note = Seed: VKLQTVHSIPLTINKEEALQRPVAS
VKLQTVHSIPLTYNKMEALQLPVAS

SEQ ID NO: 53485 - protein, 25 aa, synthetic construct
  source 1..25: note = Seed: VKLQTVHSIPLTINKEEALQRPVAS
VKLQTVHSIPLTYNKMEALQMPVAS

SEQ ID NO: 53486 - protein, 25 aa, synthetic construct
  source 1..25: note = Seed: VKLQTVHSIPLTINKEEALQRPVAS
VKLQTVHSIPLTYNKMEALQNPVAS

SEQ ID NO: 53487 - protein, 25 aa, synthetic construct
  source 1..25: note = Seed: VKLQTVHSIPLTINKEEALQRPVAS
VKLQTVHSIPLTYNKMEALQPPVAS

SEQ ID NO: 53488 - protein, 25 aa, synthetic construct
  source 1..25: note = Seed: VKLQTVHSIPLTINKEEALQRPVAS
VKLQTVHSIPLTYNKMEALQRPVAS

SEQ ID NO: 53489 - protein, 25 aa, synthetic construct
  source 1..25: note = Seed: VKLQTVHSIPLTINKEEALQRPVAS
VKLQTVHSIPLTYNKMEALQSPVAS

SEQ ID NO: 53490 - protein, 25 aa, synthetic construct
  source 1..25: note = Seed: VKLQTVHSIPLTINKEEALQRPVAS
VKLQTVHSIPLTYNKMEALQTPVAS

SEQ ID NO: 53491 - protein, 25 aa, synthetic construct
  source 1..25: note = Seed: VKLQTVHSIPLTINKEEALQRPVAS
VKLQTVHSIPLTYNKMEALQVPVAS

SEQ ID NO: 53492 - protein, 25 aa, synthetic construct
  source 1..25: note = Seed: VKLQTVHSIPLTINKEEALQRPVAS
VKLQTVHSIPLTYNKMEALQYPVAS

SEQ ID NO: 53493 - protein, 25 aa, synthetic construct
  source 1..25: note = Seed: VKLQTVHSIPLTINKEEALQRPVAS
VKLQTVHSIPLTYNKMEGLQAPVAS

SEQ ID NO: 53494 - protein, 25 aa, synthetic construct
  source 1..25: note = Seed: VKLQTVHSIPLTINKEEALQRPVAS
VKLQTVHSIPLTYNKMEGLQCPVAS

SEQ ID NO: 53495 - protein, 25 aa, synthetic construct
  source 1..25: note = Seed: VKLQTVHSIPLTINKEEALQRPVAS
VKLQTVHSIPLTYNKMEGLQFPVAS

SEQ ID NO: 53496 - protein, 25 aa, synthetic construct
  source 1..25: note = Seed: VKLQTVHSIPLTINKEEALQRPVAS
VKLQTVHSIPLTYNKMEGLQGPVAS

SEQ ID NO: 53497 - protein, 25 aa, synthetic construct
  source 1..25: note = Seed: VKLQTVHSIPLTINKEEALQRPVAS
VKLQTVHSIPLTYNKMEGLQIPVAS

SEQ ID NO: 53498 - protein, 25 aa, synthetic construct
  source 1..25: note = Seed: VKLQTVHSIPLTINKEEALQRPVAS
VKLQTVHSIPLTYNKMEGLQLPVAS

SEQ ID NO: 53499 - protein, 25 aa, synthetic construct
  source 1..25: note = Seed: VKLQTVHSIPLTINKEEALQRPVAS
VKLQTVHSIPLTYNKMEGLQMPVAS

SEQ ID NO: 53500 - protein, 25 aa, synthetic construct
  source 1..25: note = Seed: VKLQTVHSIPLTINKEEALQRPVAS
VKLQTVHSIPLTYNKMEGLQNPVAS

SEQ ID NO: 53501 - protein, 25 aa, synthetic construct
  source 1..25: note = Seed: VKLQTVHSIPLTINKEEALQRPVAS
VKLQTVHSIPLTYNKMEGLQSPVAS

SEQ ID NO: 53502 - protein, 25 aa, synthetic construct
  source 1..25: note = Seed: VKLQTVHSIPLTINKEEALQRPVAS
VKLQTVHSIPLTYNKMEGLQTPVAS

SEQ ID NO: 53503 - protein, 25 aa, synthetic construct
  source 1..25: note = Seed: VKLQTVHSIPLTINKEEALQRPVAS
VKLQTVHSIPLTYNKMEGLQVPVAS

SEQ ID NO: 53504 - protein, 25 aa, synthetic construct
  source 1..25: note = Seed: VKLQTVHSIPLTINKEEALQRPVAS
VKLQTVHSIPLTYNKMEHLQAPVAS

SEQ ID NO: 53505 - protein, 25 aa, synthetic construct
  source 1..25: note = Seed: VKLQTVHSIPLTINKEEALQRPVAS
VKLQTVHSIPLTYNKMEILQVPVAS

SEQ ID NO: 53506 - protein, 25 aa, synthetic construct
  source 1..25: note = Seed: VKLQTVHSIPLTINKEEALQRPVAS
VKLQTVHSIPLTYNKMENLQAPVAS

SEQ ID NO: 53507 - protein, 25 aa, synthetic construct
  source 1..25: note = Seed: VKLQTVHSIPLTINKEEALQRPVAS
VKLQTVHSIPLTYNKMENLQIPVAS

SEQ ID NO: 53508 - protein, 25 aa, synthetic construct
  source 1..25: note = Seed: VKLQTVHSIPLTINKEEALQRPVAS
VKLQTVHSIPLTYNKMENLQLPVAS

SEQ ID NO: 53509 - protein, 25 aa, synthetic construct
  source 1..25: note = Seed: VKLQTVHSIPLTINKEEALQRPVAS
VKLQTVHSIPLTYNKMENLQMPVAS

SEQ ID NO: 53510 - protein, 25 aa, synthetic construct
  source 1..25: note = Seed: VKLQTVHSIPLTINKEEALQRPVAS
VKLQTVHSIPLTYNKMENLQSPVAS

SEQ ID NO: 53511 - protein, 25 aa, synthetic construct
  source 1..25: note = Seed: VKLQTVHSIPLTINKEEALQRPVAS
VKLQTVHSIPLTYNKMENLQTPVAS

SEQ ID NO: 53512 - protein, 25 aa, synthetic construct
  source 1..25: note = Seed: VKLQTVHSIPLTINKEEALQRPVAS
VKLQTVHSIPLTYNKMENLQVPVAS

SEQ ID NO: 53513 - protein, 25 aa, synthetic construct
  source 1..25: note = Seed: VKLQTVHSIPLTINKEEALQRPVAS
VKLQTVHSIPLTYNKMEPLQAPVAS

SEQ ID NO: 53514 - protein, 25 aa, synthetic construct
  source 1..25: note = Seed: VKLQTVHSIPLTINKEEALQRPVAS
VKLQTVHSIPLTYNKMEPLQGPVAS

SEQ ID NO: 53515 - protein, 25 aa, synthetic construct
  source 1..25: note = Seed: VKLQTVHSIPLTINKEEALQRPVAS
VKLQTVHSIPLTYNKMEPLQIPVAS

SEQ ID NO: 53516 - protein, 25 aa, synthetic construct
  source 1..25: note = Seed: VKLQTVHSIPLTINKEEALQRPVAS
VKLQTVHSIPLTYNKMEPLQLPVAS

SEQ ID NO: 53517 - protein, 25 aa, synthetic construct
  source 1..25: note = Seed: VKLQTVHSIPLTINKEEALQRPVAS
VKLQTVHSIPLTYNKMEPLQMPVAS

SEQ ID NO: 53518 - protein, 25 aa, synthetic construct
  source 1..25: note = Seed: VKLQTVHSIPLTINKEEALQRPVAS
VKLQTVHSIPLTYNKMEPLQNPVAS

SEQ ID NO: 53519 - protein, 25 aa, synthetic construct
  source 1..25: note = Seed: VKLQTVHSIPLTINKEEALQRPVAS
VKLQTVHSIPLTYNKMEPLQSPVAS

SEQ ID NO: 53520 - protein, 25 aa, synthetic construct
  source 1..25: note = Seed: VKLQTVHSIPLTINKEEALQRPVAS
VKLQTVHSIPLTYNKMEPLQTPVAS

SEQ ID NO: 53521 - protein, 25 aa, synthetic construct
  source 1..25: note = Seed: VKLQTVHSIPLTINKEEALQRPVAS
VKLQTVHSIPLTYNKMEPLQVPVAS

SEQ ID NO: 53522 - protein, 25 aa, synthetic construct
  source 1..25: note = Seed: VKLQTVHSIPLTINKEEALQRPVAS
VKLQTVHSIPLTYNKMESLQAPVAS

SEQ ID NO: 53523 - protein, 25 aa, synthetic construct
  source 1..25: note = Seed: VKLQTVHSIPLTINKEEALQRPVAS
VKLQTVHSIPLTYNKMESLQCPVAS

SEQ ID NO: 53524 - protein, 25 aa, synthetic construct
  source 1..25: note = Seed: VKLQTVHSIPLTINKEEALQRPVAS
VKLQTVHSIPLTYNKMESLQFPVAS

SEQ ID NO: 53525 - protein, 25 aa, synthetic construct
  source 1..25: note = Seed: VKLQTVHSIPLTINKEEALQRPVAS
VKLQTVHSIPLTYNKMESLQGPVAS

SEQ ID NO: 53526 - protein, 25 aa, synthetic construct
  source 1..25: note = Seed: VKLQTVHSIPLTINKEEALQRPVAS
VKLQTVHSIPLTYNKMESLQIPVAS

SEQ ID NO: 53527 - protein, 25 aa, synthetic construct
  source 1..25: note = Seed: VKLQTVHSIPLTINKEEALQRPVAS
VKLQTVHSIPLTYNKMESLQLPVAS

SEQ ID NO: 53528 - protein, 25 aa, synthetic construct
  source 1..25: note = Seed: VKLQTVHSIPLTINKEEALQRPVAS
VKLQTVHSIPLTYNKMESLQMPVAS

SEQ ID NO: 53529 - protein, 25 aa, synthetic construct
  source 1..25: note = Seed: VKLQTVHSIPLTINKEEALQRPVAS
VKLQTVHSIPLTYNKMESLQNPVAS

SEQ ID NO: 53530 - protein, 25 aa, synthetic construct
  source 1..25: note = Seed: VKLQTVHSIPLTINKEEALQRPVAS
VKLQTVHSIPLTYNKMESLQSPVAS

SEQ ID NO: 53531 - protein, 25 aa, synthetic construct
  source 1..25: note = Seed: VKLQTVHSIPLTINKEEALQRPVAS
VKLQTVHSIPLTYNKMESLQTPVAS

SEQ ID NO: 53532 - protein, 25 aa, synthetic construct
  source 1..25: note = Seed: VKLQTVHSIPLTINKEEALQRPVAS
VKLQTVHSIPLTYNKMESLQVPVAS

SEQ ID NO: 53533 - protein, 25 aa, synthetic construct
  source 1..25: note = Seed: VKLQTVHSIPLTINKEEALQRPVAS
VKLQTVHSIPLTYNKMETLQAPVAS

SEQ ID NO: 53534 - protein, 25 aa, synthetic construct
  source 1..25: note = Seed: VKLQTVHSIPLTINKEEALQRPVAS
VKLQTVHSIPLTYNKMETLQGPVAS

SEQ ID NO: 53535 - protein, 25 aa, synthetic construct
  source 1..25: note = Seed: VKLQTVHSIPLTINKEEALQRPVAS
VKLQTVHSIPLTYNKMETLQIPVAS

SEQ ID NO: 53536 - protein, 25 aa, synthetic construct
  source 1..25: note = Seed: VKLQTVHSIPLTINKEEALQRPVAS
VKLQTVHSIPLTYNKMETLQLPVAS

SEQ ID NO: 53537 - protein, 25 aa, synthetic construct
  source 1..25: note = Seed: VKLQTVHSIPLTINKEEALQRPVAS
VKLQTVHSIPLTYNKMETLQMPVAS

SEQ ID NO: 53538 - protein, 25 aa, synthetic construct
  source 1..25: note = Seed: VKLQTVHSIPLTINKEEALQRPVAS
VKLQTVHSIPLTYNKMETLQSPVAS

SEQ ID NO: 53539 - protein, 25 aa, synthetic construct
  source 1..25: note = Seed: VKLQTVHSIPLTINKEEALQRPVAS
VKLQTVHSIPLTYNKMETLQTPVAS

SEQ ID NO: 53540 - protein, 25 aa, synthetic construct
  source 1..25: note = Seed: VKLQTVHSIPLTINKEEALQRPVAS
VKLQTVHSIPLTYNKMETLQVPVAS

SEQ ID NO: 53541 - protein, 25 aa, synthetic construct
  source 1..25: note = Seed: VKLQTVHSIPLTINKEEALQRPVAS
VKLQTVHSIPLTYNKMEVLQAPVAS

SEQ ID NO: 53542 - protein, 25 aa, synthetic construct
  source 1..25: note = Seed: VKLQTVHSIPLTINKEEALQRPVAS
VKLQTVHSIPLTYNKMEVLQGPVAS

SEQ ID NO: 53543 - protein, 25 aa, synthetic construct
  source 1..25: note = Seed: VKLQTVHSIPLTINKEEALQRPVAS
VKLQTVHSIPLTYNKMEVLQIPVAS

SEQ ID NO: 53544 - protein, 25 aa, synthetic construct
  source 1..25: note = Seed: VKLQTVHSIPLTINKEEALQRPVAS
VKLQTVHSIPLTYNKMEVLQLPVAS

SEQ ID NO: 53545 - protein, 25 aa, synthetic construct
  source 1..25: note = Seed: VKLQTVHSIPLTINKEEALQRPVAS
VKLQTVHSIPLTYNKMEVLQMPVAS

SEQ ID NO: 53546 - protein, 25 aa, synthetic construct
  source 1..25: note = Seed: VKLQTVHSIPLTINKEEALQRPVAS
VKLQTVHSIPLTYNKMEVLQSPVAS

SEQ ID NO: 53547 - protein, 25 aa, synthetic construct
  source 1..25: note = Seed: VKLQTVHSIPLTINKEEALQRPVAS
VKLQTVHSIPLTYNKMEVLQTPVAS

SEQ ID NO: 53548 - protein, 25 aa, synthetic construct
  source 1..25: note = Seed: VKLQTVHSIPLTINKEEALQRPVAS
VKLQTVHSIPLTYNKMEVLQVPVAS

SEQ ID NO: 53549 - protein, 25 aa, synthetic construct
  source 1..25: note = Seed: VKLQTVHSIPLTINKEEALQRPVAS
VKLQTVHSIPLTYNKNEALQIPVAS

SEQ ID NO: 53550 - protein, 25 aa, synthetic construct
  source 1..25: note = Seed: VKLQTVHSIPLTINKEEALQRPVAS
VKLQTVHSIPLTYNKNEALQLPVAS

SEQ ID NO: 53551 - protein, 25 aa, synthetic construct
  source 1..25: note = Seed: VKLQTVHSIPLTINKEEALQRPVAS
VKLQTVHSIPLTYNKNEALQVPVAS

SEQ ID NO: 53552 - protein, 25 aa, synthetic construct
  source 1..25: note = Seed: VKLQTVHSIPLTINKEEALQRPVAS
VKLQTVHSIPLTYNKQEALQAPVAS

SEQ ID NO: 53553 - protein, 25 aa, synthetic construct
  source 1..25: note = Seed: VKLQTVHSIPLTINKEEALQRPVAS
VKLQTVHSIPLTYNKQEALQIPVAS

SEQ ID NO: 53554 - protein, 25 aa, synthetic construct
  source 1..25: note = Seed: VKLQTVHSIPLTINKEEALQRPVAS
VKLQTVHSIPLTYNKQEALQLPVAS

SEQ ID NO: 53555 - protein, 25 aa, synthetic construct
  source 1..25: note = Seed: VKLQTVHSIPLTINKEEALQRPVAS
VKLQTVHSIPLTYNKQEALQMPVAS

SEQ ID NO: 53556 - protein, 25 aa, synthetic construct
  source 1..25: note = Seed: VKLQTVHSIPLTINKEEALQRPVAS
VKLQTVHSIPLTYNKQEALQSPVAS

SEQ ID NO: 53557 - protein, 25 aa, synthetic construct
  source 1..25: note = Seed: VKLQTVHSIPLTINKEEALQRPVAS
VKLQTVHSIPLTYNKQEALQTPVAS

SEQ ID NO: 53558 - protein, 25 aa, synthetic construct
  source 1..25: note = Seed: VKLQTVHSIPLTINKEEALQRPVAS
VKLQTVHSIPLTYNKQEALQVPVAS

SEQ ID NO: 53559 - protein, 25 aa, synthetic construct
  source 1..25: note = Seed: VKLQTVHSIPLTINKEEALQRPVAS
VKLQTVHSIPLTYNKQEGLQAPVAS

SEQ ID NO: 53560 - protein, 25 aa, synthetic construct
  source 1..25: note = Seed: VKLQTVHSIPLTINKEEALQRPVAS
VKLQTVHSIPLTYNKQEGLQIPVAS

SEQ ID NO: 53561 - protein, 25 aa, synthetic construct
  source 1..25: note = Seed: VKLQTVHSIPLTINKEEALQRPVAS
VKLQTVHSIPLTYNKQEGLQLPVAS

SEQ ID NO: 53562 - protein, 25 aa, synthetic construct
  source 1..25: note = Seed: VKLQTVHSIPLTINKEEALQRPVAS
VKLQTVHSIPLTYNKQEGLQVPVAS

SEQ ID NO: 53563 - protein, 25 aa, synthetic construct
  source 1..25: note = Seed: VKLQTVHSIPLTINKEEALQRPVAS
VKLQTVHSIPLTYNKQEPLQIPVAS

SEQ ID NO: 53564 - protein, 25 aa, synthetic construct
  source 1..25: note = Seed: VKLQTVHSIPLTINKEEALQRPVAS
VKLQTVHSIPLTYNKQEPLQLPVAS

SEQ ID NO: 53565 - protein, 25 aa, synthetic construct
  source 1..25: note = Seed: VKLQTVHSIPLTINKEEALQRPVAS
VKLQTVHSIPLTYNKQEPLQVPVAS

SEQ ID NO: 53566 - protein, 25 aa, synthetic construct
  source 1..25: note = Seed: VKLQTVHSIPLTINKEEALQRPVAS
VKLQTVHSIPLTYNKQESLQAPVAS

SEQ ID NO: 53567 - protein, 25 aa, synthetic construct
  source 1..25: note = Seed: VKLQTVHSIPLTINKEEALQRPVAS
VKLQTVHSIPLTYNKQESLQIPVAS

SEQ ID NO: 53568 - protein, 25 aa, synthetic construct
  source 1..25: note = Seed: VKLQTVHSIPLTINKEEALQRPVAS
VKLQTVHSIPLTYNKQESLQLPVAS

SEQ ID NO: 53569 - protein, 25 aa, synthetic construct
  source 1..25: note = Seed: VKLQTVHSIPLTINKEEALQRPVAS
VKLQTVHSIPLTYNKQESLQVPVAS

SEQ ID NO: 53570 - protein, 25 aa, synthetic construct
  source 1..25: note = Seed: VKLQTVHSIPLTINKEEALQRPVAS
VKLQTVHSIPLTYNKSEALQAPVAS

SEQ ID NO: 53571 - protein, 25 aa, synthetic construct
  source 1..25: note = Seed: VKLQTVHSIPLTINKEEALQRPVAS
VKLQTVHSIPLTYNKSEALQIPVAS

SEQ ID NO: 53572 - protein, 25 aa, synthetic construct
  source 1..25: note = Seed: VKLQTVHSIPLTINKEEALQRPVAS
VKLQTVHSIPLTYNKSEALQLPVAS

SEQ ID NO: 53573 - protein, 25 aa, synthetic construct
  source 1..25: note = Seed: VKLQTVHSIPLTINKEEALQRPVAS
VKLQTVHSIPLTYNKSEALQMPVAS

SEQ ID NO: 53574 - protein, 25 aa, synthetic construct
  source 1..25: note = Seed: VKLQTVHSIPLTINKEEALQRPVAS
VKLQTVHSIPLTYNKSEALQVPVAS

SEQ ID NO: 53575 - protein, 25 aa, synthetic construct
  source 1..25: note = Seed: VKLQTVHSIPLTINKEEALQRPVAS
VKLQTVHSIPLTYNKSEGLQIPVAS

SEQ ID NO: 53576 - protein, 25 aa, synthetic construct
  source 1..25: note = Seed: VKLQTVHSIPLTINKEEALQRPVAS
VKLQTVHSIPLTYNKSEGLQLPVAS

SEQ ID NO: 53577 - protein, 25 aa, synthetic construct
  source 1..25: note = Seed: VKLQTVHSIPLTINKEEALQRPVAS
VKLQTVHSIPLTYNKSEGLQVPVAS

SEQ ID NO: 53578 - protein, 25 aa, synthetic construct
  source 1..25: note = Seed: VKLQTVHSIPLTINKEEALQRPVAS
VKLQTVHSIPLTYNKSEPLQIPVAS

SEQ ID NO: 53579 - protein, 25 aa, synthetic construct
  source 1..25: note = Seed: VKLQTVHSIPLTINKEEALQRPVAS
VKLQTVHSIPLTYNKSEPLQLPVAS

SEQ ID NO: 53580 - protein, 25 aa, synthetic construct
  source 1..25: note = Seed: VKLQTVHSIPLTINKEEALQRPVAS
VKLQTVHSIPLTYNKSEPLQVPVAS

SEQ ID NO: 53581 - protein, 25 aa, synthetic construct
  source 1..25: note = Seed: VKLQTVHSIPLTINKEEALQRPVAS
VKLQTVHSIPLTYNKSESLQIPVAS

SEQ ID NO: 53582 - protein, 25 aa, synthetic construct
  source 1..25: note = Seed: VKLQTVHSIPLTINKEEALQRPVAS
VKLQTVHSIPLTYNKSESLQLPVAS

SEQ ID NO: 53583 - protein, 25 aa, synthetic construct
  source 1..25: note = Seed: VKLQTVHSIPLTINKEEALQRPVAS
VKLQTVHSIPLTYNKSESLQVPVAS

SEQ ID NO: 53584 - protein, 25 aa, synthetic construct
  source 1..25: note = Seed: VKLQTVHSIPLTINKEEALQRPVAS
VKLQTVHSIPLTYNKTEALQIPVAS

SEQ ID NO: 53585 - protein, 25 aa, synthetic construct
  source 1..25: note = Seed: VKLQTVHSIPLTINKEEALQRPVAS
VKLQTVHSIPLTYNKTEALQLPVAS

SEQ ID NO: 53586 - protein, 25 aa, synthetic construct
  source 1..25: note = Seed: VKLQTVHSIPLTINKEEALQRPVAS
VKLQTVHSIPLTYNKTEALQVPVAS

SEQ ID NO: 53587 - protein, 25 aa, synthetic construct
  source 1..25: note = Seed: VKLQTVHSIPLTINKEEALQRPVAS
VKLQTVHSIPLTYNKVEALQAPVAS

SEQ ID NO: 53588 - protein, 25 aa, synthetic construct
  source 1..25: note = Seed: VKLQTVHSIPLTINKEEALQRPVAS
VKLQTVHSIPLTYNKVEALQGPVAS

SEQ ID NO: 53589 - protein, 25 aa, synthetic construct
  source 1..25: note = Seed: VKLQTVHSIPLTINKEEALQRPVAS
VKLQTVHSIPLTYNKVEALQIPVAS

SEQ ID NO: 53590 - protein, 25 aa, synthetic construct
  source 1..25: note = Seed: VKLQTVHSIPLTINKEEALQRPVAS
VKLQTVHSIPLTYNKVEALQLPVAS

SEQ ID NO: 53591 - protein, 25 aa, synthetic construct
  source 1..25: note = Seed: VKLQTVHSIPLTINKEEALQRPVAS
VKLQTVHSIPLTYNKVEALQMPVAS

SEQ ID NO: 53592 - protein, 25 aa, synthetic construct
  source 1..25: note = Seed: VKLQTVHSIPLTINKEEALQRPVAS
VKLQTVHSIPLTYNKVEALQSPVAS

SEQ ID NO: 53593 - protein, 25 aa, synthetic construct
  source 1..25: note = Seed: VKLQTVHSIPLTINKEEALQRPVAS
VKLQTVHSIPLTYNKVEALQTPVAS

SEQ ID NO: 53594 - protein, 25 aa, synthetic construct
  source 1..25: note = Seed: VKLQTVHSIPLTINKEEALQRPVAS
VKLQTVHSIPLTYNKVEALQVPVAS

SEQ ID NO: 53595 - protein, 25 aa, synthetic construct
  source 1..25: note = Seed: VKLQTVHSIPLTINKEEALQRPVAS
VKLQTVHSIPLTYNKVEGLQAPVAS

SEQ ID NO: 53596 - protein, 25 aa, synthetic construct
  source 1..25: note = Seed: VKLQTVHSIPLTINKEEALQRPVAS
VKLQTVHSIPLTYNKVEGLQIPVAS

SEQ ID NO: 53597 - protein, 25 aa, synthetic construct
  source 1..25: note = Seed: VKLQTVHSIPLTINKEEALQRPVAS
VKLQTVHSIPLTYNKVEGLQLPVAS

SEQ ID NO: 53598 - protein, 25 aa, synthetic construct
  source 1..25: note = Seed: VKLQTVHSIPLTINKEEALQRPVAS
VKLQTVHSIPLTYNKVEGLQMPVAS

SEQ ID NO: 53599 - protein, 25 aa, synthetic construct
  source 1..25: note = Seed: VKLQTVHSIPLTINKEEALQRPVAS
VKLQTVHSIPLTYNKVEGLQTPVAS

SEQ ID NO: 53600 - protein, 25 aa, synthetic construct
  source 1..25: note = Seed: VKLQTVHSIPLTINKEEALQRPVAS
VKLQTVHSIPLTYNKVEGLQVPVAS

SEQ ID NO: 53601 - protein, 25 aa, synthetic construct
  source 1..25: note = Seed: VKLQTVHSIPLTINKEEALQRPVAS
VKLQTVHSIPLTYNKVEPLQAPVAS

SEQ ID NO: 53602 - protein, 25 aa, synthetic construct
  source 1..25: note = Seed: VKLQTVHSIPLTINKEEALQRPVAS
VKLQTVHSIPLTYNKVEPLQIPVAS

SEQ ID NO: 53603 - protein, 25 aa, synthetic construct
  source 1..25: note = Seed: VKLQTVHSIPLTINKEEALQRPVAS
VKLQTVHSIPLTYNKVEPLQLPVAS

SEQ ID NO: 53604 - protein, 25 aa, synthetic construct
  source 1..25: note = Seed: VKLQTVHSIPLTINKEEALQRPVAS
VKLQTVHSIPLTYNKVEPLQVPVAS

SEQ ID NO: 53605 - protein, 25 aa, synthetic construct
  source 1..25: note = Seed: VKLQTVHSIPLTINKEEALQRPVAS
VKLQTVHSIPLTYNKVESLQAPVAS

SEQ ID NO: 53606 - protein, 25 aa, synthetic construct
  source 1..25: note = Seed: VKLQTVHSIPLTINKEEALQRPVAS
VKLQTVHSIPLTYNKVESLQIPVAS

SEQ ID NO: 53607 - protein, 25 aa, synthetic construct
  source 1..25: note = Seed: VKLQTVHSIPLTINKEEALQRPVAS
VKLQTVHSIPLTYNKVESLQLPVAS

SEQ ID NO: 53608 - protein, 25 aa, synthetic construct
  source 1..25: note = Seed: VKLQTVHSIPLTINKEEALQRPVAS
VKLQTVHSIPLTYNKVESLQVPVAS

SEQ ID NO: 53609 - protein, 25 aa, synthetic construct
  source 1..25: note = Seed: VKLQTVHSIPLTINKEEALQRPVAS
VKLQTVHSIPLTYNKVETLQAPVAS

SEQ ID NO: 53610 - protein, 25 aa, synthetic construct
  source 1..25: note = Seed: VKLQTVHSIPLTINKEEALQRPVAS
VKLQTVHSIPLTYNKWEALQVPVAS

SEQ ID NO: 53611 - protein, 25 aa, synthetic construct
  source 1..25: note = Seed: VKLQTVHSIPLTINKEEALQRPVAS
VKLQTVHSIPATIFKAEAIQRPVAS

SEQ ID NO: 53612 - protein, 25 aa, synthetic construct
  source 1..25: note = Seed: VKLQTVHSIPLTINKEEALQRPVAS
VKLQTVHSIPATIFKAEALQRPVAS

SEQ ID NO: 53613 - protein, 25 aa, synthetic construct
  source 1..25: note = Seed: VKLQTVHSIPLTINKEEALQRPVAS
VKLQTVHSIPATIFKDEAIQRPVAS

SEQ ID NO: 53614 - protein, 25 aa, synthetic construct
  source 1..25: note = Seed: VKLQTVHSIPLTINKEEALQRPVAS
VKLQTVHSIPATIFKDEALQRPVAS

SEQ ID NO: 53615 - protein, 25 aa, synthetic construct
  source 1..25: note = Seed: VKLQTVHSIPLTINKEEALQRPVAS
VKLQTVHSIPATIFKFEAIQRPVAS

SEQ ID NO: 53616 - protein, 25 aa, synthetic construct
  source 1..25: note = Seed: VKLQTVHSIPLTINKEEALQRPVAS
VKLQTVHSIPATIFKFEALQRPVAS

SEQ ID NO: 53617 - protein, 25 aa, synthetic construct
  source 1..25: note = Seed: VKLQTVHSIPLTINKEEALQRPVAS
VKLQTVHSIPATIFKFEAMQRPVAS

SEQ ID NO: 53618 - protein, 25 aa, synthetic construct
  source 1..25: note = Seed: VKLQTVHSIPLTINKEEALQRPVAS
VKLQTVHSIPATIFKFEAVQRPVAS

SEQ ID NO: 53619 - protein, 25 aa, synthetic construct
  source 1..25: note = Seed: VKLQTVHSIPLTINKEEALQRPVAS
VKLQTVHSIPATIFKFEAYQRPVAS

SEQ ID NO: 53620 - protein, 25 aa, synthetic construct
  source 1..25: note = Seed: VKLQTVHSIPLTINKEEALQRPVAS
VKLQTVHSIPATIFKIEAAQRPVAS

SEQ ID NO: 53621 - protein, 25 aa, synthetic construct
  source 1..25: note = Seed: VKLQTVHSIPLTINKEEALQRPVAS
VKLQTVHSIPATIFKIEAFQRPVAS

SEQ ID NO: 53622 - protein, 25 aa, synthetic construct
  source 1..25: note = Seed: VKLQTVHSIPLTINKEEALQRPVAS
VKLQTVHSIPATIFKIEAIQRPVAS

SEQ ID NO: 53623 - protein, 25 aa, synthetic construct
  source 1..25: note = Seed: VKLQTVHSIPLTINKEEALQRPVAS
VKLQTVHSIPATIFKIEALQRPVAS

SEQ ID NO: 53624 - protein, 25 aa, synthetic construct
  source 1..25: note = Seed: VKLQTVHSIPLTINKEEALQRPVAS
VKLQTVHSIPATIFKIEAMQRPVAS

SEQ ID NO: 53625 - protein, 25 aa, synthetic construct
  source 1..25: note = Seed: VKLQTVHSIPLTINKEEALQRPVAS
VKLQTVHSIPATIFKIEASQRPVAS

SEQ ID NO: 53626 - protein, 25 aa, synthetic construct
  source 1..25: note = Seed: VKLQTVHSIPLTINKEEALQRPVAS
VKLQTVHSIPATIFKIEAVQRPVAS

SEQ ID NO: 53627 - protein, 25 aa, synthetic construct
  source 1..25: note = Seed: VKLQTVHSIPLTINKEEALQRPVAS
VKLQTVHSIPATIFKIEAYQRPVAS

SEQ ID NO: 53628 - protein, 25 aa, synthetic construct
  source 1..25: note = Seed: VKLQTVHSIPLTINKEEALQRPVAS
VKLQTVHSIPATIFKLEAAQRPVAS

SEQ ID NO: 53629 - protein, 25 aa, synthetic construct
  source 1..25: note = Seed: VKLQTVHSIPLTINKEEALQRPVAS
VKLQTVHSIPATIFKLEAIQRPVAS

SEQ ID NO: 53630 - protein, 25 aa, synthetic construct
  source 1..25: note = Seed: VKLQTVHSIPLTINKEEALQRPVAS
VKLQTVHSIPATIFKLEALQRPVAS

SEQ ID NO: 53631 - protein, 25 aa, synthetic construct
  source 1..25: note = Seed: VKLQTVHSIPLTINKEEALQRPVAS
VKLQTVHSIPATIFKLEAMQRPVAS

SEQ ID NO: 53632 - protein, 25 aa, synthetic construct
  source 1..25: note = Seed: VKLQTVHSIPLTINKEEALQRPVAS
VKLQTVHSIPATIFKLEAVQRPVAS

SEQ ID NO: 53633 - protein, 25 aa, synthetic construct
  source 1..25: note = Seed: VKLQTVHSIPLTINKEEALQRPVAS
VKLQTVHSIPATIFKMEAAQRPVAS

SEQ ID NO: 53634 - protein, 25 aa, synthetic construct
  source 1..25: note = Seed: VKLQTVHSIPLTINKEEALQRPVAS
VKLQTVHSIPATIFKVEAAQRPVAS

SEQ ID NO: 53635 - protein, 25 aa, synthetic construct
  source 1..25: note = Seed: VKLQTVHSIPLTINKEEALQRPVAS
VKLQTVHSIPATIFKVEAFQRPVAS

SEQ ID NO: 53636 - protein, 25 aa, synthetic construct
  source 1..25: note = Seed: VKLQTVHSIPLTINKEEALQRPVAS
VKLQTVHSIPATIFKVEAIQRPVAS

SEQ ID NO: 53637 - protein, 25 aa, synthetic construct
  source 1..25: note = Seed: VKLQTVHSIPLTINKEEALQRPVAS
VKLQTVHSIPATIFKVEALQRPVAS

SEQ ID NO: 53638 - protein, 25 aa, synthetic construct
  source 1..25: note = Seed: VKLQTVHSIPLTINKEEALQRPVAS
VKLQTVHSIPATIFKVEAMQRPVAS

SEQ ID NO: 53639 - protein, 25 aa, synthetic construct
  source 1..25: note = Seed: VKLQTVHSIPLTINKEEALQRPVAS
VKLQTVHSIPATIFKVEAVQRPVAS

SEQ ID NO: 53640 - protein, 25 aa, synthetic construct
  source 1..25: note = Seed: VKLQTVHSIPLTINKEEALQRPVAS
VKLQTVHSIPATIFKYEALQRPVAS

SEQ ID NO: 53641 - protein, 25 aa, synthetic construct
  source 1..25: note = Seed: VKLQTVHSIPLTINKEEALQRPVAS
VKLQTVHSIPATIIKFEAIQRPVAS

SEQ ID NO: 53642 - protein, 25 aa, synthetic construct
  source 1..25: note = Seed: VKLQTVHSIPLTINKEEALQRPVAS
VKLQTVHSIPATIIKFEALQRPVAS

SEQ ID NO: 53643 - protein, 25 aa, synthetic construct
  source 1..25: note = Seed: VKLQTVHSIPLTINKEEALQRPVAS
VKLQTVHSIPATIIKFEAVQRPVAS

SEQ ID NO: 53644 - protein, 25 aa, synthetic construct
  source 1..25: note = Seed: VKLQTVHSIPLTINKEEALQRPVAS
VKLQTVHSIPATILKFEAIQRPVAS

SEQ ID NO: 53645 - protein, 25 aa, synthetic construct
  source 1..25: note = Seed: VKLQTVHSIPLTINKEEALQRPVAS
VKLQTVHSIPATILKFEALQRPVAS

SEQ ID NO: 53646 - protein, 25 aa, synthetic construct
  source 1..25: note = Seed: VKLQTVHSIPLTINKEEALQRPVAS
VKLQTVHSIPATIMKIEAIQRPVAS

SEQ ID NO: 53647 - protein, 25 aa, synthetic construct
  source 1..25: note = Seed: VKLQTVHSIPLTINKEEALQRPVAS
VKLQTVHSIPATIMKIEAVQRPVAS

SEQ ID NO: 53648 - protein, 25 aa, synthetic construct
  source 1..25: note = Seed: VKLQTVHSIPLTINKEEALQRPVAS
VKLQTVHSIPATIVKFEALQRPVAS

SEQ ID NO: 53649 - protein, 25 aa, synthetic construct
  source 1..25: note = Seed: VKLQTVHSIPLTINKEEALQRPVAS
VKLQTVHSIPATIWKFEAFQRPVAS

SEQ ID NO: 53650 - protein, 25 aa, synthetic construct
  source 1..25: note = Seed: VKLQTVHSIPLTINKEEALQRPVAS
VKLQTVHSIPATIYKFEALQRPVAS

SEQ ID NO: 53651 - protein, 25 aa, synthetic construct
  source 1..25: note = Seed: VKLQTVHSIPLTINKEEALQRPVAS
VKLQTVHSIPATIYKIEAAQRPVAS

SEQ ID NO: 53652 - protein, 25 aa, synthetic construct
  source 1..25: note = Seed: VKLQTVHSIPLTINKEEALQRPVAS
VKLQTVHSIPATIYKIEAFQRPVAS

SEQ ID NO: 53653 - protein, 25 aa, synthetic construct
  source 1..25: note = Seed: VKLQTVHSIPLTINKEEALQRPVAS
VKLQTVHSIPATIYKIEAIQRPVAS

SEQ ID NO: 53654 - protein, 25 aa, synthetic construct
  source 1..25: note = Seed: VKLQTVHSIPLTINKEEALQRPVAS
VKLQTVHSIPATIYKIEALQRPVAS

SEQ ID NO: 53655 - protein, 25 aa, synthetic construct
  source 1..25: note = Seed: VKLQTVHSIPLTINKEEALQRPVAS
VKLQTVHSIPATIYKIEAVQRPVAS

SEQ ID NO: 53656 - protein, 25 aa, synthetic construct
  source 1..25: note = Seed: VKLQTVHSIPLTINKEEALQRPVAS
VKLQTVHSIPCTIAKFEAIQRPVAS

SEQ ID NO: 53657 - protein, 25 aa, synthetic construct
  source 1..25: note = Seed: VKLQTVHSIPLTINKEEALQRPVAS
VKLQTVHSIPCTIAKFEALQRPVAS

SEQ ID NO: 53658 - protein, 25 aa, synthetic construct
  source 1..25: note = Seed: VKLQTVHSIPLTINKEEALQRPVAS
VKLQTVHSIPCTIAKFEAVQRPVAS

SEQ ID NO: 53659 - protein, 25 aa, synthetic construct
  source 1..25: note = Seed: VKLQTVHSIPLTINKEEALQRPVAS
VKLQTVHSIPCTIFKFEAIQRPVAS

SEQ ID NO: 53660 - protein, 25 aa, synthetic construct
  source 1..25: note = Seed: VKLQTVHSIPLTINKEEALQRPVAS
VKLQTVHSIPCTIFKFEALQRPVAS

SEQ ID NO: 53661 - protein, 25 aa, synthetic construct
  source 1..25: note = Seed: VKLQTVHSIPLTINKEEALQRPVAS
VKLQTVHSIPCTIFKFEAMQRPVAS

SEQ ID NO: 53662 - protein, 25 aa, synthetic construct
  source 1..25: note = Seed: VKLQTVHSIPLTINKEEALQRPVAS
VKLQTVHSIPCTIFKFEAVQRPVAS

SEQ ID NO: 53663 - protein, 25 aa, synthetic construct
  source 1..25: note = Seed: VKLQTVHSIPLTINKEEALQRPVAS
VKLQTVHSIPCTIFKFEAYQRPVAS

SEQ ID NO: 53664 - protein, 25 aa, synthetic construct
  source 1..25: note = Seed: VKLQTVHSIPLTINKEEALQRPVAS
VKLQTVHSIPCTIFKLEAIQRPVAS

SEQ ID NO: 53665 - protein, 25 aa, synthetic construct
  source 1..25: note = Seed: VKLQTVHSIPLTINKEEALQRPVAS
VKLQTVHSIPCTIFKLEALQRPVAS

SEQ ID NO: 53666 - protein, 25 aa, synthetic construct
  source 1..25: note = Seed: VKLQTVHSIPLTINKEEALQRPVAS
VKLQTVHSIPCTIFKYEAVQRPVAS

SEQ ID NO: 53667 - protein, 25 aa, synthetic construct
  source 1..25: note = Seed: VKLQTVHSIPLTINKEEALQRPVAS
VKLQTVHSIPCTIHKFEAIQRPVAS

SEQ ID NO: 53668 - protein, 25 aa, synthetic construct
  source 1..25: note = Seed: VKLQTVHSIPLTINKEEALQRPVAS
VKLQTVHSIPCTIHKFEALQRPVAS

SEQ ID NO: 53669 - protein, 25 aa, synthetic construct
  source 1..25: note = Seed: VKLQTVHSIPLTINKEEALQRPVAS
VKLQTVHSIPCTIHKFEAVQRPVAS

SEQ ID NO: 53670 - protein, 25 aa, synthetic construct
  source 1..25: note = Seed: VKLQTVHSIPLTINKEEALQRPVAS
VKLQTVHSIPCTIIKFEAIQRPVAS

SEQ ID NO: 53671 - protein, 25 aa, synthetic construct
  source 1..25: note = Seed: VKLQTVHSIPLTINKEEALQRPVAS
VKLQTVHSIPCTIIKFEALQRPVAS

SEQ ID NO: 53672 - protein, 25 aa, synthetic construct
  source 1..25: note = Seed: VKLQTVHSIPLTINKEEALQRPVAS
VKLQTVHSIPCTIIKFEAMQRPVAS

SEQ ID NO: 53673 - protein, 25 aa, synthetic construct
  source 1..25: note = Seed: VKLQTVHSIPLTINKEEALQRPVAS
VKLQTVHSIPCTIIKFEAVQRPVAS

SEQ ID NO: 53674 - protein, 25 aa, synthetic construct
  source 1..25: note = Seed: VKLQTVHSIPLTINKEEALQRPVAS
VKLQTVHSIPCTIIKYEALQRPVAS

SEQ ID NO: 53675 - protein, 25 aa, synthetic construct
  source 1..25: note = Seed: VKLQTVHSIPLTINKEEALQRPVAS
VKLQTVHSIPCTILKFEAIQRPVAS

SEQ ID NO: 53676 - protein, 25 aa, synthetic construct
  source 1..25: note = Seed: VKLQTVHSIPLTINKEEALQRPVAS
VKLQTVHSIPCTILKFEALQRPVAS

SEQ ID NO: 53677 - protein, 25 aa, synthetic construct
  source 1..25: note = Seed: VKLQTVHSIPLTINKEEALQRPVAS
VKLQTVHSIPCTILKFEAMQRPVAS

SEQ ID NO: 53678 - protein, 25 aa, synthetic construct
  source 1..25: note = Seed: VKLQTVHSIPLTINKEEALQRPVAS
VKLQTVHSIPCTILKFEAVQRPVAS

SEQ ID NO: 53679 - protein, 25 aa, synthetic construct
  source 1..25: note = Seed: VKLQTVHSIPLTINKEEALQRPVAS
VKLQTVHSIPCTIMKFEAIQRPVAS

SEQ ID NO: 53680 - protein, 25 aa, synthetic construct
  source 1..25: note = Seed: VKLQTVHSIPLTINKEEALQRPVAS
VKLQTVHSIPCTIMKFEALQRPVAS

SEQ ID NO: 53681 - protein, 25 aa, synthetic construct
  source 1..25: note = Seed: VKLQTVHSIPLTINKEEALQRPVAS
VKLQTVHSIPCTIMKFEAVQRPVAS

SEQ ID NO: 53682 - protein, 25 aa, synthetic construct
  source 1..25: note = Seed: VKLQTVHSIPLTINKEEALQRPVAS
VKLQTVHSIPCTIQKFEAIQRPVAS

SEQ ID NO: 53683 - protein, 25 aa, synthetic construct
  source 1..25: note = Seed: VKLQTVHSIPLTINKEEALQRPVAS
VKLQTVHSIPCTIQKFEALQRPVAS

SEQ ID NO: 53684 - protein, 25 aa, synthetic construct
  source 1..25: note = Seed: VKLQTVHSIPLTINKEEALQRPVAS
VKLQTVHSIPCTISKFEAIQRPVAS

SEQ ID NO: 53685 - protein, 25 aa, synthetic construct
  source 1..25: note = Seed: VKLQTVHSIPLTINKEEALQRPVAS
VKLQTVHSIPCTISKFEALQRPVAS

SEQ ID NO: 53686 - protein, 25 aa, synthetic construct
  source 1..25: note = Seed: VKLQTVHSIPLTINKEEALQRPVAS
VKLQTVHSIPCTISKFEAVQRPVAS

SEQ ID NO: 53687 - protein, 25 aa, synthetic construct
  source 1..25: note = Seed: VKLQTVHSIPLTINKEEALQRPVAS
VKLQTVHSIPCTITKFEAFQRPVAS

SEQ ID NO: 53688 - protein, 25 aa, synthetic construct
  source 1..25: note = Seed: VKLQTVHSIPLTINKEEALQRPVAS
VKLQTVHSIPCTITKFEAIQRPVAS

SEQ ID NO: 53689 - protein, 25 aa, synthetic construct
  source 1..25: note = Seed: VKLQTVHSIPLTINKEEALQRPVAS
VKLQTVHSIPCTITKFEALQRPVAS

SEQ ID NO: 53690 - protein, 25 aa, synthetic construct
  source 1..25: note = Seed: VKLQTVHSIPLTINKEEALQRPVAS
VKLQTVHSIPCTITKFEAVQRPVAS

SEQ ID NO: 53691 - protein, 25 aa, synthetic construct
  source 1..25: note = Seed: VKLQTVHSIPLTINKEEALQRPVAS
VKLQTVHSIPCTIVKFEAIQRPVAS

SEQ ID NO: 53692 - protein, 25 aa, synthetic construct
  source 1..25: note = Seed: VKLQTVHSIPLTINKEEALQRPVAS
VKLQTVHSIPCTIVKFEALQRPVAS

SEQ ID NO: 53693 - protein, 25 aa, synthetic construct
  source 1..25: note = Seed: VKLQTVHSIPLTINKEEALQRPVAS
VKLQTVHSIPCTIVKFEAMQRPVAS

SEQ ID NO: 53694 - protein, 25 aa, synthetic construct
  source 1..25: note = Seed: VKLQTVHSIPLTINKEEALQRPVAS
VKLQTVHSIPCTIVKFEAVQRPVAS

SEQ ID NO: 53695 - protein, 25 aa, synthetic construct
  source 1..25: note = Seed: VKLQTVHSIPLTINKEEALQRPVAS
VKLQTVHSIPCTIWKFEAFQRPVAS

SEQ ID NO: 53696 - protein, 25 aa, synthetic construct
  source 1..25: note = Seed: VKLQTVHSIPLTINKEEALQRPVAS
VKLQTVHSIPCTIWKFEALQRPVAS

SEQ ID NO: 53697 - protein, 25 aa, synthetic construct
  source 1..25: note = Seed: VKLQTVHSIPLTINKEEALQRPVAS
VKLQTVHSIPCTIYKFEAIQRPVAS

SEQ ID NO: 53698 - protein, 25 aa, synthetic construct
  source 1..25: note = Seed: VKLQTVHSIPLTINKEEALQRPVAS
VKLQTVHSIPCTIYKFEALQRPVAS

SEQ ID NO: 53699 - protein, 25 aa, synthetic construct
  source 1..25: note = Seed: VKLQTVHSIPLTINKEEALQRPVAS
VKLQTVHSIPCTIYKFEAVQRPVAS

SEQ ID NO: 53700 - protein, 25 aa, synthetic construct
  source 1..25: note = Seed: VKLQTVHSIPLTINKEEALQRPVAS
VKLQTVHSIPETIFKFEAIQRPVAS

SEQ ID NO: 53701 - protein, 25 aa, synthetic construct
  source 1..25: note = Seed: VKLQTVHSIPLTINKEEALQRPVAS
VKLQTVHSIPETIFKFEALQRPVAS

SEQ ID NO: 53702 - protein, 25 aa, synthetic construct
  source 1..25: note = Seed: VKLQTVHSIPLTINKEEALQRPVAS
VKLQTVHSIPETIIKFEAIQRPVAS

SEQ ID NO: 53703 - protein, 25 aa, synthetic construct
  source 1..25: note = Seed: VKLQTVHSIPLTINKEEALQRPVAS
VKLQTVHSIPETIIKFEALQRPVAS

SEQ ID NO: 53704 - protein, 25 aa, synthetic construct
  source 1..25: note = Seed: VKLQTVHSIPLTINKEEALQRPVAS
VKLQTVHSIPETILKFEALQRPVAS

SEQ ID NO: 53705 - protein, 25 aa, synthetic construct
  source 1..25: note = Seed: VKLQTVHSIPLTINKEEALQRPVAS
VKLQTVHSIPFTIAKAEAIQRPVAS

SEQ ID NO: 53706 - protein, 25 aa, synthetic construct
  source 1..25: note = Seed: VKLQTVHSIPLTINKEEALQRPVAS
VKLQTVHSIPFTIAKAEALQRPVAS

SEQ ID NO: 53707 - protein, 25 aa, synthetic construct
  source 1..25: note = Seed: VKLQTVHSIPLTINKEEALQRPVAS
VKLQTVHSIPFTIAKAEAVQRPVAS

SEQ ID NO: 53708 - protein, 25 aa, synthetic construct
  source 1..25: note = Seed: VKLQTVHSIPLTINKEEALQRPVAS
VKLQTVHSIPFTIAKFEAAQRPVAS

SEQ ID NO: 53709 - protein, 25 aa, synthetic construct
  source 1..25: note = Seed: VKLQTVHSIPLTINKEEALQRPVAS
VKLQTVHSIPFTIAKFEACQRPVAS

SEQ ID NO: 53710 - protein, 25 aa, synthetic construct
  source 1..25: note = Seed: VKLQTVHSIPLTINKEEALQRPVAS
VKLQTVHSIPFTIAKFEADQRPVAS

SEQ ID NO: 53711 - protein, 25 aa, synthetic construct
  source 1..25: note = Seed: VKLQTVHSIPLTINKEEALQRPVAS
VKLQTVHSIPFTIAKFEAEQRPVAS

SEQ ID NO: 53712 - protein, 25 aa, synthetic construct
  source 1..25: note = Seed: VKLQTVHSIPLTINKEEALQRPVAS
VKLQTVHSIPFTIAKFEAFQRPVAS

SEQ ID NO: 53713 - protein, 25 aa, synthetic construct
  source 1..25: note = Seed: VKLQTVHSIPLTINKEEALQRPVAS
VKLQTVHSIPFTIAKFEAGQRPVAS

SEQ ID NO: 53714 - protein, 25 aa, synthetic construct
  source 1..25: note = Seed: VKLQTVHSIPLTINKEEALQRPVAS
VKLQTVHSIPFTIAKFEAHQRPVAS

SEQ ID NO: 53715 - protein, 25 aa, synthetic construct
  source 1..25: note = Seed: VKLQTVHSIPLTINKEEALQRPVAS
VKLQTVHSIPFTIAKFEAIQRPVAS

SEQ ID NO: 53716 - protein, 25 aa, synthetic construct
  source 1..25: note = Seed: VKLQTVHSIPLTINKEEALQRPVAS
VKLQTVHSIPFTIAKFEAKQRPVAS

SEQ ID NO: 53717 - protein, 25 aa, synthetic construct
  source 1..25: note = Seed: VKLQTVHSIPLTINKEEALQRPVAS
VKLQTVHSIPFTIAKFEALQRPVAS

SEQ ID NO: 53718 - protein, 25 aa, synthetic construct
  source 1..25: note = Seed: VKLQTVHSIPLTINKEEALQRPVAS
VKLQTVHSIPFTIAKFEAMQRPVAS

SEQ ID NO: 53719 - protein, 25 aa, synthetic construct
  source 1..25: note = Seed: VKLQTVHSIPLTINKEEALQRPVAS
VKLQTVHSIPFTIAKFEANQRPVAS

SEQ ID NO: 53720 - protein, 25 aa, synthetic construct
  source 1..25: note = Seed: VKLQTVHSIPLTINKEEALQRPVAS
VKLQTVHSIPFTIAKFEAPQRPVAS

SEQ ID NO: 53721 - protein, 25 aa, synthetic construct
  source 1..25: note = Seed: VKLQTVHSIPLTINKEEALQRPVAS
VKLQTVHSIPFTIAKFEAQQRPVAS

SEQ ID NO: 53722 - protein, 25 aa, synthetic construct
  source 1..25: note = Seed: VKLQTVHSIPLTINKEEALQRPVAS
VKLQTVHSIPFTIAKFEARQRPVAS

SEQ ID NO: 53723 - protein, 25 aa, synthetic construct
  source 1..25: note = Seed: VKLQTVHSIPLTINKEEALQRPVAS
VKLQTVHSIPFTIAKFEASQRPVAS

SEQ ID NO: 53724 - protein, 25 aa, synthetic construct
  source 1..25: note = Seed: VKLQTVHSIPLTINKEEALQRPVAS
VKLQTVHSIPFTIAKFEATQRPVAS

SEQ ID NO: 53725 - protein, 25 aa, synthetic construct
  source 1..25: note = Seed: VKLQTVHSIPLTINKEEALQRPVAS
VKLQTVHSIPFTIAKFEAVQRPVAS

SEQ ID NO: 53726 - protein, 25 aa, synthetic construct
  source 1..25: note = Seed: VKLQTVHSIPLTINKEEALQRPVAS
VKLQTVHSIPFTIAKFEAWQRPVAS

SEQ ID NO: 53727 - protein, 25 aa, synthetic construct
  source 1..25: note = Seed: VKLQTVHSIPLTINKEEALQRPVAS
VKLQTVHSIPFTIAKFEAYQRPVAS

SEQ ID NO: 53728 - protein, 25 aa, synthetic construct
  source 1..25: note = Seed: VKLQTVHSIPLTINKEEALQRPVAS
VKLQTVHSIPFTIAKIEAAQRPVAS

SEQ ID NO: 53729 - protein, 25 aa, synthetic construct
  source 1..25: note = Seed: VKLQTVHSIPLTINKEEALQRPVAS
VKLQTVHSIPFTIAKIEAFQRPVAS

SEQ ID NO: 53730 - protein, 25 aa, synthetic construct
  source 1..25: note = Seed: VKLQTVHSIPLTINKEEALQRPVAS
VKLQTVHSIPFTIAKIEAIQRPVAS

SEQ ID NO: 53731 - protein, 25 aa, synthetic construct
  source 1..25: note = Seed: VKLQTVHSIPLTINKEEALQRPVAS
VKLQTVHSIPFTIAKIEALQRPVAS

SEQ ID NO: 53732 - protein, 25 aa, synthetic construct
  source 1..25: note = Seed: VKLQTVHSIPLTINKEEALQRPVAS
VKLQTVHSIPFTIAKIEAMQRPVAS

SEQ ID NO: 53733 - protein, 25 aa, synthetic construct
  source 1..25: note = Seed: VKLQTVHSIPLTINKEEALQRPVAS
VKLQTVHSIPFTIAKIEANQRPVAS

SEQ ID NO: 53734 - protein, 25 aa, synthetic construct
  source 1..25: note = Seed: VKLQTVHSIPLTINKEEALQRPVAS
VKLQTVHSIPFTIAKIEARQRPVAS

SEQ ID NO: 53735 - protein, 25 aa, synthetic construct
  source 1..25: note = Seed: VKLQTVHSIPLTINKEEALQRPVAS
VKLQTVHSIPFTIAKIEATQRPVAS

SEQ ID NO: 53736 - protein, 25 aa, synthetic construct
  source 1..25: note = Seed: VKLQTVHSIPLTINKEEALQRPVAS
VKLQTVHSIPFTIAKIEAVQRPVAS

SEQ ID NO: 53737 - protein, 25 aa, synthetic construct
  source 1..25: note = Seed: VKLQTVHSIPLTINKEEALQRPVAS
VKLQTVHSIPFTIAKIEAYQRPVAS

SEQ ID NO: 53738 - protein, 25 aa, synthetic construct
  source 1..25: note = Seed: VKLQTVHSIPLTINKEEALQRPVAS
VKLQTVHSIPFTIAKLEAAQRPVAS

SEQ ID NO: 53739 - protein, 25 aa, synthetic construct
  source 1..25: note = Seed: VKLQTVHSIPLTINKEEALQRPVAS
VKLQTVHSIPFTIAKLEADQRPVAS

SEQ ID NO: 53740 - protein, 25 aa, synthetic construct
  source 1..25: note = Seed: VKLQTVHSIPLTINKEEALQRPVAS
VKLQTVHSIPFTIAKLEAEQRPVAS

SEQ ID NO: 53741 - protein, 25 aa, synthetic construct
  source 1..25: note = Seed: VKLQTVHSIPLTINKEEALQRPVAS
VKLQTVHSIPFTIAKLEAFQRPVAS

SEQ ID NO: 53742 - protein, 25 aa, synthetic construct
  source 1..25: note = Seed: VKLQTVHSIPLTINKEEALQRPVAS
VKLQTVHSIPFTIAKLEAHQRPVAS

SEQ ID NO: 53743 - protein, 25 aa, synthetic construct
  source 1..25: note = Seed: VKLQTVHSIPLTINKEEALQRPVAS
VKLQTVHSIPFTIAKLEAIQRPVAS

SEQ ID NO: 53744 - protein, 25 aa, synthetic construct
  source 1..25: note = Seed: VKLQTVHSIPLTINKEEALQRPVAS
VKLQTVHSIPFTIAKLEALQRPVAS

SEQ ID NO: 53745 - protein, 25 aa, synthetic construct
  source 1..25: note = Seed: VKLQTVHSIPLTINKEEALQRPVAS
VKLQTVHSIPFTIAKLEAMQRPVAS

SEQ ID NO: 53746 - protein, 25 aa, synthetic construct
  source 1..25: note = Seed: VKLQTVHSIPLTINKEEALQRPVAS
VKLQTVHSIPFTIAKLEANQRPVAS

SEQ ID NO: 53747 - protein, 25 aa, synthetic construct
  source 1..25: note = Seed: VKLQTVHSIPLTINKEEALQRPVAS
VKLQTVHSIPFTIAKLEAQQRPVAS

SEQ ID NO: 53748 - protein, 25 aa, synthetic construct
  source 1..25: note = Seed: VKLQTVHSIPLTINKEEALQRPVAS
VKLQTVHSIPFTIAKLEARQRPVAS

SEQ ID NO: 53749 - protein, 25 aa, synthetic construct
  source 1..25: note = Seed: VKLQTVHSIPLTINKEEALQRPVAS
VKLQTVHSIPFTIAKLEASQRPVAS

SEQ ID NO: 53750 - protein, 25 aa, synthetic construct
  source 1..25: note = Seed: VKLQTVHSIPLTINKEEALQRPVAS
VKLQTVHSIPFTIAKLEATQRPVAS

SEQ ID NO: 53751 - protein, 25 aa, synthetic construct
  source 1..25: note = Seed: VKLQTVHSIPLTINKEEALQRPVAS
VKLQTVHSIPFTIAKLEAVQRPVAS

SEQ ID NO: 53752 - protein, 25 aa, synthetic construct
  source 1..25: note = Seed: VKLQTVHSIPLTINKEEALQRPVAS
VKLQTVHSIPFTIAKLEAYQRPVAS

SEQ ID NO: 53753 - protein, 25 aa, synthetic construct
  source 1..25: note = Seed: VKLQTVHSIPLTINKEEALQRPVAS
VKLQTVHSIPFTIAKMEAFQRPVAS

SEQ ID NO: 53754 - protein, 25 aa, synthetic construct
  source 1..25: note = Seed: VKLQTVHSIPLTINKEEALQRPVAS
VKLQTVHSIPFTIAKMEAIQRPVAS

SEQ ID NO: 53755 - protein, 25 aa, synthetic construct
  source 1..25: note = Seed: VKLQTVHSIPLTINKEEALQRPVAS
VKLQTVHSIPFTIAKMEALQRPVAS

SEQ ID NO: 53756 - protein, 25 aa, synthetic construct
  source 1..25: note = Seed: VKLQTVHSIPLTINKEEALQRPVAS
VKLQTVHSIPFTIAKMEAMQRPVAS

SEQ ID NO: 53757 - protein, 25 aa, synthetic construct
  source 1..25: note = Seed: VKLQTVHSIPLTINKEEALQRPVAS
VKLQTVHSIPFTIAKMEANQRPVAS

SEQ ID NO: 53758 - protein, 25 aa, synthetic construct
  source 1..25: note = Seed: VKLQTVHSIPLTINKEEALQRPVAS
VKLQTVHSIPFTIAKMEATQRPVAS

SEQ ID NO: 53759 - protein, 25 aa, synthetic construct
  source 1..25: note = Seed: VKLQTVHSIPLTINKEEALQRPVAS
VKLQTVHSIPFTIAKMEAVQRPVAS

SEQ ID NO: 53760 - protein, 25 aa, synthetic construct
  source 1..25: note = Seed: VKLQTVHSIPLTINKEEALQRPVAS
VKLQTVHSIPFTIAKMEAYQRPVAS

SEQ ID NO: 53761 - protein, 25 aa, synthetic construct
  source 1..25: note = Seed: VKLQTVHSIPLTINKEEALQRPVAS
VKLQTVHSIPFTIAKNEAAQRPVAS

SEQ ID NO: 53762 - protein, 25 aa, synthetic construct
  source 1..25: note = Seed: VKLQTVHSIPLTINKEEALQRPVAS
VKLQTVHSIPFTIAKNEADQRPVAS

SEQ ID NO: 53763 - protein, 25 aa, synthetic construct
  source 1..25: note = Seed: VKLQTVHSIPLTINKEEALQRPVAS
VKLQTVHSIPFTIAKNEAEQRPVAS

SEQ ID NO: 53764 - protein, 25 aa, synthetic construct
  source 1..25: note = Seed: VKLQTVHSIPLTINKEEALQRPVAS
VKLQTVHSIPFTIAKNEAIQRPVAS

SEQ ID NO: 53765 - protein, 25 aa, synthetic construct
  source 1..25: note = Seed: VKLQTVHSIPLTINKEEALQRPVAS
VKLQTVHSIPFTIAKNEALQRPVAS

SEQ ID NO: 53766 - protein, 25 aa, synthetic construct
  source 1..25: note = Seed: VKLQTVHSIPLTINKEEALQRPVAS
VKLQTVHSIPFTIAKNEAVQRPVAS

SEQ ID NO: 53767 - protein, 25 aa, synthetic construct
  source 1..25: note = Seed: VKLQTVHSIPLTINKEEALQRPVAS
VKLQTVHSIPFTIAKSEADQRPVAS

SEQ ID NO: 53768 - protein, 25 aa, synthetic construct
  source 1..25: note = Seed: VKLQTVHSIPLTINKEEALQRPVAS
VKLQTVHSIPFTIAKVEAFQRPVAS

SEQ ID NO: 53769 - protein, 25 aa, synthetic construct
  source 1..25: note = Seed: VKLQTVHSIPLTINKEEALQRPVAS
VKLQTVHSIPFTIAKVEAIQRPVAS

SEQ ID NO: 53770 - protein, 25 aa, synthetic construct
  source 1..25: note = Seed: VKLQTVHSIPLTINKEEALQRPVAS
VKLQTVHSIPFTIAKVEALQRPVAS

SEQ ID NO: 53771 - protein, 25 aa, synthetic construct
  source 1..25: note = Seed: VKLQTVHSIPLTINKEEALQRPVAS
VKLQTVHSIPFTIAKVEAMQRPVAS

SEQ ID NO: 53772 - protein, 25 aa, synthetic construct
  source 1..25: note = Seed: VKLQTVHSIPLTINKEEALQRPVAS
VKLQTVHSIPFTIAKVEAVQRPVAS

SEQ ID NO: 53773 - protein, 25 aa, synthetic construct
  source 1..25: note = Seed: VKLQTVHSIPLTINKEEALQRPVAS
VKLQTVHSIPFTIAKVEAYQRPVAS

SEQ ID NO: 53774 - protein, 25 aa, synthetic construct
  source 1..25: note = Seed: VKLQTVHSIPLTINKEEALQRPVAS
VKLQTVHSIPFTIAKWEAAQRPVAS

SEQ ID NO: 53775 - protein, 25 aa, synthetic construct
  source 1..25: note = Seed: VKLQTVHSIPLTINKEEALQRPVAS
VKLQTVHSIPFTIAKWEACQRPVAS

SEQ ID NO: 53776 - protein, 25 aa, synthetic construct
  source 1..25: note = Seed: VKLQTVHSIPLTINKEEALQRPVAS
VKLQTVHSIPFTIAKWEADQRPVAS

SEQ ID NO: 53777 - protein, 25 aa, synthetic construct
  source 1..25: note = Seed: VKLQTVHSIPLTINKEEALQRPVAS
VKLQTVHSIPFTIAKWEAEQRPVAS

SEQ ID NO: 53778 - protein, 25 aa, synthetic construct
  source 1..25: note = Seed: VKLQTVHSIPLTINKEEALQRPVAS
VKLQTVHSIPFTIAKWEAFQRPVAS

SEQ ID NO: 53779 - protein, 25 aa, synthetic construct
  source 1..25: note = Seed: VKLQTVHSIPLTINKEEALQRPVAS
VKLQTVHSIPFTIAKWEAGQRPVAS

SEQ ID NO: 53780 - protein, 25 aa, synthetic construct
  source 1..25: note = Seed: VKLQTVHSIPLTINKEEALQRPVAS
VKLQTVHSIPFTIAKWEAHQRPVAS

SEQ ID NO: 53781 - protein, 25 aa, synthetic construct
  source 1..25: note = Seed: VKLQTVHSIPLTINKEEALQRPVAS
VKLQTVHSIPFTIAKWEAIQRPVAS

SEQ ID NO: 53782 - protein, 25 aa, synthetic construct
  source 1..25: note = Seed: VKLQTVHSIPLTINKEEALQRPVAS
VKLQTVHSIPFTIAKWEALQRPVAS

SEQ ID NO: 53783 - protein, 25 aa, synthetic construct
  source 1..25: note = Seed: VKLQTVHSIPLTINKEEALQRPVAS
VKLQTVHSIPFTIAKWEAMQRPVAS

SEQ ID NO: 53784 - protein, 25 aa, synthetic construct
  source 1..25: note = Seed: VKLQTVHSIPLTINKEEALQRPVAS
VKLQTVHSIPFTIAKWEANQRPVAS

SEQ ID NO: 53785 - protein, 25 aa, synthetic construct
  source 1..25: note = Seed: VKLQTVHSIPLTINKEEALQRPVAS
VKLQTVHSIPFTIAKWEAQQRPVAS

SEQ ID NO: 53786 - protein, 25 aa, synthetic construct
  source 1..25: note = Seed: VKLQTVHSIPLTINKEEALQRPVAS
VKLQTVHSIPFTIAKWEASQRPVAS

SEQ ID NO: 53787 - protein, 25 aa, synthetic construct
  source 1..25: note = Seed: VKLQTVHSIPLTINKEEALQRPVAS
VKLQTVHSIPFTIAKWEATQRPVAS

SEQ ID NO: 53788 - protein, 25 aa, synthetic construct
  source 1..25: note = Seed: VKLQTVHSIPLTINKEEALQRPVAS
VKLQTVHSIPFTIAKWEAVQRPVAS

SEQ ID NO: 53789 - protein, 25 aa, synthetic construct
  source 1..25: note = Seed: VKLQTVHSIPLTINKEEALQRPVAS
VKLQTVHSIPFTIAKWEAYQRPVAS

SEQ ID NO: 53790 - protein, 25 aa, synthetic construct
  source 1..25: note = Seed: VKLQTVHSIPLTINKEEALQRPVAS
VKLQTVHSIPFTIAKYEAAQRPVAS

SEQ ID NO: 53791 - protein, 25 aa, synthetic construct
  source 1..25: note = Seed: VKLQTVHSIPLTINKEEALQRPVAS
VKLQTVHSIPFTIAKYEACQRPVAS

SEQ ID NO: 53792 - protein, 25 aa, synthetic construct
  source 1..25: note = Seed: VKLQTVHSIPLTINKEEALQRPVAS
VKLQTVHSIPFTIAKYEADQRPVAS

SEQ ID NO: 53793 - protein, 25 aa, synthetic construct
  source 1..25: note = Seed: VKLQTVHSIPLTINKEEALQRPVAS
VKLQTVHSIPFTIAKYEAEQRPVAS

SEQ ID NO: 53794 - protein, 25 aa, synthetic construct
  source 1..25: note = Seed: VKLQTVHSIPLTINKEEALQRPVAS
VKLQTVHSIPFTIAKYEAFQRPVAS

SEQ ID NO: 53795 - protein, 25 aa, synthetic construct
  source 1..25: note = Seed: VKLQTVHSIPLTINKEEALQRPVAS
VKLQTVHSIPFTIAKYEAGQRPVAS

SEQ ID NO: 53796 - protein, 25 aa, synthetic construct
  source 1..25: note = Seed: VKLQTVHSIPLTINKEEALQRPVAS
VKLQTVHSIPFTIAKYEAHQRPVAS

SEQ ID NO: 53797 - protein, 25 aa, synthetic construct
  source 1..25: note = Seed: VKLQTVHSIPLTINKEEALQRPVAS
VKLQTVHSIPFTIAKYEAIQRPVAS

SEQ ID NO: 53798 - protein, 25 aa, synthetic construct
  source 1..25: note = Seed: VKLQTVHSIPLTINKEEALQRPVAS
VKLQTVHSIPFTIAKYEALQRPVAS

SEQ ID NO: 53799 - protein, 25 aa, synthetic construct
  source 1..25: note = Seed: VKLQTVHSIPLTINKEEALQRPVAS
VKLQTVHSIPFTIAKYEAMQRPVAS

SEQ ID NO: 53800 - protein, 25 aa, synthetic construct
  source 1..25: note = Seed: VKLQTVHSIPLTINKEEALQRPVAS
VKLQTVHSIPFTIAKYEANQRPVAS

SEQ ID NO: 53801 - protein, 25 aa, synthetic construct
  source 1..25: note = Seed: VKLQTVHSIPLTINKEEALQRPVAS
VKLQTVHSIPFTIAKYEAPQRPVAS

SEQ ID NO: 53802 - protein, 25 aa, synthetic construct
  source 1..25: note = Seed: VKLQTVHSIPLTINKEEALQRPVAS
VKLQTVHSIPFTIAKYEAQQRPVAS

SEQ ID NO: 53803 - protein, 25 aa, synthetic construct
  source 1..25: note = Seed: VKLQTVHSIPLTINKEEALQRPVAS
VKLQTVHSIPFTIAKYEASQRPVAS

SEQ ID NO: 53804 - protein, 25 aa, synthetic construct
  source 1..25: note = Seed: VKLQTVHSIPLTINKEEALQRPVAS
VKLQTVHSIPFTIAKYEATQRPVAS

SEQ ID NO: 53805 - protein, 25 aa, synthetic construct
  source 1..25: note = Seed: VKLQTVHSIPLTINKEEALQRPVAS
VKLQTVHSIPFTIAKYEAVQRPVAS

SEQ ID NO: 53806 - protein, 25 aa, synthetic construct
  source 1..25: note = Seed: VKLQTVHSIPLTINKEEALQRPVAS
VKLQTVHSIPFTIAKYEAWQRPVAS

SEQ ID NO: 53807 - protein, 25 aa, synthetic construct
  source 1..25: note = Seed: VKLQTVHSIPLTINKEEALQRPVAS
VKLQTVHSIPFTIAKYEAYQRPVAS

SEQ ID NO: 53808 - protein, 25 aa, synthetic construct
  source 1..25: note = Seed: VKLQTVHSIPLTINKEEALQRPVAS
VKLQTVHSIPFTICKFEAAQRPVAS

SEQ ID NO: 53809 - protein, 25 aa, synthetic construct
  source 1..25: note = Seed: VKLQTVHSIPLTINKEEALQRPVAS
VKLQTVHSIPFTICKFEADQRPVAS

SEQ ID NO: 53810 - protein, 25 aa, synthetic construct
  source 1..25: note = Seed: VKLQTVHSIPLTINKEEALQRPVAS
VKLQTVHSIPFTICKFEAEQRPVAS

SEQ ID NO: 53811 - protein, 25 aa, synthetic construct
  source 1..25: note = Seed: VKLQTVHSIPLTINKEEALQRPVAS
VKLQTVHSIPFTICKFEAFQRPVAS

SEQ ID NO: 53812 - protein, 25 aa, synthetic construct
  source 1..25: note = Seed: VKLQTVHSIPLTINKEEALQRPVAS
VKLQTVHSIPFTICKFEAIQRPVAS

SEQ ID NO: 53813 - protein, 25 aa, synthetic construct
  source 1..25: note = Seed: VKLQTVHSIPLTINKEEALQRPVAS
VKLQTVHSIPFTICKFEALQRPVAS

SEQ ID NO: 53814 - protein, 25 aa, synthetic construct
  source 1..25: note = Seed: VKLQTVHSIPLTINKEEALQRPVAS
VKLQTVHSIPFTICKFEAMQRPVAS

SEQ ID NO: 53815 - protein, 25 aa, synthetic construct
  source 1..25: note = Seed: VKLQTVHSIPLTINKEEALQRPVAS
VKLQTVHSIPFTICKFEANQRPVAS

SEQ ID NO: 53816 - protein, 25 aa, synthetic construct
  source 1..25: note = Seed: VKLQTVHSIPLTINKEEALQRPVAS
VKLQTVHSIPFTICKFEASQRPVAS

SEQ ID NO: 53817 - protein, 25 aa, synthetic construct
  source 1..25: note = Seed: VKLQTVHSIPLTINKEEALQRPVAS
VKLQTVHSIPFTICKFEATQRPVAS

SEQ ID NO: 53818 - protein, 25 aa, synthetic construct
  source 1..25: note = Seed: VKLQTVHSIPLTINKEEALQRPVAS
VKLQTVHSIPFTICKFEAVQRPVAS

SEQ ID NO: 53819 - protein, 25 aa, synthetic construct
  source 1..25: note = Seed: VKLQTVHSIPLTINKEEALQRPVAS
VKLQTVHSIPFTICKFEAWQRPVAS

SEQ ID NO: 53820 - protein, 25 aa, synthetic construct
  source 1..25: note = Seed: VKLQTVHSIPLTINKEEALQRPVAS
VKLQTVHSIPFTICKFEAYQRPVAS

SEQ ID NO: 53821 - protein, 25 aa, synthetic construct
  source 1..25: note = Seed: VKLQTVHSIPLTINKEEALQRPVAS
VKLQTVHSIPFTICKIEAIQRPVAS

SEQ ID NO: 53822 - protein, 25 aa, synthetic construct
  source 1..25: note = Seed: VKLQTVHSIPLTINKEEALQRPVAS
VKLQTVHSIPFTICKLEAFQRPVAS

SEQ ID NO: 53823 - protein, 25 aa, synthetic construct
  source 1..25: note = Seed: VKLQTVHSIPLTINKEEALQRPVAS
VKLQTVHSIPFTICKLEAIQRPVAS

SEQ ID NO: 53824 - protein, 25 aa, synthetic construct
  source 1..25: note = Seed: VKLQTVHSIPLTINKEEALQRPVAS
VKLQTVHSIPFTICKLEALQRPVAS

SEQ ID NO: 53825 - protein, 25 aa, synthetic construct
  source 1..25: note = Seed: VKLQTVHSIPLTINKEEALQRPVAS
VKLQTVHSIPFTICKLEAVQRPVAS

SEQ ID NO: 53826 - protein, 25 aa, synthetic construct
  source 1..25: note = Seed: VKLQTVHSIPLTINKEEALQRPVAS
VKLQTVHSIPFTICKWEAFQRPVAS

SEQ ID NO: 53827 - protein, 25 aa, synthetic construct
  source 1..25: note = Seed: VKLQTVHSIPLTINKEEALQRPVAS
VKLQTVHSIPFTICKWEAIQRPVAS

SEQ ID NO: 53828 - protein, 25 aa, synthetic construct
  source 1..25: note = Seed: VKLQTVHSIPLTINKEEALQRPVAS
VKLQTVHSIPFTICKWEALQRPVAS

SEQ ID NO: 53829 - protein, 25 aa, synthetic construct
  source 1..25: note = Seed: VKLQTVHSIPLTINKEEALQRPVAS
VKLQTVHSIPFTICKWEAVQRPVAS

SEQ ID NO: 53830 - protein, 25 aa, synthetic construct
  source 1..25: note = Seed: VKLQTVHSIPLTINKEEALQRPVAS
VKLQTVHSIPFTICKYEAFQRPVAS

SEQ ID NO: 53831 - protein, 25 aa, synthetic construct
  source 1..25: note = Seed: VKLQTVHSIPLTINKEEALQRPVAS
VKLQTVHSIPFTICKYEAIQRPVAS

SEQ ID NO: 53832 - protein, 25 aa, synthetic construct
  source 1..25: note = Seed: VKLQTVHSIPLTINKEEALQRPVAS
VKLQTVHSIPFTICKYEALQRPVAS

SEQ ID NO: 53833 - protein, 25 aa, synthetic construct
  source 1..25: note = Seed: VKLQTVHSIPLTINKEEALQRPVAS
VKLQTVHSIPFTICKYEAMQRPVAS

SEQ ID NO: 53834 - protein, 25 aa, synthetic construct
  source 1..25: note = Seed: VKLQTVHSIPLTINKEEALQRPVAS
VKLQTVHSIPFTICKYEAVQRPVAS

SEQ ID NO: 53835 - protein, 25 aa, synthetic construct
  source 1..25: note = Seed: VKLQTVHSIPLTINKEEALQRPVAS
VKLQTVHSIPFTIDKFEAAQRPVAS

SEQ ID NO: 53836 - protein, 25 aa, synthetic construct
  source 1..25: note = Seed: VKLQTVHSIPLTINKEEALQRPVAS
VKLQTVHSIPFTIDKFEACQRPVAS

SEQ ID NO: 53837 - protein, 25 aa, synthetic construct
  source 1..25: note = Seed: VKLQTVHSIPLTINKEEALQRPVAS
VKLQTVHSIPFTIDKFEADQRPVAS

SEQ ID NO: 53838 - protein, 25 aa, synthetic construct
  source 1..25: note = Seed: VKLQTVHSIPLTINKEEALQRPVAS
VKLQTVHSIPFTIDKFEAEQRPVAS

SEQ ID NO: 53839 - protein, 25 aa, synthetic construct
  source 1..25: note = Seed: VKLQTVHSIPLTINKEEALQRPVAS
VKLQTVHSIPFTIDKFEAFQRPVAS

SEQ ID NO: 53840 - protein, 25 aa, synthetic construct
  source 1..25: note = Seed: VKLQTVHSIPLTINKEEALQRPVAS
VKLQTVHSIPFTIDKFEAIQRPVAS

SEQ ID NO: 53841 - protein, 25 aa, synthetic construct
  source 1..25: note = Seed: VKLQTVHSIPLTINKEEALQRPVAS
VKLQTVHSIPFTIDKFEALQRPVAS

SEQ ID NO: 53842 - protein, 25 aa, synthetic construct
  source 1..25: note = Seed: VKLQTVHSIPLTINKEEALQRPVAS
VKLQTVHSIPFTIDKFEAMQRPVAS

SEQ ID NO: 53843 - protein, 25 aa, synthetic construct
  source 1..25: note = Seed: VKLQTVHSIPLTINKEEALQRPVAS
VKLQTVHSIPFTIDKFEANQRPVAS

SEQ ID NO: 53844 - protein, 25 aa, synthetic construct
  source 1..25: note = Seed: VKLQTVHSIPLTINKEEALQRPVAS
VKLQTVHSIPFTIDKFEASQRPVAS

SEQ ID NO: 53845 - protein, 25 aa, synthetic construct
  source 1..25: note = Seed: VKLQTVHSIPLTINKEEALQRPVAS
VKLQTVHSIPFTIDKFEATQRPVAS

SEQ ID NO: 53846 - protein, 25 aa, synthetic construct
  source 1..25: note = Seed: VKLQTVHSIPLTINKEEALQRPVAS
VKLQTVHSIPFTIDKFEAVQRPVAS

SEQ ID NO: 53847 - protein, 25 aa, synthetic construct
  source 1..25: note = Seed: VKLQTVHSIPLTINKEEALQRPVAS
VKLQTVHSIPFTIDKFEAWQRPVAS

SEQ ID NO: 53848 - protein, 25 aa, synthetic construct
  source 1..25: note = Seed: VKLQTVHSIPLTINKEEALQRPVAS
VKLQTVHSIPFTIDKFEAYQRPVAS

SEQ ID NO: 53849 - protein, 25 aa, synthetic construct
  source 1..25: note = Seed: VKLQTVHSIPLTINKEEALQRPVAS
VKLQTVHSIPFTIDKIEAFQRPVAS

SEQ ID NO: 53850 - protein, 25 aa, synthetic construct
  source 1..25: note = Seed: VKLQTVHSIPLTINKEEALQRPVAS
VKLQTVHSIPFTIDKIEAIQRPVAS

SEQ ID NO: 53851 - protein, 25 aa, synthetic construct
  source 1..25: note = Seed: VKLQTVHSIPLTINKEEALQRPVAS
VKLQTVHSIPFTIDKIEALQRPVAS

SEQ ID NO: 53852 - protein, 25 aa, synthetic construct
  source 1..25: note = Seed: VKLQTVHSIPLTINKEEALQRPVAS
VKLQTVHSIPFTIDKIEAVQRPVAS

SEQ ID NO: 53853 - protein, 25 aa, synthetic construct
  source 1..25: note = Seed: VKLQTVHSIPLTINKEEALQRPVAS
VKLQTVHSIPFTIDKLEAFQRPVAS

SEQ ID NO: 53854 - protein, 25 aa, synthetic construct
  source 1..25: note = Seed: VKLQTVHSIPLTINKEEALQRPVAS
VKLQTVHSIPFTIDKLEAIQRPVAS

SEQ ID NO: 53855 - protein, 25 aa, synthetic construct
  source 1..25: note = Seed: VKLQTVHSIPLTINKEEALQRPVAS
VKLQTVHSIPFTIDKLEALQRPVAS

SEQ ID NO: 53856 - protein, 25 aa, synthetic construct
  source 1..25: note = Seed: VKLQTVHSIPLTINKEEALQRPVAS
VKLQTVHSIPFTIDKLEAMQRPVAS

SEQ ID NO: 53857 - protein, 25 aa, synthetic construct
  source 1..25: note = Seed: VKLQTVHSIPLTINKEEALQRPVAS
VKLQTVHSIPFTIDKLEAVQRPVAS

SEQ ID NO: 53858 - protein, 25 aa, synthetic construct
  source 1..25: note = Seed: VKLQTVHSIPLTINKEEALQRPVAS
VKLQTVHSIPFTIDKMEALQRPVAS

SEQ ID NO: 53859 - protein, 25 aa, synthetic construct
  source 1..25: note = Seed: VKLQTVHSIPLTINKEEALQRPVAS
VKLQTVHSIPFTIDKWEAFQRPVAS

SEQ ID NO: 53860 - protein, 25 aa, synthetic construct
  source 1..25: note = Seed: VKLQTVHSIPLTINKEEALQRPVAS
VKLQTVHSIPFTIDKWEAIQRPVAS

SEQ ID NO: 53861 - protein, 25 aa, synthetic construct
  source 1..25: note = Seed: VKLQTVHSIPLTINKEEALQRPVAS
VKLQTVHSIPFTIDKWEALQRPVAS

SEQ ID NO: 53862 - protein, 25 aa, synthetic construct
  source 1..25: note = Seed: VKLQTVHSIPLTINKEEALQRPVAS
VKLQTVHSIPFTIDKWEAVQRPVAS

SEQ ID NO: 53863 - protein, 25 aa, synthetic construct
  source 1..25: note = Seed: VKLQTVHSIPLTINKEEALQRPVAS
VKLQTVHSIPFTIDKYEAFQRPVAS

SEQ ID NO: 53864 - protein, 25 aa, synthetic construct
  source 1..25: note = Seed: VKLQTVHSIPLTINKEEALQRPVAS
VKLQTVHSIPFTIDKYEAIQRPVAS

SEQ ID NO: 53865 - protein, 25 aa, synthetic construct
  source 1..25: note = Seed: VKLQTVHSIPLTINKEEALQRPVAS
VKLQTVHSIPFTIDKYEALQRPVAS

SEQ ID NO: 53866 - protein, 25 aa, synthetic construct
  source 1..25: note = Seed: VKLQTVHSIPLTINKEEALQRPVAS
VKLQTVHSIPFTIDKYEAMQRPVAS

SEQ ID NO: 53867 - protein, 25 aa, synthetic construct
  source 1..25: note = Seed: VKLQTVHSIPLTINKEEALQRPVAS
VKLQTVHSIPFTIDKYEAVQRPVAS

SEQ ID NO: 53868 - protein, 25 aa, synthetic construct
  source 1..25: note = Seed: VKLQTVHSIPLTINKEEALQRPVAS
VKLQTVHSIPFTIEKAEAFQRPVAS

SEQ ID NO: 53869 - protein, 25 aa, synthetic construct
  source 1..25: note = Seed: VKLQTVHSIPLTINKEEALQRPVAS
VKLQTVHSIPFTIEKAEAIQRPVAS

SEQ ID NO: 53870 - protein, 25 aa, synthetic construct
  source 1..25: note = Seed: VKLQTVHSIPLTINKEEALQRPVAS
VKLQTVHSIPFTIEKAEALQRPVAS

SEQ ID NO: 53871 - protein, 25 aa, synthetic construct
  source 1..25: note = Seed: VKLQTVHSIPLTINKEEALQRPVAS
VKLQTVHSIPFTIEKAEAVQRPVAS

SEQ ID NO: 53872 - protein, 25 aa, synthetic construct
  source 1..25: note = Seed: VKLQTVHSIPLTINKEEALQRPVAS
VKLQTVHSIPFTIEKFEAAQRPVAS

SEQ ID NO: 53873 - protein, 25 aa, synthetic construct
  source 1..25: note = Seed: VKLQTVHSIPLTINKEEALQRPVAS
VKLQTVHSIPFTIEKFEACQRPVAS

SEQ ID NO: 53874 - protein, 25 aa, synthetic construct
  source 1..25: note = Seed: VKLQTVHSIPLTINKEEALQRPVAS
VKLQTVHSIPFTIEKFEADQRPVAS

SEQ ID NO: 53875 - protein, 25 aa, synthetic construct
  source 1..25: note = Seed: VKLQTVHSIPLTINKEEALQRPVAS
VKLQTVHSIPFTIEKFEAEQRPVAS

SEQ ID NO: 53876 - protein, 25 aa, synthetic construct
  source 1..25: note = Seed: VKLQTVHSIPLTINKEEALQRPVAS
VKLQTVHSIPFTIEKFEAFQRPVAS

SEQ ID NO: 53877 - protein, 25 aa, synthetic construct
  source 1..25: note = Seed: VKLQTVHSIPLTINKEEALQRPVAS
VKLQTVHSIPFTIEKFEAGQRPVAS

SEQ ID NO: 53878 - protein, 25 aa, synthetic construct
  source 1..25: note = Seed: VKLQTVHSIPLTINKEEALQRPVAS
VKLQTVHSIPFTIEKFEAHQRPVAS

SEQ ID NO: 53879 - protein, 25 aa, synthetic construct
  source 1..25: note = Seed: VKLQTVHSIPLTINKEEALQRPVAS
VKLQTVHSIPFTIEKFEAIQRPVAS

SEQ ID NO: 53880 - protein, 25 aa, synthetic construct
  source 1..25: note = Seed: VKLQTVHSIPLTINKEEALQRPVAS
VKLQTVHSIPFTIEKFEAKQRPVAS

SEQ ID NO: 53881 - protein, 25 aa, synthetic construct
  source 1..25: note = Seed: VKLQTVHSIPLTINKEEALQRPVAS
VKLQTVHSIPFTIEKFEALQRPVAS

SEQ ID NO: 53882 - protein, 25 aa, synthetic construct
  source 1..25: note = Seed: VKLQTVHSIPLTINKEEALQRPVAS
VKLQTVHSIPFTIEKFEAMQRPVAS

SEQ ID NO: 53883 - protein, 25 aa, synthetic construct
  source 1..25: note = Seed: VKLQTVHSIPLTINKEEALQRPVAS
VKLQTVHSIPFTIEKFEANQRPVAS

SEQ ID NO: 53884 - protein, 25 aa, synthetic construct
  source 1..25: note = Seed: VKLQTVHSIPLTINKEEALQRPVAS
VKLQTVHSIPFTIEKFEAPQRPVAS

SEQ ID NO: 53885 - protein, 25 aa, synthetic construct
  source 1..25: note = Seed: VKLQTVHSIPLTINKEEALQRPVAS
VKLQTVHSIPFTIEKFEAQQRPVAS

SEQ ID NO: 53886 - protein, 25 aa, synthetic construct
  source 1..25: note = Seed: VKLQTVHSIPLTINKEEALQRPVAS
VKLQTVHSIPFTIEKFEARQRPVAS

SEQ ID NO: 53887 - protein, 25 aa, synthetic construct
  source 1..25: note = Seed: VKLQTVHSIPLTINKEEALQRPVAS
VKLQTVHSIPFTIEKFEASQRPVAS

SEQ ID NO: 53888 - protein, 25 aa, synthetic construct
  source 1..25: note = Seed: VKLQTVHSIPLTINKEEALQRPVAS
VKLQTVHSIPFTIEKFEATQRPVAS

SEQ ID NO: 53889 - protein, 25 aa, synthetic construct
  source 1..25: note = Seed: VKLQTVHSIPLTINKEEALQRPVAS
VKLQTVHSIPFTIEKFEAVQRPVAS

SEQ ID NO: 53890 - protein, 25 aa, synthetic construct
  source 1..25: note = Seed: VKLQTVHSIPLTINKEEALQRPVAS
VKLQTVHSIPFTIEKFEAWQRPVAS

SEQ ID NO: 53891 - protein, 25 aa, synthetic construct
  source 1..25: note = Seed: VKLQTVHSIPLTINKEEALQRPVAS
VKLQTVHSIPFTIEKFEAYQRPVAS

SEQ ID NO: 53892 - protein, 25 aa, synthetic construct
  source 1..25: note = Seed: VKLQTVHSIPLTINKEEALQRPVAS
VKLQTVHSIPFTIEKIEAAQRPVAS

SEQ ID NO: 53893 - protein, 25 aa, synthetic construct
  source 1..25: note = Seed: VKLQTVHSIPLTINKEEALQRPVAS
VKLQTVHSIPFTIEKIEADQRPVAS

SEQ ID NO: 53894 - protein, 25 aa, synthetic construct
  source 1..25: note = Seed: VKLQTVHSIPLTINKEEALQRPVAS
VKLQTVHSIPFTIEKIEAEQRPVAS

SEQ ID NO: 53895 - protein, 25 aa, synthetic construct
  source 1..25: note = Seed: VKLQTVHSIPLTINKEEALQRPVAS
VKLQTVHSIPFTIEKIEAFQRPVAS

SEQ ID NO: 53896 - protein, 25 aa, synthetic construct
  source 1..25: note = Seed: VKLQTVHSIPLTINKEEALQRPVAS
VKLQTVHSIPFTIEKIEAIQRPVAS

SEQ ID NO: 53897 - protein, 25 aa, synthetic construct
  source 1..25: note = Seed: VKLQTVHSIPLTINKEEALQRPVAS
VKLQTVHSIPFTIEKIEALQRPVAS

SEQ ID NO: 53898 - protein, 25 aa, synthetic construct
  source 1..25: note = Seed: VKLQTVHSIPLTINKEEALQRPVAS
VKLQTVHSIPFTIEKIEAMQRPVAS

SEQ ID NO: 53899 - protein, 25 aa, synthetic construct
  source 1..25: note = Seed: VKLQTVHSIPLTINKEEALQRPVAS
VKLQTVHSIPFTIEKIEANQRPVAS

SEQ ID NO: 53900 - protein, 25 aa, synthetic construct
  source 1..25: note = Seed: VKLQTVHSIPLTINKEEALQRPVAS
VKLQTVHSIPFTIEKIEASQRPVAS

SEQ ID NO: 53901 - protein, 25 aa, synthetic construct
  source 1..25: note = Seed: VKLQTVHSIPLTINKEEALQRPVAS
VKLQTVHSIPFTIEKIEATQRPVAS

SEQ ID NO: 53902 - protein, 25 aa, synthetic construct
  source 1..25: note = Seed: VKLQTVHSIPLTINKEEALQRPVAS
VKLQTVHSIPFTIEKIEAVQRPVAS

SEQ ID NO: 53903 - protein, 25 aa, synthetic construct
  source 1..25: note = Seed: VKLQTVHSIPLTINKEEALQRPVAS
VKLQTVHSIPFTIEKIEAWQRPVAS

SEQ ID NO: 53904 - protein, 25 aa, synthetic construct
  source 1..25: note = Seed: VKLQTVHSIPLTINKEEALQRPVAS
VKLQTVHSIPFTIEKIEAYQRPVAS

SEQ ID NO: 53905 - protein, 25 aa, synthetic construct
  source 1..25: note = Seed: VKLQTVHSIPLTINKEEALQRPVAS
VKLQTVHSIPFTIEKLEAAQRPVAS

SEQ ID NO: 53906 - protein, 25 aa, synthetic construct
  source 1..25: note = Seed: VKLQTVHSIPLTINKEEALQRPVAS
VKLQTVHSIPFTIEKLEADQRPVAS

SEQ ID NO: 53907 - protein, 25 aa, synthetic construct
  source 1..25: note = Seed: VKLQTVHSIPLTINKEEALQRPVAS
VKLQTVHSIPFTIEKLEAEQRPVAS

SEQ ID NO: 53908 - protein, 25 aa, synthetic construct
  source 1..25: note = Seed: VKLQTVHSIPLTINKEEALQRPVAS
VKLQTVHSIPFTIEKLEAFQRPVAS

SEQ ID NO: 53909 - protein, 25 aa, synthetic construct
  source 1..25: note = Seed: VKLQTVHSIPLTINKEEALQRPVAS
VKLQTVHSIPFTIEKLEAIQRPVAS

SEQ ID NO: 53910 - protein, 25 aa, synthetic construct
  source 1..25: note = Seed: VKLQTVHSIPLTINKEEALQRPVAS
VKLQTVHSIPFTIEKLEALQRPVAS

SEQ ID NO: 53911 - protein, 25 aa, synthetic construct
  source 1..25: note = Seed: VKLQTVHSIPLTINKEEALQRPVAS
VKLQTVHSIPFTIEKLEAMQRPVAS

SEQ ID NO: 53912 - protein, 25 aa, synthetic construct
  source 1..25: note = Seed: VKLQTVHSIPLTINKEEALQRPVAS
VKLQTVHSIPFTIEKLEANQRPVAS

SEQ ID NO: 53913 - protein, 25 aa, synthetic construct
  source 1..25: note = Seed: VKLQTVHSIPLTINKEEALQRPVAS
VKLQTVHSIPFTIEKLEAQQRPVAS

SEQ ID NO: 53914 - protein, 25 aa, synthetic construct
  source 1..25: note = Seed: VKLQTVHSIPLTINKEEALQRPVAS
VKLQTVHSIPFTIEKLEASQRPVAS

SEQ ID NO: 53915 - protein, 25 aa, synthetic construct
  source 1..25: note = Seed: VKLQTVHSIPLTINKEEALQRPVAS
VKLQTVHSIPFTIEKLEATQRPVAS

SEQ ID NO: 53916 - protein, 25 aa, synthetic construct
  source 1..25: note = Seed: VKLQTVHSIPLTINKEEALQRPVAS
VKLQTVHSIPFTIEKLEAVQRPVAS

SEQ ID NO: 53917 - protein, 25 aa, synthetic construct
  source 1..25: note = Seed: VKLQTVHSIPLTINKEEALQRPVAS
VKLQTVHSIPFTIEKLEAWQRPVAS

SEQ ID NO: 53918 - protein, 25 aa, synthetic construct
  source 1..25: note = Seed: VKLQTVHSIPLTINKEEALQRPVAS
VKLQTVHSIPFTIEKLEAYQRPVAS

SEQ ID NO: 53919 - protein, 25 aa, synthetic construct
  source 1..25: note = Seed: VKLQTVHSIPLTINKEEALQRPVAS
VKLQTVHSIPFTIEKMEAFQRPVAS

SEQ ID NO: 53920 - protein, 25 aa, synthetic construct
  source 1..25: note = Seed: VKLQTVHSIPLTINKEEALQRPVAS
VKLQTVHSIPFTIEKMEAIQRPVAS

SEQ ID NO: 53921 - protein, 25 aa, synthetic construct
  source 1..25: note = Seed: VKLQTVHSIPLTINKEEALQRPVAS
VKLQTVHSIPFTIEKMEALQRPVAS

SEQ ID NO: 53922 - protein, 25 aa, synthetic construct
  source 1..25: note = Seed: VKLQTVHSIPLTINKEEALQRPVAS
VKLQTVHSIPFTIEKMEAMQRPVAS

SEQ ID NO: 53923 - protein, 25 aa, synthetic construct
  source 1..25: note = Seed: VKLQTVHSIPLTINKEEALQRPVAS
VKLQTVHSIPFTIEKMEAVQRPVAS

SEQ ID NO: 53924 - protein, 25 aa, synthetic construct
  source 1..25: note = Seed: VKLQTVHSIPLTINKEEALQRPVAS
VKLQTVHSIPFTIEKMEAYQRPVAS

SEQ ID NO: 53925 - protein, 25 aa, synthetic construct
  source 1..25: note = Seed: VKLQTVHSIPLTINKEEALQRPVAS
VKLQTVHSIPFTIEKVEAFQRPVAS

SEQ ID NO: 53926 - protein, 25 aa, synthetic construct
  source 1..25: note = Seed: VKLQTVHSIPLTINKEEALQRPVAS
VKLQTVHSIPFTIEKVEAIQRPVAS

SEQ ID NO: 53927 - protein, 25 aa, synthetic construct
  source 1..25: note = Seed: VKLQTVHSIPLTINKEEALQRPVAS
VKLQTVHSIPFTIEKVEALQRPVAS

SEQ ID NO: 53928 - protein, 25 aa, synthetic construct
  source 1..25: note = Seed: VKLQTVHSIPLTINKEEALQRPVAS
VKLQTVHSIPFTIEKVEAMQRPVAS

SEQ ID NO: 53929 - protein, 25 aa, synthetic construct
  source 1..25: note = Seed: VKLQTVHSIPLTINKEEALQRPVAS
VKLQTVHSIPFTIEKVEAVQRPVAS

SEQ ID NO: 53930 - protein, 25 aa, synthetic construct
  source 1..25: note = Seed: VKLQTVHSIPLTINKEEALQRPVAS
VKLQTVHSIPFTIEKWEAAQRPVAS

SEQ ID NO: 53931 - protein, 25 aa, synthetic construct
  source 1..25: note = Seed: VKLQTVHSIPLTINKEEALQRPVAS
VKLQTVHSIPFTIEKWEAFQRPVAS

SEQ ID NO: 53932 - protein, 25 aa, synthetic construct
  source 1..25: note = Seed: VKLQTVHSIPLTINKEEALQRPVAS
VKLQTVHSIPFTIEKWEAIQRPVAS

SEQ ID NO: 53933 - protein, 25 aa, synthetic construct
  source 1..25: note = Seed: VKLQTVHSIPLTINKEEALQRPVAS
VKLQTVHSIPFTIEKWEALQRPVAS

SEQ ID NO: 53934 - protein, 25 aa, synthetic construct
  source 1..25: note = Seed: VKLQTVHSIPLTINKEEALQRPVAS
VKLQTVHSIPFTIEKWEAMQRPVAS

SEQ ID NO: 53935 - protein, 25 aa, synthetic construct
  source 1..25: note = Seed: VKLQTVHSIPLTINKEEALQRPVAS
VKLQTVHSIPFTIEKWEATQRPVAS

SEQ ID NO: 53936 - protein, 25 aa, synthetic construct
  source 1..25: note = Seed: VKLQTVHSIPLTINKEEALQRPVAS
VKLQTVHSIPFTIEKWEAVQRPVAS

SEQ ID NO: 53937 - protein, 25 aa, synthetic construct
  source 1..25: note = Seed: VKLQTVHSIPLTINKEEALQRPVAS
VKLQTVHSIPFTIEKWEAWQRPVAS

SEQ ID NO: 53938 - protein, 25 aa, synthetic construct
  source 1..25: note = Seed: VKLQTVHSIPLTINKEEALQRPVAS
VKLQTVHSIPFTIEKWEAYQRPVAS

SEQ ID NO: 53939 - protein, 25 aa, synthetic construct
  source 1..25: note = Seed: VKLQTVHSIPLTINKEEALQRPVAS
VKLQTVHSIPFTIEKYEAAQRPVAS

SEQ ID NO: 53940 - protein, 25 aa, synthetic construct
  source 1..25: note = Seed: VKLQTVHSIPLTINKEEALQRPVAS
VKLQTVHSIPFTIEKYEAFQRPVAS

SEQ ID NO: 53941 - protein, 25 aa, synthetic construct
  source 1..25: note = Seed: VKLQTVHSIPLTINKEEALQRPVAS
VKLQTVHSIPFTIEKYEAIQRPVAS

SEQ ID NO: 53942 - protein, 25 aa, synthetic construct
  source 1..25: note = Seed: VKLQTVHSIPLTINKEEALQRPVAS
VKLQTVHSIPFTIEKYEALQRPVAS

SEQ ID NO: 53943 - protein, 25 aa, synthetic construct
  source 1..25: note = Seed: VKLQTVHSIPLTINKEEALQRPVAS
VKLQTVHSIPFTIEKYEAMQRPVAS

SEQ ID NO: 53944 - protein, 25 aa, synthetic construct
  source 1..25: note = Seed: VKLQTVHSIPLTINKEEALQRPVAS
VKLQTVHSIPFTIEKYEANQRPVAS

SEQ ID NO: 53945 - protein, 25 aa, synthetic construct
  source 1..25: note = Seed: VKLQTVHSIPLTINKEEALQRPVAS
VKLQTVHSIPFTIEKYEASQRPVAS

SEQ ID NO: 53946 - protein, 25 aa, synthetic construct
  source 1..25: note = Seed: VKLQTVHSIPLTINKEEALQRPVAS
VKLQTVHSIPFTIEKYEATQRPVAS

SEQ ID NO: 53947 - protein, 25 aa, synthetic construct
  source 1..25: note = Seed: VKLQTVHSIPLTINKEEALQRPVAS
VKLQTVHSIPFTIEKYEAVQRPVAS

SEQ ID NO: 53948 - protein, 25 aa, synthetic construct
  source 1..25: note = Seed: VKLQTVHSIPLTINKEEALQRPVAS
VKLQTVHSIPFTIEKYEAWQRPVAS

SEQ ID NO: 53949 - protein, 25 aa, synthetic construct
  source 1..25: note = Seed: VKLQTVHSIPLTINKEEALQRPVAS
VKLQTVHSIPFTIEKYEAYQRPVAS

SEQ ID NO: 53950 - protein, 25 aa, synthetic construct
  source 1..25: note = Seed: VKLQTVHSIPLTINKEEALQRPVAS
VKLQTVHSIPFTIFKAEAAQRPVAS

SEQ ID NO: 53951 - protein, 25 aa, synthetic construct
  source 1..25: note = Seed: VKLQTVHSIPLTINKEEALQRPVAS
VKLQTVHSIPFTIFKAEACQRPVAS

SEQ ID NO: 53952 - protein, 25 aa, synthetic construct
  source 1..25: note = Seed: VKLQTVHSIPLTINKEEALQRPVAS
VKLQTVHSIPFTIFKAEADQRPVAS

SEQ ID NO: 53953 - protein, 25 aa, synthetic construct
  source 1..25: note = Seed: VKLQTVHSIPLTINKEEALQRPVAS
VKLQTVHSIPFTIFKAEAEQRPVAS

SEQ ID NO: 53954 - protein, 25 aa, synthetic construct
  source 1..25: note = Seed: VKLQTVHSIPLTINKEEALQRPVAS
VKLQTVHSIPFTIFKAEAFQRPVAS

SEQ ID NO: 53955 - protein, 25 aa, synthetic construct
  source 1..25: note = Seed: VKLQTVHSIPLTINKEEALQRPVAS
VKLQTVHSIPFTIFKAEAGQRPVAS

SEQ ID NO: 53956 - protein, 25 aa, synthetic construct
  source 1..25: note = Seed: VKLQTVHSIPLTINKEEALQRPVAS
VKLQTVHSIPFTIFKAEAIQRPVAS

SEQ ID NO: 53957 - protein, 25 aa, synthetic construct
  source 1..25: note = Seed: VKLQTVHSIPLTINKEEALQRPVAS
VKLQTVHSIPFTIFKAEALQRPVAS

SEQ ID NO: 53958 - protein, 25 aa, synthetic construct
  source 1..25: note = Seed: VKLQTVHSIPLTINKEEALQRPVAS
VKLQTVHSIPFTIFKAEAMQRPVAS

SEQ ID NO: 53959 - protein, 25 aa, synthetic construct
  source 1..25: note = Seed: VKLQTVHSIPLTINKEEALQRPVAS
VKLQTVHSIPFTIFKAEANQRPVAS

SEQ ID NO: 53960 - protein, 25 aa, synthetic construct
  source 1..25: note = Seed: VKLQTVHSIPLTINKEEALQRPVAS
VKLQTVHSIPFTIFKAEAQQRPVAS

SEQ ID NO: 53961 - protein, 25 aa, synthetic construct
  source 1..25: note = Seed: VKLQTVHSIPLTINKEEALQRPVAS
VKLQTVHSIPFTIFKAEARQRPVAS

SEQ ID NO: 53962 - protein, 25 aa, synthetic construct
  source 1..25: note = Seed: VKLQTVHSIPLTINKEEALQRPVAS
VKLQTVHSIPFTIFKAEASQRPVAS

SEQ ID NO: 53963 - protein, 25 aa, synthetic construct
  source 1..25: note = Seed: VKLQTVHSIPLTINKEEALQRPVAS
VKLQTVHSIPFTIFKAEATQRPVAS

SEQ ID NO: 53964 - protein, 25 aa, synthetic construct
  source 1..25: note = Seed: VKLQTVHSIPLTINKEEALQRPVAS
VKLQTVHSIPFTIFKAEAVQRPVAS

SEQ ID NO: 53965 - protein, 25 aa, synthetic construct
  source 1..25: note = Seed: VKLQTVHSIPLTINKEEALQRPVAS
VKLQTVHSIPFTIFKAEAWQRPVAS

SEQ ID NO: 53966 - protein, 25 aa, synthetic construct
  source 1..25: note = Seed: VKLQTVHSIPLTINKEEALQRPVAS
VKLQTVHSIPFTIFKAEAYQRPVAS

SEQ ID NO: 53967 - protein, 25 aa, synthetic construct
  source 1..25: note = Seed: VKLQTVHSIPLTINKEEALQRPVAS
VKLQTVHSIPFTIFKCEAIQRPVAS

SEQ ID NO: 53968 - protein, 25 aa, synthetic construct
  source 1..25: note = Seed: VKLQTVHSIPLTINKEEALQRPVAS
VKLQTVHSIPFTIFKCEALQRPVAS

SEQ ID NO: 53969 - protein, 25 aa, synthetic construct
  source 1..25: note = Seed: VKLQTVHSIPLTINKEEALQRPVAS
VKLQTVHSIPFTIFKCEAMQRPVAS

SEQ ID NO: 53970 - protein, 25 aa, synthetic construct
  source 1..25: note = Seed: VKLQTVHSIPLTINKEEALQRPVAS
VKLQTVHSIPFTIFKCEAVQRPVAS

SEQ ID NO: 53971 - protein, 25 aa, synthetic construct
  source 1..25: note = Seed: VKLQTVHSIPLTINKEEALQRPVAS
VKLQTVHSIPFTIFKCEAYQRPVAS

SEQ ID NO: 53972 - protein, 25 aa, synthetic construct
  source 1..25: note = Seed: VKLQTVHSIPLTINKEEALQRPVAS
VKLQTVHSIPFTIFKDEAAQRPVAS

SEQ ID NO: 53973 - protein, 25 aa, synthetic construct
  source 1..25: note = Seed: VKLQTVHSIPLTINKEEALQRPVAS
VKLQTVHSIPFTIFKDEAFQRPVAS

SEQ ID NO: 53974 - protein, 25 aa, synthetic construct
  source 1..25: note = Seed: VKLQTVHSIPLTINKEEALQRPVAS
VKLQTVHSIPFTIFKDEAIQRPVAS

SEQ ID NO: 53975 - protein, 25 aa, synthetic construct
  source 1..25: note = Seed: VKLQTVHSIPLTINKEEALQRPVAS
VKLQTVHSIPFTIFKDEALQRPVAS

SEQ ID NO: 53976 - protein, 25 aa, synthetic construct
  source 1..25: note = Seed: VKLQTVHSIPLTINKEEALQRPVAS
VKLQTVHSIPFTIFKDEAMQRPVAS

SEQ ID NO: 53977 - protein, 25 aa, synthetic construct
  source 1..25: note = Seed: VKLQTVHSIPLTINKEEALQRPVAS
VKLQTVHSIPFTIFKDEASQRPVAS

SEQ ID NO: 53978 - protein, 25 aa, synthetic construct
  source 1..25: note = Seed: VKLQTVHSIPLTINKEEALQRPVAS
VKLQTVHSIPFTIFKDEATQRPVAS

SEQ ID NO: 53979 - protein, 25 aa, synthetic construct
  source 1..25: note = Seed: VKLQTVHSIPLTINKEEALQRPVAS
VKLQTVHSIPFTIFKDEAVQRPVAS

SEQ ID NO: 53980 - protein, 25 aa, synthetic construct
  source 1..25: note = Seed: VKLQTVHSIPLTINKEEALQRPVAS
VKLQTVHSIPFTIFKDEAYQRPVAS

SEQ ID NO: 53981 - protein, 25 aa, synthetic construct
  source 1..25: note = Seed: VKLQTVHSIPLTINKEEALQRPVAS
VKLQTVHSIPFTIFKEEAAQRPVAS

SEQ ID NO: 53982 - protein, 25 aa, synthetic construct
  source 1..25: note = Seed: VKLQTVHSIPLTINKEEALQRPVAS
VKLQTVHSIPFTIFKEEAFQRPVAS

SEQ ID NO: 53983 - protein, 25 aa, synthetic construct
  source 1..25: note = Seed: VKLQTVHSIPLTINKEEALQRPVAS
VKLQTVHSIPFTIFKEEAIQRPVAS

SEQ ID NO: 53984 - protein, 25 aa, synthetic construct
  source 1..25: note = Seed: VKLQTVHSIPLTINKEEALQRPVAS
VKLQTVHSIPFTIFKEEALQRPVAS

SEQ ID NO: 53985 - protein, 25 aa, synthetic construct
  source 1..25: note = Seed: VKLQTVHSIPLTINKEEALQRPVAS
VKLQTVHSIPFTIFKEEAMQRPVAS

SEQ ID NO: 53986 - protein, 25 aa, synthetic construct
  source 1..25: note = Seed: VKLQTVHSIPLTINKEEALQRPVAS
VKLQTVHSIPFTIFKEEAVQRPVAS

SEQ ID NO: 53987 - protein, 25 aa, synthetic construct
  source 1..25: note = Seed: VKLQTVHSIPLTINKEEALQRPVAS
VKLQTVHSIPFTIFKEEAYQRPVAS

SEQ ID NO: 53988 - protein, 25 aa, synthetic construct
  source 1..25: note = Seed: VKLQTVHSIPLTINKEEALQRPVAS
VKLQTVHSIPFTIFKFEAAQRPVAS

SEQ ID NO: 53989 - protein, 25 aa, synthetic construct
  source 1..25: note = Seed: VKLQTVHSIPLTINKEEALQRPVAS
VKLQTVHSIPFTIFKFEACQRPVAS

SEQ ID NO: 53990 - protein, 25 aa, synthetic construct
  source 1..25: note = Seed: VKLQTVHSIPLTINKEEALQRPVAS
VKLQTVHSIPFTIFKFEADQRPVAS

SEQ ID NO: 53991 - protein, 25 aa, synthetic construct
  source 1..25: note = Seed: VKLQTVHSIPLTINKEEALQRPVAS
VKLQTVHSIPFTIFKFEAEQRPVAS

SEQ ID NO: 53992 - protein, 25 aa, synthetic construct
  source 1..25: note = Seed: VKLQTVHSIPLTINKEEALQRPVAS
VKLQTVHSIPFTIFKFEAFQRPVAS

SEQ ID NO: 53993 - protein, 25 aa, synthetic construct
  source 1..25: note = Seed: VKLQTVHSIPLTINKEEALQRPVAS
VKLQTVHSIPFTIFKFEAGQRPVAS

SEQ ID NO: 53994 - protein, 25 aa, synthetic construct
  source 1..25: note = Seed: VKLQTVHSIPLTINKEEALQRPVAS
VKLQTVHSIPFTIFKFEAHQRPVAS

SEQ ID NO: 53995 - protein, 25 aa, synthetic construct
  source 1..25: note = Seed: VKLQTVHSIPLTINKEEALQRPVAS
VKLQTVHSIPFTIFKFEAIQRPVAS

SEQ ID NO: 53996 - protein, 25 aa, synthetic construct
  source 1..25: note = Seed: VKLQTVHSIPLTINKEEALQRPVAS
VKLQTVHSIPFTIFKFEAKQRPVAS

SEQ ID NO: 53997 - protein, 25 aa, synthetic construct
  source 1..25: note = Seed: VKLQTVHSIPLTINKEEALQRPVAS
VKLQTVHSIPFTIFKFEALQRPVAS

SEQ ID NO: 53998 - protein, 25 aa, synthetic construct
  source 1..25: note = Seed: VKLQTVHSIPLTINKEEALQRPVAS
VKLQTVHSIPFTIFKFEAMQRPVAS

SEQ ID NO: 53999 - protein, 25 aa, synthetic construct
  source 1..25: note = Seed: VKLQTVHSIPLTINKEEALQRPVAS
VKLQTVHSIPFTIFKFEANQRPVAS

SEQ ID NO: 54000 - protein, 25 aa, synthetic construct
  source 1..25: note = Seed: VKLQTVHSIPLTINKEEALQRPVAS
VKLQTVHSIPFTIFKFEAPQRPVAS

SEQ ID NO: 54001 - protein, 25 aa, synthetic construct
  source 1..25: note = Seed: VKLQTVHSIPLTINKEEALQRPVAS
VKLQTVHSIPFTIFKFEAQQRPVAS

SEQ ID NO: 54002 - protein, 25 aa, synthetic construct
  source 1..25: note = Seed: VKLQTVHSIPLTINKEEALQRPVAS
VKLQTVHSIPFTIFKFEARQRPVAS

SEQ ID NO: 54003 - protein, 25 aa, synthetic construct
  source 1..25: note = Seed: VKLQTVHSIPLTINKEEALQRPVAS
VKLQTVHSIPFTIFKFEASQRPVAS

SEQ ID NO: 54004 - protein, 25 aa, synthetic construct
  source 1..25: note = Seed: VKLQTVHSIPLTINKEEALQRPVAS
VKLQTVHSIPFTIFKFEATQRPVAS

SEQ ID NO: 54005 - protein, 25 aa, synthetic construct
  source 1..25: note = Seed: VKLQTVHSIPLTINKEEALQRPVAS
VKLQTVHSIPFTIFKFEAVQRPVAS

SEQ ID NO: 54006 - protein, 25 aa, synthetic construct
  source 1..25: note = Seed: VKLQTVHSIPLTINKEEALQRPVAS
VKLQTVHSIPFTIFKFEAWQRPVAS

SEQ ID NO: 54007 - protein, 25 aa, synthetic construct
  source 1..25: note = Seed: VKLQTVHSIPLTINKEEALQRPVAS
VKLQTVHSIPFTIFKFEAYQRPVAS

SEQ ID NO: 54008 - protein, 25 aa, synthetic construct
  source 1..25: note = Seed: VKLQTVHSIPLTINKEEALQRPVAS
VKLQTVHSIPFTIFKGEAAQRPVAS

SEQ ID NO: 54009 - protein, 25 aa, synthetic construct
  source 1..25: note = Seed: VKLQTVHSIPLTINKEEALQRPVAS
VKLQTVHSIPFTIFKGEAIQRPVAS

SEQ ID NO: 54010 - protein, 25 aa, synthetic construct
  source 1..25: note = Seed: VKLQTVHSIPLTINKEEALQRPVAS
VKLQTVHSIPFTIFKGEALQRPVAS

SEQ ID NO: 54011 - protein, 25 aa, synthetic construct
  source 1..25: note = Seed: VKLQTVHSIPLTINKEEALQRPVAS
VKLQTVHSIPFTIFKGEAMQRPVAS

SEQ ID NO: 54012 - protein, 25 aa, synthetic construct
  source 1..25: note = Seed: VKLQTVHSIPLTINKEEALQRPVAS
VKLQTVHSIPFTIFKGEATQRPVAS

SEQ ID NO: 54013 - protein, 25 aa, synthetic construct
  source 1..25: note = Seed: VKLQTVHSIPLTINKEEALQRPVAS
VKLQTVHSIPFTIFKGEAVQRPVAS

SEQ ID NO: 54014 - protein, 25 aa, synthetic construct
  source 1..25: note = Seed: VKLQTVHSIPLTINKEEALQRPVAS
VKLQTVHSIPFTIFKGEAYQRPVAS

SEQ ID NO: 54015 - protein, 25 aa, synthetic construct
  source 1..25: note = Seed: VKLQTVHSIPLTINKEEALQRPVAS
VKLQTVHSIPFTIFKHEAAQRPVAS

SEQ ID NO: 54016 - protein, 25 aa, synthetic construct
  source 1..25: note = Seed: VKLQTVHSIPLTINKEEALQRPVAS
VKLQTVHSIPFTIFKHEADQRPVAS

SEQ ID NO: 54017 - protein, 25 aa, synthetic construct
  source 1..25: note = Seed: VKLQTVHSIPLTINKEEALQRPVAS
VKLQTVHSIPFTIFKHEAEQRPVAS

SEQ ID NO: 54018 - protein, 25 aa, synthetic construct
  source 1..25: note = Seed: VKLQTVHSIPLTINKEEALQRPVAS
VKLQTVHSIPFTIFKHEAFQRPVAS

SEQ ID NO: 54019 - protein, 25 aa, synthetic construct
  source 1..25: note = Seed: VKLQTVHSIPLTINKEEALQRPVAS
VKLQTVHSIPFTIFKHEAIQRPVAS

SEQ ID NO: 54020 - protein, 25 aa, synthetic construct
  source 1..25: note = Seed: VKLQTVHSIPLTINKEEALQRPVAS
VKLQTVHSIPFTIFKHEALQRPVAS

SEQ ID NO: 54021 - protein, 25 aa, synthetic construct
  source 1..25: note = Seed: VKLQTVHSIPLTINKEEALQRPVAS
VKLQTVHSIPFTIFKHEAMQRPVAS

SEQ ID NO: 54022 - protein, 25 aa, synthetic construct
  source 1..25: note = Seed: VKLQTVHSIPLTINKEEALQRPVAS
VKLQTVHSIPFTIFKHEANQRPVAS

SEQ ID NO: 54023 - protein, 25 aa, synthetic construct
  source 1..25: note = Seed: VKLQTVHSIPLTINKEEALQRPVAS
VKLQTVHSIPFTIFKHEAQQRPVAS

SEQ ID NO: 54024 - protein, 25 aa, synthetic construct
  source 1..25: note = Seed: VKLQTVHSIPLTINKEEALQRPVAS
VKLQTVHSIPFTIFKHEATQRPVAS

SEQ ID NO: 54025 - protein, 25 aa, synthetic construct
  source 1..25: note = Seed: VKLQTVHSIPLTINKEEALQRPVAS
VKLQTVHSIPFTIFKHEAVQRPVAS

SEQ ID NO: 54026 - protein, 25 aa, synthetic construct
  source 1..25: note = Seed: VKLQTVHSIPLTINKEEALQRPVAS
VKLQTVHSIPFTIFKHEAYQRPVAS

SEQ ID NO: 54027 - protein, 25 aa, synthetic construct
  source 1..25: note = Seed: VKLQTVHSIPLTINKEEALQRPVAS
VKLQTVHSIPFTIFKIEAAQRPVAS

SEQ ID NO: 54028 - protein, 25 aa, synthetic construct
  source 1..25: note = Seed: VKLQTVHSIPLTINKEEALQRPVAS
VKLQTVHSIPFTIFKIEACQRPVAS

SEQ ID NO: 54029 - protein, 25 aa, synthetic construct
  source 1..25: note = Seed: VKLQTVHSIPLTINKEEALQRPVAS
VKLQTVHSIPFTIFKIEADQRPVAS

SEQ ID NO: 54030 - protein, 25 aa, synthetic construct
  source 1..25: note = Seed: VKLQTVHSIPLTINKEEALQRPVAS
VKLQTVHSIPFTIFKIEAEQRPVAS

SEQ ID NO: 54031 - protein, 25 aa, synthetic construct
  source 1..25: note = Seed: VKLQTVHSIPLTINKEEALQRPVAS
VKLQTVHSIPFTIFKIEAFQRPVAS

SEQ ID NO: 54032 - protein, 25 aa, synthetic construct
  source 1..25: note = Seed: VKLQTVHSIPLTINKEEALQRPVAS
VKLQTVHSIPFTIFKIEAGQRPVAS

SEQ ID NO: 54033 - protein, 25 aa, synthetic construct
  source 1..25: note = Seed: VKLQTVHSIPLTINKEEALQRPVAS
VKLQTVHSIPFTIFKIEAHQRPVAS

SEQ ID NO: 54034 - protein, 25 aa, synthetic construct
  source 1..25: note = Seed: VKLQTVHSIPLTINKEEALQRPVAS
VKLQTVHSIPFTIFKIEAIQRPVAS

SEQ ID NO: 54035 - protein, 25 aa, synthetic construct
  source 1..25: note = Seed: VKLQTVHSIPLTINKEEALQRPVAS
VKLQTVHSIPFTIFKIEAKQRPVAS

SEQ ID NO: 54036 - protein, 25 aa, synthetic construct
  source 1..25: note = Seed: VKLQTVHSIPLTINKEEALQRPVAS
VKLQTVHSIPFTIFKIEALQRPVAS

SEQ ID NO: 54037 - protein, 25 aa, synthetic construct
  source 1..25: note = Seed: VKLQTVHSIPLTINKEEALQRPVAS
VKLQTVHSIPFTIFKIEAMQRPVAS

SEQ ID NO: 54038 - protein, 25 aa, synthetic construct
  source 1..25: note = Seed: VKLQTVHSIPLTINKEEALQRPVAS
VKLQTVHSIPFTIFKIEANQRPVAS

SEQ ID NO: 54039 - protein, 25 aa, synthetic construct
  source 1..25: note = Seed: VKLQTVHSIPLTINKEEALQRPVAS
VKLQTVHSIPFTIFKIEAPQRPVAS

SEQ ID NO: 54040 - protein, 25 aa, synthetic construct
  source 1..25: note = Seed: VKLQTVHSIPLTINKEEALQRPVAS
VKLQTVHSIPFTIFKIEAQQRPVAS

SEQ ID NO: 54041 - protein, 25 aa, synthetic construct
  source 1..25: note = Seed: VKLQTVHSIPLTINKEEALQRPVAS
VKLQTVHSIPFTIFKIEARQRPVAS

SEQ ID NO: 54042 - protein, 25 aa, synthetic construct
  source 1..25: note = Seed: VKLQTVHSIPLTINKEEALQRPVAS
VKLQTVHSIPFTIFKIEASQRPVAS

SEQ ID NO: 54043 - protein, 25 aa, synthetic construct
  source 1..25: note = Seed: VKLQTVHSIPLTINKEEALQRPVAS
VKLQTVHSIPFTIFKIEATQRPVAS

SEQ ID NO: 54044 - protein, 25 aa, synthetic construct
  source 1..25: note = Seed: VKLQTVHSIPLTINKEEALQRPVAS
VKLQTVHSIPFTIFKIEAVQRPVAS

SEQ ID NO: 54045 - protein, 25 aa, synthetic construct
  source 1..25: note = Seed: VKLQTVHSIPLTINKEEALQRPVAS
VKLQTVHSIPFTIFKIEAYQRPVAS

SEQ ID NO: 54046 - protein, 25 aa, synthetic construct
  source 1..25: note = Seed: VKLQTVHSIPLTINKEEALQRPVAS
VKLQTVHSIPFTIFKKEAAQRPVAS

SEQ ID NO: 54047 - protein, 25 aa, synthetic construct
  source 1..25: note = Seed: VKLQTVHSIPLTINKEEALQRPVAS
VKLQTVHSIPFTIFKKEAFQRPVAS

SEQ ID NO: 54048 - protein, 25 aa, synthetic construct
  source 1..25: note = Seed: VKLQTVHSIPLTINKEEALQRPVAS
VKLQTVHSIPFTIFKKEAIQRPVAS

SEQ ID NO: 54049 - protein, 25 aa, synthetic construct
  source 1..25: note = Seed: VKLQTVHSIPLTINKEEALQRPVAS
VKLQTVHSIPFTIFKKEALQRPVAS

SEQ ID NO: 54050 - protein, 25 aa, synthetic construct
  source 1..25: note = Seed: VKLQTVHSIPLTINKEEALQRPVAS
VKLQTVHSIPFTIFKKEAMQRPVAS

SEQ ID NO: 54051 - protein, 25 aa, synthetic construct
  source 1..25: note = Seed: VKLQTVHSIPLTINKEEALQRPVAS
VKLQTVHSIPFTIFKKEARQRPVAS

SEQ ID NO: 54052 - protein, 25 aa, synthetic construct
  source 1..25: note = Seed: VKLQTVHSIPLTINKEEALQRPVAS
VKLQTVHSIPFTIFKKEAVQRPVAS

SEQ ID NO: 54053 - protein, 25 aa, synthetic construct
  source 1..25: note = Seed: VKLQTVHSIPLTINKEEALQRPVAS
VKLQTVHSIPFTIFKKEAYQRPVAS

SEQ ID NO: 54054 - protein, 25 aa, synthetic construct
  source 1..25: note = Seed: VKLQTVHSIPLTINKEEALQRPVAS
VKLQTVHSIPFTIFKLEAAQRPVAS

SEQ ID NO: 54055 - protein, 25 aa, synthetic construct
  source 1..25: note = Seed: VKLQTVHSIPLTINKEEALQRPVAS
VKLQTVHSIPFTIFKLEACQRPVAS

SEQ ID NO: 54056 - protein, 25 aa, synthetic construct
  source 1..25: note = Seed: VKLQTVHSIPLTINKEEALQRPVAS
VKLQTVHSIPFTIFKLEADQRPVAS

SEQ ID NO: 54057 - protein, 25 aa, synthetic construct
  source 1..25: note = Seed: VKLQTVHSIPLTINKEEALQRPVAS
VKLQTVHSIPFTIFKLEAEQRPVAS

SEQ ID NO: 54058 - protein, 25 aa, synthetic construct
  source 1..25: note = Seed: VKLQTVHSIPLTINKEEALQRPVAS
VKLQTVHSIPFTIFKLEAFQRPVAS

SEQ ID NO: 54059 - protein, 25 aa, synthetic construct
  source 1..25: note = Seed: VKLQTVHSIPLTINKEEALQRPVAS
VKLQTVHSIPFTIFKLEAGQRPVAS

SEQ ID NO: 54060 - protein, 25 aa, synthetic construct
  source 1..25: note = Seed: VKLQTVHSIPLTINKEEALQRPVAS
VKLQTVHSIPFTIFKLEAHQRPVAS

SEQ ID NO: 54061 - protein, 25 aa, synthetic construct
  source 1..25: note = Seed: VKLQTVHSIPLTINKEEALQRPVAS
VKLQTVHSIPFTIFKLEAIQRPVAS

SEQ ID NO: 54062 - protein, 25 aa, synthetic construct
  source 1..25: note = Seed: VKLQTVHSIPLTINKEEALQRPVAS
VKLQTVHSIPFTIFKLEAKQRPVAS

SEQ ID NO: 54063 - protein, 25 aa, synthetic construct
  source 1..25: note = Seed: VKLQTVHSIPLTINKEEALQRPVAS
VKLQTVHSIPFTIFKLEALQRPVAS

SEQ ID NO: 54064 - protein, 25 aa, synthetic construct
  source 1..25: note = Seed: VKLQTVHSIPLTINKEEALQRPVAS
VKLQTVHSIPFTIFKLEAMQRPVAS

SEQ ID NO: 54065 - protein, 25 aa, synthetic construct
  source 1..25: note = Seed: VKLQTVHSIPLTINKEEALQRPVAS
VKLQTVHSIPFTIFKLEANQRPVAS

SEQ ID NO: 54066 - protein, 25 aa, synthetic construct
  source 1..25: note = Seed: VKLQTVHSIPLTINKEEALQRPVAS
VKLQTVHSIPFTIFKLEAPQRPVAS

SEQ ID NO: 54067 - protein, 25 aa, synthetic construct
  source 1..25: note = Seed: VKLQTVHSIPLTINKEEALQRPVAS
VKLQTVHSIPFTIFKLEAQQRPVAS

SEQ ID NO: 54068 - protein, 25 aa, synthetic construct
  source 1..25: note = Seed: VKLQTVHSIPLTINKEEALQRPVAS
VKLQTVHSIPFTIFKLEARQRPVAS

SEQ ID NO: 54069 - protein, 25 aa, synthetic construct
  source 1..25: note = Seed: VKLQTVHSIPLTINKEEALQRPVAS
VKLQTVHSIPFTIFKLEASQRPVAS

SEQ ID NO: 54070 - protein, 25 aa, synthetic construct
  source 1..25: note = Seed: VKLQTVHSIPLTINKEEALQRPVAS
VKLQTVHSIPFTIFKLEATQRPVAS

SEQ ID NO: 54071 - protein, 25 aa, synthetic construct
  source 1..25: note = Seed: VKLQTVHSIPLTINKEEALQRPVAS
VKLQTVHSIPFTIFKLEAVQRPVAS

SEQ ID NO: 54072 - protein, 25 aa, synthetic construct
  source 1..25: note = Seed: VKLQTVHSIPLTINKEEALQRPVAS
VKLQTVHSIPFTIFKLEAYQRPVAS

SEQ ID NO: 54073 - protein, 25 aa, synthetic construct
  source 1..25: note = Seed: VKLQTVHSIPLTINKEEALQRPVAS
VKLQTVHSIPFTIFKMEAAQRPVAS

SEQ ID NO: 54074 - protein, 25 aa, synthetic construct
  source 1..25: note = Seed: VKLQTVHSIPLTINKEEALQRPVAS
VKLQTVHSIPFTIFKMEACQRPVAS

SEQ ID NO: 54075 - protein, 25 aa, synthetic construct
  source 1..25: note = Seed: VKLQTVHSIPLTINKEEALQRPVAS
VKLQTVHSIPFTIFKMEADQRPVAS

SEQ ID NO: 54076 - protein, 25 aa, synthetic construct
  source 1..25: note = Seed: VKLQTVHSIPLTINKEEALQRPVAS
VKLQTVHSIPFTIFKMEAEQRPVAS

SEQ ID NO: 54077 - protein, 25 aa, synthetic construct
  source 1..25: note = Seed: VKLQTVHSIPLTINKEEALQRPVAS
VKLQTVHSIPFTIFKMEAFQRPVAS

SEQ ID NO: 54078 - protein, 25 aa, synthetic construct
  source 1..25: note = Seed: VKLQTVHSIPLTINKEEALQRPVAS
VKLQTVHSIPFTIFKMEAGQRPVAS

SEQ ID NO: 54079 - protein, 25 aa, synthetic construct
  source 1..25: note = Seed: VKLQTVHSIPLTINKEEALQRPVAS
VKLQTVHSIPFTIFKMEAHQRPVAS

SEQ ID NO: 54080 - protein, 25 aa, synthetic construct
  source 1..25: note = Seed: VKLQTVHSIPLTINKEEALQRPVAS
VKLQTVHSIPFTIFKMEAIQRPVAS

SEQ ID NO: 54081 - protein, 25 aa, synthetic construct
  source 1..25: note = Seed: VKLQTVHSIPLTINKEEALQRPVAS
VKLQTVHSIPFTIFKMEAKQRPVAS

SEQ ID NO: 54082 - protein, 25 aa, synthetic construct
  source 1..25: note = Seed: VKLQTVHSIPLTINKEEALQRPVAS
VKLQTVHSIPFTIFKMEALQRPVAS

SEQ ID NO: 54083 - protein, 25 aa, synthetic construct
  source 1..25: note = Seed: VKLQTVHSIPLTINKEEALQRPVAS
VKLQTVHSIPFTIFKMEAMQRPVAS

SEQ ID NO: 54084 - protein, 25 aa, synthetic construct
  source 1..25: note = Seed: VKLQTVHSIPLTINKEEALQRPVAS
VKLQTVHSIPFTIFKMEANQRPVAS

SEQ ID NO: 54085 - protein, 25 aa, synthetic construct
  source 1..25: note = Seed: VKLQTVHSIPLTINKEEALQRPVAS
VKLQTVHSIPFTIFKMEAPQRPVAS

SEQ ID NO: 54086 - protein, 25 aa, synthetic construct
  source 1..25: note = Seed: VKLQTVHSIPLTINKEEALQRPVAS
VKLQTVHSIPFTIFKMEAQQRPVAS

SEQ ID NO: 54087 - protein, 25 aa, synthetic construct
  source 1..25: note = Seed: VKLQTVHSIPLTINKEEALQRPVAS
VKLQTVHSIPFTIFKMEARQRPVAS

SEQ ID NO: 54088 - protein, 25 aa, synthetic construct
  source 1..25: note = Seed: VKLQTVHSIPLTINKEEALQRPVAS
VKLQTVHSIPFTIFKMEASQRPVAS

SEQ ID NO: 54089 - protein, 25 aa, synthetic construct
  source 1..25: note = Seed: VKLQTVHSIPLTINKEEALQRPVAS
VKLQTVHSIPFTIFKMEATQRPVAS

SEQ ID NO: 54090 - protein, 25 aa, synthetic construct
  source 1..25: note = Seed: VKLQTVHSIPLTINKEEALQRPVAS
VKLQTVHSIPFTIFKMEAVQRPVAS

SEQ ID NO: 54091 - protein, 25 aa, synthetic construct
  source 1..25: note = Seed: VKLQTVHSIPLTINKEEALQRPVAS
VKLQTVHSIPFTIFKMEAYQRPVAS

SEQ ID NO: 54092 - protein, 25 aa, synthetic construct
  source 1..25: note = Seed: VKLQTVHSIPLTINKEEALQRPVAS
VKLQTVHSIPFTIFKNEAAQRPVAS

SEQ ID NO: 54093 - protein, 25 aa, synthetic construct
  source 1..25: note = Seed: VKLQTVHSIPLTINKEEALQRPVAS
VKLQTVHSIPFTIFKNEADQRPVAS

SEQ ID NO: 54094 - protein, 25 aa, synthetic construct
  source 1..25: note = Seed: VKLQTVHSIPLTINKEEALQRPVAS
VKLQTVHSIPFTIFKNEAEQRPVAS

SEQ ID NO: 54095 - protein, 25 aa, synthetic construct
  source 1..25: note = Seed: VKLQTVHSIPLTINKEEALQRPVAS
VKLQTVHSIPFTIFKNEAFQRPVAS

SEQ ID NO: 54096 - protein, 25 aa, synthetic construct
  source 1..25: note = Seed: VKLQTVHSIPLTINKEEALQRPVAS
VKLQTVHSIPFTIFKNEAIQRPVAS

SEQ ID NO: 54097 - protein, 25 aa, synthetic construct
  source 1..25: note = Seed: VKLQTVHSIPLTINKEEALQRPVAS
VKLQTVHSIPFTIFKNEALQRPVAS

SEQ ID NO: 54098 - protein, 25 aa, synthetic construct
  source 1..25: note = Seed: VKLQTVHSIPLTINKEEALQRPVAS
VKLQTVHSIPFTIFKNEAMQRPVAS

SEQ ID NO: 54099 - protein, 25 aa, synthetic construct
  source 1..25: note = Seed: VKLQTVHSIPLTINKEEALQRPVAS
VKLQTVHSIPFTIFKNEASQRPVAS

SEQ ID NO: 54100 - protein, 25 aa, synthetic construct
  source 1..25: note = Seed: VKLQTVHSIPLTINKEEALQRPVAS
VKLQTVHSIPFTIFKNEATQRPVAS

SEQ ID NO: 54101 - protein, 25 aa, synthetic construct
  source 1..25: note = Seed: VKLQTVHSIPLTINKEEALQRPVAS
VKLQTVHSIPFTIFKNEAVQRPVAS

SEQ ID NO: 54102 - protein, 25 aa, synthetic construct
  source 1..25: note = Seed: VKLQTVHSIPLTINKEEALQRPVAS
VKLQTVHSIPFTIFKNEAYQRPVAS

SEQ ID NO: 54103 - protein, 25 aa, synthetic construct
  source 1..25: note = Seed: VKLQTVHSIPLTINKEEALQRPVAS
VKLQTVHSIPFTIFKPEAAQRPVAS

SEQ ID NO: 54104 - protein, 25 aa, synthetic construct
  source 1..25: note = Seed: VKLQTVHSIPLTINKEEALQRPVAS
VKLQTVHSIPFTIFKPEACQRPVAS

SEQ ID NO: 54105 - protein, 25 aa, synthetic construct
  source 1..25: note = Seed: VKLQTVHSIPLTINKEEALQRPVAS
VKLQTVHSIPFTIFKPEADQRPVAS

SEQ ID NO: 54106 - protein, 25 aa, synthetic construct
  source 1..25: note = Seed: VKLQTVHSIPLTINKEEALQRPVAS
VKLQTVHSIPFTIFKPEAEQRPVAS

SEQ ID NO: 54107 - protein, 25 aa, synthetic construct
  source 1..25: note = Seed: VKLQTVHSIPLTINKEEALQRPVAS
VKLQTVHSIPFTIFKPEAFQRPVAS

SEQ ID NO: 54108 - protein, 25 aa, synthetic construct
  source 1..25: note = Seed: VKLQTVHSIPLTINKEEALQRPVAS
VKLQTVHSIPFTIFKPEAIQRPVAS

SEQ ID NO: 54109 - protein, 25 aa, synthetic construct
  source 1..25: note = Seed: VKLQTVHSIPLTINKEEALQRPVAS
VKLQTVHSIPFTIFKPEALQRPVAS

SEQ ID NO: 54110 - protein, 25 aa, synthetic construct
  source 1..25: note = Seed: VKLQTVHSIPLTINKEEALQRPVAS
VKLQTVHSIPFTIFKPEAMQRPVAS

SEQ ID NO: 54111 - protein, 25 aa, synthetic construct
  source 1..25: note = Seed: VKLQTVHSIPLTINKEEALQRPVAS
VKLQTVHSIPFTIFKPEANQRPVAS

SEQ ID NO: 54112 - protein, 25 aa, synthetic construct
  source 1..25: note = Seed: VKLQTVHSIPLTINKEEALQRPVAS
VKLQTVHSIPFTIFKPEASQRPVAS

SEQ ID NO: 54113 - protein, 25 aa, synthetic construct
  source 1..25: note = Seed: VKLQTVHSIPLTINKEEALQRPVAS
VKLQTVHSIPFTIFKPEATQRPVAS

SEQ ID NO: 54114 - protein, 25 aa, synthetic construct
  source 1..25: note = Seed: VKLQTVHSIPLTINKEEALQRPVAS
VKLQTVHSIPFTIFKPEAVQRPVAS

SEQ ID NO: 54115 - protein, 25 aa, synthetic construct
  source 1..25: note = Seed: VKLQTVHSIPLTINKEEALQRPVAS
VKLQTVHSIPFTIFKPEAYQRPVAS

SEQ ID NO: 54116 - protein, 25 aa, synthetic construct
  source 1..25: note = Seed: VKLQTVHSIPLTINKEEALQRPVAS
VKLQTVHSIPFTIFKQEAAQRPVAS

SEQ ID NO: 54117 - protein, 25 aa, synthetic construct
  source 1..25: note = Seed: VKLQTVHSIPLTINKEEALQRPVAS
VKLQTVHSIPFTIFKQEAFQRPVAS

SEQ ID NO: 54118 - protein, 25 aa, synthetic construct
  source 1..25: note = Seed: VKLQTVHSIPLTINKEEALQRPVAS
VKLQTVHSIPFTIFKQEAIQRPVAS

SEQ ID NO: 54119 - protein, 25 aa, synthetic construct
  source 1..25: note = Seed: VKLQTVHSIPLTINKEEALQRPVAS
VKLQTVHSIPFTIFKQEALQRPVAS

SEQ ID NO: 54120 - protein, 25 aa, synthetic construct
  source 1..25: note = Seed: VKLQTVHSIPLTINKEEALQRPVAS
VKLQTVHSIPFTIFKQEAMQRPVAS

SEQ ID NO: 54121 - protein, 25 aa, synthetic construct
  source 1..25: note = Seed: VKLQTVHSIPLTINKEEALQRPVAS
VKLQTVHSIPFTIFKQEATQRPVAS

SEQ ID NO: 54122 - protein, 25 aa, synthetic construct
  source 1..25: note = Seed: VKLQTVHSIPLTINKEEALQRPVAS
VKLQTVHSIPFTIFKQEAVQRPVAS

SEQ ID NO: 54123 - protein, 25 aa, synthetic construct
  source 1..25: note = Seed: VKLQTVHSIPLTINKEEALQRPVAS
VKLQTVHSIPFTIFKQEAYQRPVAS

SEQ ID NO: 54124 - protein, 25 aa, synthetic construct
  source 1..25: note = Seed: VKLQTVHSIPLTINKEEALQRPVAS
VKLQTVHSIPFTIFKREAAQRPVAS

SEQ ID NO: 54125 - protein, 25 aa, synthetic construct
  source 1..25: note = Seed: VKLQTVHSIPLTINKEEALQRPVAS
VKLQTVHSIPFTIFKREAEQRPVAS

SEQ ID NO: 54126 - protein, 25 aa, synthetic construct
  source 1..25: note = Seed: VKLQTVHSIPLTINKEEALQRPVAS
VKLQTVHSIPFTIFKREAFQRPVAS

SEQ ID NO: 54127 - protein, 25 aa, synthetic construct
  source 1..25: note = Seed: VKLQTVHSIPLTINKEEALQRPVAS
VKLQTVHSIPFTIFKREAIQRPVAS

SEQ ID NO: 54128 - protein, 25 aa, synthetic construct
  source 1..25: note = Seed: VKLQTVHSIPLTINKEEALQRPVAS
VKLQTVHSIPFTIFKREALQRPVAS

SEQ ID NO: 54129 - protein, 25 aa, synthetic construct
  source 1..25: note = Seed: VKLQTVHSIPLTINKEEALQRPVAS
VKLQTVHSIPFTIFKREAMQRPVAS

SEQ ID NO: 54130 - protein, 25 aa, synthetic construct
  source 1..25: note = Seed: VKLQTVHSIPLTINKEEALQRPVAS
VKLQTVHSIPFTIFKREAQQRPVAS

SEQ ID NO: 54131 - protein, 25 aa, synthetic construct
  source 1..25: note = Seed: VKLQTVHSIPLTINKEEALQRPVAS
VKLQTVHSIPFTIFKREARQRPVAS

SEQ ID NO: 54132 - protein, 25 aa, synthetic construct
  source 1..25: note = Seed: VKLQTVHSIPLTINKEEALQRPVAS
VKLQTVHSIPFTIFKREASQRPVAS

SEQ ID NO: 54133 - protein, 25 aa, synthetic construct
  source 1..25: note = Seed: VKLQTVHSIPLTINKEEALQRPVAS
VKLQTVHSIPFTIFKREAVQRPVAS

SEQ ID NO: 54134 - protein, 25 aa, synthetic construct
  source 1..25: note = Seed: VKLQTVHSIPLTINKEEALQRPVAS
VKLQTVHSIPFTIFKREAYQRPVAS

SEQ ID NO: 54135 - protein, 25 aa, synthetic construct
  source 1..25: note = Seed: VKLQTVHSIPLTINKEEALQRPVAS
VKLQTVHSIPFTIFKSEAAQRPVAS

SEQ ID NO: 54136 - protein, 25 aa, synthetic construct
  source 1..25: note = Seed: VKLQTVHSIPLTINKEEALQRPVAS
VKLQTVHSIPFTIFKSEADQRPVAS

SEQ ID NO: 54137 - protein, 25 aa, synthetic construct
  source 1..25: note = Seed: VKLQTVHSIPLTINKEEALQRPVAS
VKLQTVHSIPFTIFKSEAEQRPVAS

SEQ ID NO: 54138 - protein, 25 aa, synthetic construct
  source 1..25: note = Seed: VKLQTVHSIPLTINKEEALQRPVAS
VKLQTVHSIPFTIFKSEAFQRPVAS

SEQ ID NO: 54139 - protein, 25 aa, synthetic construct
  source 1..25: note = Seed: VKLQTVHSIPLTINKEEALQRPVAS
VKLQTVHSIPFTIFKSEAIQRPVAS

SEQ ID NO: 54140 - protein, 25 aa, synthetic construct
  source 1..25: note = Seed: VKLQTVHSIPLTINKEEALQRPVAS
VKLQTVHSIPFTIFKSEAMQRPVAS

SEQ ID NO: 54141 - protein, 25 aa, synthetic construct
  source 1..25: note = Seed: VKLQTVHSIPLTINKEEALQRPVAS
VKLQTVHSIPFTIFKSEAQQRPVAS

SEQ ID NO: 54142 - protein, 25 aa, synthetic construct
  source 1..25: note = Seed: VKLQTVHSIPLTINKEEALQRPVAS
VKLQTVHSIPFTIFKSEARQRPVAS

SEQ ID NO: 54143 - protein, 25 aa, synthetic construct
  source 1..25: note = Seed: VKLQTVHSIPLTINKEEALQRPVAS
VKLQTVHSIPFTIFKSEASQRPVAS

SEQ ID NO: 54144 - protein, 25 aa, synthetic construct
  source 1..25: note = Seed: VKLQTVHSIPLTINKEEALQRPVAS
VKLQTVHSIPFTIFKSEATQRPVAS

SEQ ID NO: 54145 - protein, 25 aa, synthetic construct
  source 1..25: note = Seed: VKLQTVHSIPLTINKEEALQRPVAS
VKLQTVHSIPFTIFKSEAVQRPVAS

SEQ ID NO: 54146 - protein, 25 aa, synthetic construct
  source 1..25: note = Seed: VKLQTVHSIPLTINKEEALQRPVAS
VKLQTVHSIPFTIFKSEAYQRPVAS

SEQ ID NO: 54147 - protein, 25 aa, synthetic construct
  source 1..25: note = Seed: VKLQTVHSIPLTINKEEALQRPVAS
VKLQTVHSIPFTIFKTEAAQRPVAS

SEQ ID NO: 54148 - protein, 25 aa, synthetic construct
  source 1..25: note = Seed: VKLQTVHSIPLTINKEEALQRPVAS
VKLQTVHSIPFTIFKTEADQRPVAS

SEQ ID NO: 54149 - protein, 25 aa, synthetic construct
  source 1..25: note = Seed: VKLQTVHSIPLTINKEEALQRPVAS
VKLQTVHSIPFTIFKTEAEQRPVAS

SEQ ID NO: 54150 - protein, 25 aa, synthetic construct
  source 1..25: note = Seed: VKLQTVHSIPLTINKEEALQRPVAS
VKLQTVHSIPFTIFKTEAFQRPVAS

SEQ ID NO: 54151 - protein, 25 aa, synthetic construct
  source 1..25: note = Seed: VKLQTVHSIPLTINKEEALQRPVAS
VKLQTVHSIPFTIFKTEAHQRPVAS

SEQ ID NO: 54152 - protein, 25 aa, synthetic construct
  source 1..25: note = Seed: VKLQTVHSIPLTINKEEALQRPVAS
VKLQTVHSIPFTIFKTEAIQRPVAS

SEQ ID NO: 54153 - protein, 25 aa, synthetic construct
  source 1..25: note = Seed: VKLQTVHSIPLTINKEEALQRPVAS
VKLQTVHSIPFTIFKTEALQRPVAS

SEQ ID NO: 54154 - protein, 25 aa, synthetic construct
  source 1..25: note = Seed: VKLQTVHSIPLTINKEEALQRPVAS
VKLQTVHSIPFTIFKTEAMQRPVAS

SEQ ID NO: 54155 - protein, 25 aa, synthetic construct
  source 1..25: note = Seed: VKLQTVHSIPLTINKEEALQRPVAS
VKLQTVHSIPFTIFKTEANQRPVAS

SEQ ID NO: 54156 - protein, 25 aa, synthetic construct
  source 1..25: note = Seed: VKLQTVHSIPLTINKEEALQRPVAS
VKLQTVHSIPFTIFKTEAQQRPVAS

SEQ ID NO: 54157 - protein, 25 aa, synthetic construct
  source 1..25: note = Seed: VKLQTVHSIPLTINKEEALQRPVAS
VKLQTVHSIPFTIFKTEARQRPVAS

SEQ ID NO: 54158 - protein, 25 aa, synthetic construct
  source 1..25: note = Seed: VKLQTVHSIPLTINKEEALQRPVAS
VKLQTVHSIPFTIFKTEASQRPVAS

SEQ ID NO: 54159 - protein, 25 aa, synthetic construct
  source 1..25: note = Seed: VKLQTVHSIPLTINKEEALQRPVAS
VKLQTVHSIPFTIFKTEATQRPVAS

SEQ ID NO: 54160 - protein, 25 aa, synthetic construct
  source 1..25: note = Seed: VKLQTVHSIPLTINKEEALQRPVAS
VKLQTVHSIPFTIFKTEAVQRPVAS

SEQ ID NO: 54161 - protein, 25 aa, synthetic construct
  source 1..25: note = Seed: VKLQTVHSIPLTINKEEALQRPVAS
VKLQTVHSIPFTIFKTEAYQRPVAS

SEQ ID NO: 54162 - protein, 25 aa, synthetic construct
  source 1..25: note = Seed: VKLQTVHSIPLTINKEEALQRPVAS
VKLQTVHSIPFTIFKVEAAQRPVAS

SEQ ID NO: 54163 - protein, 25 aa, synthetic construct
  source 1..25: note = Seed: VKLQTVHSIPLTINKEEALQRPVAS
VKLQTVHSIPFTIFKVEACQRPVAS

SEQ ID NO: 54164 - protein, 25 aa, synthetic construct
  source 1..25: note = Seed: VKLQTVHSIPLTINKEEALQRPVAS
VKLQTVHSIPFTIFKVEADQRPVAS

SEQ ID NO: 54165 - protein, 25 aa, synthetic construct
  source 1..25: note = Seed: VKLQTVHSIPLTINKEEALQRPVAS
VKLQTVHSIPFTIFKVEAEQRPVAS

SEQ ID NO: 54166 - protein, 25 aa, synthetic construct
  source 1..25: note = Seed: VKLQTVHSIPLTINKEEALQRPVAS
VKLQTVHSIPFTIFKVEAFQRPVAS

SEQ ID NO: 54167 - protein, 25 aa, synthetic construct
  source 1..25: note = Seed: VKLQTVHSIPLTINKEEALQRPVAS
VKLQTVHSIPFTIFKVEAGQRPVAS

SEQ ID NO: 54168 - protein, 25 aa, synthetic construct
  source 1..25: note = Seed: VKLQTVHSIPLTINKEEALQRPVAS
VKLQTVHSIPFTIFKVEAHQRPVAS

SEQ ID NO: 54169 - protein, 25 aa, synthetic construct
  source 1..25: note = Seed: VKLQTVHSIPLTINKEEALQRPVAS
VKLQTVHSIPFTIFKVEAIQRPVAS

SEQ ID NO: 54170 - protein, 25 aa, synthetic construct
  source 1..25: note = Seed: VKLQTVHSIPLTINKEEALQRPVAS
VKLQTVHSIPFTIFKVEAKQRPVAS

SEQ ID NO: 54171 - protein, 25 aa, synthetic construct
  source 1..25: note = Seed: VKLQTVHSIPLTINKEEALQRPVAS
VKLQTVHSIPFTIFKVEALQRPVAS

SEQ ID NO: 54172 - protein, 25 aa, synthetic construct
  source 1..25: note = Seed: VKLQTVHSIPLTINKEEALQRPVAS
VKLQTVHSIPFTIFKVEAMQRPVAS

SEQ ID NO: 54173 - protein, 25 aa, synthetic construct
  source 1..25: note = Seed: VKLQTVHSIPLTINKEEALQRPVAS
VKLQTVHSIPFTIFKVEANQRPVAS

SEQ ID NO: 54174 - protein, 25 aa, synthetic construct
  source 1..25: note = Seed: VKLQTVHSIPLTINKEEALQRPVAS
VKLQTVHSIPFTIFKVEAQQRPVAS

SEQ ID NO: 54175 - protein, 25 aa, synthetic construct
  source 1..25: note = Seed: VKLQTVHSIPLTINKEEALQRPVAS
VKLQTVHSIPFTIFKVEARQRPVAS

SEQ ID NO: 54176 - protein, 25 aa, synthetic construct
  source 1..25: note = Seed: VKLQTVHSIPLTINKEEALQRPVAS
VKLQTVHSIPFTIFKVEASQRPVAS

SEQ ID NO: 54177 - protein, 25 aa, synthetic construct
  source 1..25: note = Seed: VKLQTVHSIPLTINKEEALQRPVAS
VKLQTVHSIPFTIFKVEATQRPVAS

SEQ ID NO: 54178 - protein, 25 aa, synthetic construct
  source 1..25: note = Seed: VKLQTVHSIPLTINKEEALQRPVAS
VKLQTVHSIPFTIFKVEAVQRPVAS

SEQ ID NO: 54179 - protein, 25 aa, synthetic construct
  source 1..25: note = Seed: VKLQTVHSIPLTINKEEALQRPVAS
VKLQTVHSIPFTIFKVEAYQRPVAS

SEQ ID NO: 54180 - protein, 25 aa, synthetic construct
  source 1..25: note = Seed: VKLQTVHSIPLTINKEEALQRPVAS
VKLQTVHSIPFTIFKWEAAQRPVAS

SEQ ID NO: 54181 - protein, 25 aa, synthetic construct
  source 1..25: note = Seed: VKLQTVHSIPLTINKEEALQRPVAS
VKLQTVHSIPFTIFKWEACQRPVAS

SEQ ID NO: 54182 - protein, 25 aa, synthetic construct
  source 1..25: note = Seed: VKLQTVHSIPLTINKEEALQRPVAS
VKLQTVHSIPFTIFKWEADQRPVAS

SEQ ID NO: 54183 - protein, 25 aa, synthetic construct
  source 1..25: note = Seed: VKLQTVHSIPLTINKEEALQRPVAS
VKLQTVHSIPFTIFKWEAEQRPVAS

SEQ ID NO: 54184 - protein, 25 aa, synthetic construct
  source 1..25: note = Seed: VKLQTVHSIPLTINKEEALQRPVAS
VKLQTVHSIPFTIFKWEAFQRPVAS

SEQ ID NO: 54185 - protein, 25 aa, synthetic construct
  source 1..25: note = Seed: VKLQTVHSIPLTINKEEALQRPVAS
VKLQTVHSIPFTIFKWEAGQRPVAS

SEQ ID NO: 54186 - protein, 25 aa, synthetic construct
  source 1..25: note = Seed: VKLQTVHSIPLTINKEEALQRPVAS
VKLQTVHSIPFTIFKWEAHQRPVAS

SEQ ID NO: 54187 - protein, 25 aa, synthetic construct
  source 1..25: note = Seed: VKLQTVHSIPLTINKEEALQRPVAS
VKLQTVHSIPFTIFKWEAIQRPVAS

SEQ ID NO: 54188 - protein, 25 aa, synthetic construct
  source 1..25: note = Seed: VKLQTVHSIPLTINKEEALQRPVAS
VKLQTVHSIPFTIFKWEAKQRPVAS

SEQ ID NO: 54189 - protein, 25 aa, synthetic construct
  source 1..25: note = Seed: VKLQTVHSIPLTINKEEALQRPVAS
VKLQTVHSIPFTIFKWEALQRPVAS

SEQ ID NO: 54190 - protein, 25 aa, synthetic construct
  source 1..25: note = Seed: VKLQTVHSIPLTINKEEALQRPVAS
VKLQTVHSIPFTIFKWEAMQRPVAS

SEQ ID NO: 54191 - protein, 25 aa, synthetic construct
  source 1..25: note = Seed: VKLQTVHSIPLTINKEEALQRPVAS
VKLQTVHSIPFTIFKWEANQRPVAS

SEQ ID NO: 54192 - protein, 25 aa, synthetic construct
  source 1..25: note = Seed: VKLQTVHSIPLTINKEEALQRPVAS
VKLQTVHSIPFTIFKWEAPQRPVAS

SEQ ID NO: 54193 - protein, 25 aa, synthetic construct
  source 1..25: note = Seed: VKLQTVHSIPLTINKEEALQRPVAS
VKLQTVHSIPFTIFKWEAQQRPVAS

SEQ ID NO: 54194 - protein, 25 aa, synthetic construct
  source 1..25: note = Seed: VKLQTVHSIPLTINKEEALQRPVAS
VKLQTVHSIPFTIFKWEARQRPVAS

SEQ ID NO: 54195 - protein, 25 aa, synthetic construct
  source 1..25: note = Seed: VKLQTVHSIPLTINKEEALQRPVAS
VKLQTVHSIPFTIFKWEASQRPVAS

SEQ ID NO: 54196 - protein, 25 aa, synthetic construct
  source 1..25: note = Seed: VKLQTVHSIPLTINKEEALQRPVAS
VKLQTVHSIPFTIFKWEATQRPVAS

SEQ ID NO: 54197 - protein, 25 aa, synthetic construct
  source 1..25: note = Seed: VKLQTVHSIPLTINKEEALQRPVAS
VKLQTVHSIPFTIFKWEAVQRPVAS

SEQ ID NO: 54198 - protein, 25 aa, synthetic construct
  source 1..25: note = Seed: VKLQTVHSIPLTINKEEALQRPVAS
VKLQTVHSIPFTIFKWEAYQRPVAS

SEQ ID NO: 54199 - protein, 25 aa, synthetic construct
  source 1..25: note = Seed: VKLQTVHSIPLTINKEEALQRPVAS
VKLQTVHSIPFTIFKYEAAQRPVAS

SEQ ID NO: 54200 - protein, 25 aa, synthetic construct
  source 1..25: note = Seed: VKLQTVHSIPLTINKEEALQRPVAS
VKLQTVHSIPFTIFKYEACQRPVAS

SEQ ID NO: 54201 - protein, 25 aa, synthetic construct
  source 1..25: note = Seed: VKLQTVHSIPLTINKEEALQRPVAS
VKLQTVHSIPFTIFKYEADQRPVAS

SEQ ID NO: 54202 - protein, 25 aa, synthetic construct
  source 1..25: note = Seed: VKLQTVHSIPLTINKEEALQRPVAS
VKLQTVHSIPFTIFKYEAEQRPVAS

SEQ ID NO: 54203 - protein, 25 aa, synthetic construct
  source 1..25: note = Seed: VKLQTVHSIPLTINKEEALQRPVAS
VKLQTVHSIPFTIFKYEAFQRPVAS

SEQ ID NO: 54204 - protein, 25 aa, synthetic construct
  source 1..25: note = Seed: VKLQTVHSIPLTINKEEALQRPVAS
VKLQTVHSIPFTIFKYEAGQRPVAS

SEQ ID NO: 54205 - protein, 25 aa, synthetic construct
  source 1..25: note = Seed: VKLQTVHSIPLTINKEEALQRPVAS
VKLQTVHSIPFTIFKYEAHQRPVAS

SEQ ID NO: 54206 - protein, 25 aa, synthetic construct
  source 1..25: note = Seed: VKLQTVHSIPLTINKEEALQRPVAS
VKLQTVHSIPFTIFKYEAIQRPVAS

SEQ ID NO: 54207 - protein, 25 aa, synthetic construct
  source 1..25: note = Seed: VKLQTVHSIPLTINKEEALQRPVAS
VKLQTVHSIPFTIFKYEAKQRPVAS

SEQ ID NO: 54208 - protein, 25 aa, synthetic construct
  source 1..25: note = Seed: VKLQTVHSIPLTINKEEALQRPVAS
VKLQTVHSIPFTIFKYEALQRPVAS

SEQ ID NO: 54209 - protein, 25 aa, synthetic construct
  source 1..25: note = Seed: VKLQTVHSIPLTINKEEALQRPVAS
VKLQTVHSIPFTIFKYEAMQRPVAS

SEQ ID NO: 54210 - protein, 25 aa, synthetic construct
  source 1..25: note = Seed: VKLQTVHSIPLTINKEEALQRPVAS
VKLQTVHSIPFTIFKYEANQRPVAS

SEQ ID NO: 54211 - protein, 25 aa, synthetic construct
  source 1..25: note = Seed: VKLQTVHSIPLTINKEEALQRPVAS
VKLQTVHSIPFTIFKYEAPQRPVAS

SEQ ID NO: 54212 - protein, 25 aa, synthetic construct
  source 1..25: note = Seed: VKLQTVHSIPLTINKEEALQRPVAS
VKLQTVHSIPFTIFKYEAQQRPVAS

SEQ ID NO: 54213 - protein, 25 aa, synthetic construct
  source 1..25: note = Seed: VKLQTVHSIPLTINKEEALQRPVAS
VKLQTVHSIPFTIFKYEARQRPVAS

SEQ ID NO: 54214 - protein, 25 aa, synthetic construct
  source 1..25: note = Seed: VKLQTVHSIPLTINKEEALQRPVAS
VKLQTVHSIPFTIFKYEASQRPVAS

SEQ ID NO: 54215 - protein, 25 aa, synthetic construct
  source 1..25: note = Seed: VKLQTVHSIPLTINKEEALQRPVAS
VKLQTVHSIPFTIFKYEATQRPVAS

SEQ ID NO: 54216 - protein, 25 aa, synthetic construct
  source 1..25: note = Seed: VKLQTVHSIPLTINKEEALQRPVAS
VKLQTVHSIPFTIFKYEAVQRPVAS

SEQ ID NO: 54217 - protein, 25 aa, synthetic construct
  source 1..25: note = Seed: VKLQTVHSIPLTINKEEALQRPVAS
VKLQTVHSIPFTIFKYEAYQRPVAS

SEQ ID NO: 54218 - protein, 25 aa, synthetic construct
  source 1..25: note = Seed: VKLQTVHSIPLTINKEEALQRPVAS
VKLQTVHSIPFTIGKFEAAQRPVAS

SEQ ID NO: 54219 - protein, 25 aa, synthetic construct
  source 1..25: note = Seed: VKLQTVHSIPLTINKEEALQRPVAS
VKLQTVHSIPFTIGKFEAFQRPVAS

SEQ ID NO: 54220 - protein, 25 aa, synthetic construct
  source 1..25: note = Seed: VKLQTVHSIPLTINKEEALQRPVAS
VKLQTVHSIPFTIGKFEAIQRPVAS

SEQ ID NO: 54221 - protein, 25 aa, synthetic construct
  source 1..25: note = Seed: VKLQTVHSIPLTINKEEALQRPVAS
VKLQTVHSIPFTIGKFEALQRPVAS

SEQ ID NO: 54222 - protein, 25 aa, synthetic construct
  source 1..25: note = Seed: VKLQTVHSIPLTINKEEALQRPVAS
VKLQTVHSIPFTIGKFEAMQRPVAS

SEQ ID NO: 54223 - protein, 25 aa, synthetic construct
  source 1..25: note = Seed: VKLQTVHSIPLTINKEEALQRPVAS
VKLQTVHSIPFTIGKFEATQRPVAS

SEQ ID NO: 54224 - protein, 25 aa, synthetic construct
  source 1..25: note = Seed: VKLQTVHSIPLTINKEEALQRPVAS
VKLQTVHSIPFTIGKFEAVQRPVAS

SEQ ID NO: 54225 - protein, 25 aa, synthetic construct
  source 1..25: note = Seed: VKLQTVHSIPLTINKEEALQRPVAS
VKLQTVHSIPFTIGKFEAYQRPVAS

SEQ ID NO: 54226 - protein, 25 aa, synthetic construct
  source 1..25: note = Seed: VKLQTVHSIPLTINKEEALQRPVAS
VKLQTVHSIPFTIGKYEALQRPVAS

SEQ ID NO: 54227 - protein, 25 aa, synthetic construct
  source 1..25: note = Seed: VKLQTVHSIPLTINKEEALQRPVAS
VKLQTVHSIPFTIHKAEALQRPVAS

SEQ ID NO: 54228 - protein, 25 aa, synthetic construct
  source 1..25: note = Seed: VKLQTVHSIPLTINKEEALQRPVAS
VKLQTVHSIPFTIHKFEAAQRPVAS

SEQ ID NO: 54229 - protein, 25 aa, synthetic construct
  source 1..25: note = Seed: VKLQTVHSIPLTINKEEALQRPVAS
VKLQTVHSIPFTIHKFEACQRPVAS

SEQ ID NO: 54230 - protein, 25 aa, synthetic construct
  source 1..25: note = Seed: VKLQTVHSIPLTINKEEALQRPVAS
VKLQTVHSIPFTIHKFEADQRPVAS

SEQ ID NO: 54231 - protein, 25 aa, synthetic construct
  source 1..25: note = Seed: VKLQTVHSIPLTINKEEALQRPVAS
VKLQTVHSIPFTIHKFEAEQRPVAS

SEQ ID NO: 54232 - protein, 25 aa, synthetic construct
  source 1..25: note = Seed: VKLQTVHSIPLTINKEEALQRPVAS
VKLQTVHSIPFTIHKFEAFQRPVAS

SEQ ID NO: 54233 - protein, 25 aa, synthetic construct
  source 1..25: note = Seed: VKLQTVHSIPLTINKEEALQRPVAS
VKLQTVHSIPFTIHKFEAGQRPVAS

SEQ ID NO: 54234 - protein, 25 aa, synthetic construct
  source 1..25: note = Seed: VKLQTVHSIPLTINKEEALQRPVAS
VKLQTVHSIPFTIHKFEAHQRPVAS

SEQ ID NO: 54235 - protein, 25 aa, synthetic construct
  source 1..25: note = Seed: VKLQTVHSIPLTINKEEALQRPVAS
VKLQTVHSIPFTIHKFEAIQRPVAS

SEQ ID NO: 54236 - protein, 25 aa, synthetic construct
  source 1..25: note = Seed: VKLQTVHSIPLTINKEEALQRPVAS
VKLQTVHSIPFTIHKFEAKQRPVAS

SEQ ID NO: 54237 - protein, 25 aa, synthetic construct
  source 1..25: note = Seed: VKLQTVHSIPLTINKEEALQRPVAS
VKLQTVHSIPFTIHKFEALQRPVAS

SEQ ID NO: 54238 - protein, 25 aa, synthetic construct
  source 1..25: note = Seed: VKLQTVHSIPLTINKEEALQRPVAS
VKLQTVHSIPFTIHKFEAMQRPVAS

SEQ ID NO: 54239 - protein, 25 aa, synthetic construct
  source 1..25: note = Seed: VKLQTVHSIPLTINKEEALQRPVAS
VKLQTVHSIPFTIHKFEANQRPVAS

SEQ ID NO: 54240 - protein, 25 aa, synthetic construct
  source 1..25: note = Seed: VKLQTVHSIPLTINKEEALQRPVAS
VKLQTVHSIPFTIHKFEAPQRPVAS

SEQ ID NO: 54241 - protein, 25 aa, synthetic construct
  source 1..25: note = Seed: VKLQTVHSIPLTINKEEALQRPVAS
VKLQTVHSIPFTIHKFEAQQRPVAS

SEQ ID NO: 54242 - protein, 25 aa, synthetic construct
  source 1..25: note = Seed: VKLQTVHSIPLTINKEEALQRPVAS
VKLQTVHSIPFTIHKFEARQRPVAS

SEQ ID NO: 54243 - protein, 25 aa, synthetic construct
  source 1..25: note = Seed: VKLQTVHSIPLTINKEEALQRPVAS
VKLQTVHSIPFTIHKFEASQRPVAS

SEQ ID NO: 54244 - protein, 25 aa, synthetic construct
  source 1..25: note = Seed: VKLQTVHSIPLTINKEEALQRPVAS
VKLQTVHSIPFTIHKFEATQRPVAS

SEQ ID NO: 54245 - protein, 25 aa, synthetic construct
  source 1..25: note = Seed: VKLQTVHSIPLTINKEEALQRPVAS
VKLQTVHSIPFTIHKFEAVQRPVAS

SEQ ID NO: 54246 - protein, 25 aa, synthetic construct
  source 1..25: note = Seed: VKLQTVHSIPLTINKEEALQRPVAS
VKLQTVHSIPFTIHKFEAWQRPVAS

SEQ ID NO: 54247 - protein, 25 aa, synthetic construct
  source 1..25: note = Seed: VKLQTVHSIPLTINKEEALQRPVAS
VKLQTVHSIPFTIHKFEAYQRPVAS

SEQ ID NO: 54248 - protein, 25 aa, synthetic construct
  source 1..25: note = Seed: VKLQTVHSIPLTINKEEALQRPVAS
VKLQTVHSIPFTIHKHEAYQRPVAS

SEQ ID NO: 54249 - protein, 25 aa, synthetic construct
  source 1..25: note = Seed: VKLQTVHSIPLTINKEEALQRPVAS
VKLQTVHSIPFTIHKIEAFQRPVAS

SEQ ID NO: 54250 - protein, 25 aa, synthetic construct
  source 1..25: note = Seed: VKLQTVHSIPLTINKEEALQRPVAS
VKLQTVHSIPFTIHKIEAIQRPVAS

SEQ ID NO: 54251 - protein, 25 aa, synthetic construct
  source 1..25: note = Seed: VKLQTVHSIPLTINKEEALQRPVAS
VKLQTVHSIPFTIHKIEALQRPVAS

SEQ ID NO: 54252 - protein, 25 aa, synthetic construct
  source 1..25: note = Seed: VKLQTVHSIPLTINKEEALQRPVAS
VKLQTVHSIPFTIHKIEAMQRPVAS

SEQ ID NO: 54253 - protein, 25 aa, synthetic construct
  source 1..25: note = Seed: VKLQTVHSIPLTINKEEALQRPVAS
VKLQTVHSIPFTIHKIEARQRPVAS

SEQ ID NO: 54254 - protein, 25 aa, synthetic construct
  source 1..25: note = Seed: VKLQTVHSIPLTINKEEALQRPVAS
VKLQTVHSIPFTIHKIEATQRPVAS

SEQ ID NO: 54255 - protein, 25 aa, synthetic construct
  source 1..25: note = Seed: VKLQTVHSIPLTINKEEALQRPVAS
VKLQTVHSIPFTIHKIEAVQRPVAS

SEQ ID NO: 54256 - protein, 25 aa, synthetic construct
  source 1..25: note = Seed: VKLQTVHSIPLTINKEEALQRPVAS
VKLQTVHSIPFTIHKIEAWQRPVAS

SEQ ID NO: 54257 - protein, 25 aa, synthetic construct
  source 1..25: note = Seed: VKLQTVHSIPLTINKEEALQRPVAS
VKLQTVHSIPFTIHKIEAYQRPVAS

SEQ ID NO: 54258 - protein, 25 aa, synthetic construct
  source 1..25: note = Seed: VKLQTVHSIPLTINKEEALQRPVAS
VKLQTVHSIPFTIHKLEAAQRPVAS

SEQ ID NO: 54259 - protein, 25 aa, synthetic construct
  source 1..25: note = Seed: VKLQTVHSIPLTINKEEALQRPVAS
VKLQTVHSIPFTIHKLEAEQRPVAS

SEQ ID NO: 54260 - protein, 25 aa, synthetic construct
  source 1..25: note = Seed: VKLQTVHSIPLTINKEEALQRPVAS
VKLQTVHSIPFTIHKLEAFQRPVAS

SEQ ID NO: 54261 - protein, 25 aa, synthetic construct
  source 1..25: note = Seed: VKLQTVHSIPLTINKEEALQRPVAS
VKLQTVHSIPFTIHKLEAIQRPVAS

SEQ ID NO: 54262 - protein, 25 aa, synthetic construct
  source 1..25: note = Seed: VKLQTVHSIPLTINKEEALQRPVAS
VKLQTVHSIPFTIHKLEALQRPVAS

SEQ ID NO: 54263 - protein, 25 aa, synthetic construct
  source 1..25: note = Seed: VKLQTVHSIPLTINKEEALQRPVAS
VKLQTVHSIPFTIHKLEAMQRPVAS

SEQ ID NO: 54264 - protein, 25 aa, synthetic construct
  source 1..25: note = Seed: VKLQTVHSIPLTINKEEALQRPVAS
VKLQTVHSIPFTIHKLEANQRPVAS

SEQ ID NO: 54265 - protein, 25 aa, synthetic construct
  source 1..25: note = Seed: VKLQTVHSIPLTINKEEALQRPVAS
VKLQTVHSIPFTIHKLEASQRPVAS

SEQ ID NO: 54266 - protein, 25 aa, synthetic construct
  source 1..25: note = Seed: VKLQTVHSIPLTINKEEALQRPVAS
VKLQTVHSIPFTIHKLEATQRPVAS

SEQ ID NO: 54267 - protein, 25 aa, synthetic construct
  source 1..25: note = Seed: VKLQTVHSIPLTINKEEALQRPVAS
VKLQTVHSIPFTIHKLEAVQRPVAS

SEQ ID NO: 54268 - protein, 25 aa, synthetic construct
  source 1..25: note = Seed: VKLQTVHSIPLTINKEEALQRPVAS
VKLQTVHSIPFTIHKLEAWQRPVAS

SEQ ID NO: 54269 - protein, 25 aa, synthetic construct
  source 1..25: note = Seed: VKLQTVHSIPLTINKEEALQRPVAS
VKLQTVHSIPFTIHKLEAYQRPVAS

SEQ ID NO: 54270 - protein, 25 aa, synthetic construct
  source 1..25: note = Seed: VKLQTVHSIPLTINKEEALQRPVAS
VKLQTVHSIPFTIHKMEAFQRPVAS

SEQ ID NO: 54271 - protein, 25 aa, synthetic construct
  source 1..25: note = Seed: VKLQTVHSIPLTINKEEALQRPVAS
VKLQTVHSIPFTIHKMEAIQRPVAS

SEQ ID NO: 54272 - protein, 25 aa, synthetic construct
  source 1..25: note = Seed: VKLQTVHSIPLTINKEEALQRPVAS
VKLQTVHSIPFTIHKMEALQRPVAS

SEQ ID NO: 54273 - protein, 25 aa, synthetic construct
  source 1..25: note = Seed: VKLQTVHSIPLTINKEEALQRPVAS
VKLQTVHSIPFTIHKMEAMQRPVAS

SEQ ID NO: 54274 - protein, 25 aa, synthetic construct
  source 1..25: note = Seed: VKLQTVHSIPLTINKEEALQRPVAS
VKLQTVHSIPFTIHKMEAVQRPVAS

SEQ ID NO: 54275 - protein, 25 aa, synthetic construct
  source 1..25: note = Seed: VKLQTVHSIPLTINKEEALQRPVAS
VKLQTVHSIPFTIHKMEAYQRPVAS

SEQ ID NO: 54276 - protein, 25 aa, synthetic construct
  source 1..25: note = Seed: VKLQTVHSIPLTINKEEALQRPVAS
VKLQTVHSIPFTIHKNEAIQRPVAS

SEQ ID NO: 54277 - protein, 25 aa, synthetic construct
  source 1..25: note = Seed: VKLQTVHSIPLTINKEEALQRPVAS
VKLQTVHSIPFTIHKNEAVQRPVAS

SEQ ID NO: 54278 - protein, 25 aa, synthetic construct
  source 1..25: note = Seed: VKLQTVHSIPLTINKEEALQRPVAS
VKLQTVHSIPFTIHKREAFQRPVAS

SEQ ID NO: 54279 - protein, 25 aa, synthetic construct
  source 1..25: note = Seed: VKLQTVHSIPLTINKEEALQRPVAS
VKLQTVHSIPFTIHKREALQRPVAS

SEQ ID NO: 54280 - protein, 25 aa, synthetic construct
  source 1..25: note = Seed: VKLQTVHSIPLTINKEEALQRPVAS
VKLQTVHSIPFTIHKREAWQRPVAS

SEQ ID NO: 54281 - protein, 25 aa, synthetic construct
  source 1..25: note = Seed: VKLQTVHSIPLTINKEEALQRPVAS
VKLQTVHSIPFTIHKREAYQRPVAS

SEQ ID NO: 54282 - protein, 25 aa, synthetic construct
  source 1..25: note = Seed: VKLQTVHSIPLTINKEEALQRPVAS
VKLQTVHSIPFTIHKSEALQRPVAS

SEQ ID NO: 54283 - protein, 25 aa, synthetic construct
  source 1..25: note = Seed: VKLQTVHSIPLTINKEEALQRPVAS
VKLQTVHSIPFTIHKVEAFQRPVAS

SEQ ID NO: 54284 - protein, 25 aa, synthetic construct
  source 1..25: note = Seed: VKLQTVHSIPLTINKEEALQRPVAS
VKLQTVHSIPFTIHKVEAIQRPVAS

SEQ ID NO: 54285 - protein, 25 aa, synthetic construct
  source 1..25: note = Seed: VKLQTVHSIPLTINKEEALQRPVAS
VKLQTVHSIPFTIHKVEALQRPVAS

SEQ ID NO: 54286 - protein, 25 aa, synthetic construct
  source 1..25: note = Seed: VKLQTVHSIPLTINKEEALQRPVAS
VKLQTVHSIPFTIHKVEAMQRPVAS

SEQ ID NO: 54287 - protein, 25 aa, synthetic construct
  source 1..25: note = Seed: VKLQTVHSIPLTINKEEALQRPVAS
VKLQTVHSIPFTIHKVEARQRPVAS

SEQ ID NO: 54288 - protein, 25 aa, synthetic construct
  source 1..25: note = Seed: VKLQTVHSIPLTINKEEALQRPVAS
VKLQTVHSIPFTIHKVEAVQRPVAS

SEQ ID NO: 54289 - protein, 25 aa, synthetic construct
  source 1..25: note = Seed: VKLQTVHSIPLTINKEEALQRPVAS
VKLQTVHSIPFTIHKVEAYQRPVAS

SEQ ID NO: 54290 - protein, 25 aa, synthetic construct
  source 1..25: note = Seed: VKLQTVHSIPLTINKEEALQRPVAS
VKLQTVHSIPFTIHKWEAAQRPVAS

SEQ ID NO: 54291 - protein, 25 aa, synthetic construct
  source 1..25: note = Seed: VKLQTVHSIPLTINKEEALQRPVAS
VKLQTVHSIPFTIHKWEAFQRPVAS

SEQ ID NO: 54292 - protein, 25 aa, synthetic construct
  source 1..25: note = Seed: VKLQTVHSIPLTINKEEALQRPVAS
VKLQTVHSIPFTIHKWEAIQRPVAS

SEQ ID NO: 54293 - protein, 25 aa, synthetic construct
  source 1..25: note = Seed: VKLQTVHSIPLTINKEEALQRPVAS
VKLQTVHSIPFTIHKWEALQRPVAS

SEQ ID NO: 54294 - protein, 25 aa, synthetic construct
  source 1..25: note = Seed: VKLQTVHSIPLTINKEEALQRPVAS
VKLQTVHSIPFTIHKWEAMQRPVAS

SEQ ID NO: 54295 - protein, 25 aa, synthetic construct
  source 1..25: note = Seed: VKLQTVHSIPLTINKEEALQRPVAS
VKLQTVHSIPFTIHKWEASQRPVAS

SEQ ID NO: 54296 - protein, 25 aa, synthetic construct
  source 1..25: note = Seed: VKLQTVHSIPLTINKEEALQRPVAS
VKLQTVHSIPFTIHKWEATQRPVAS

SEQ ID NO: 54297 - protein, 25 aa, synthetic construct
  source 1..25: note = Seed: VKLQTVHSIPLTINKEEALQRPVAS
VKLQTVHSIPFTIHKWEAVQRPVAS

SEQ ID NO: 54298 - protein, 25 aa, synthetic construct
  source 1..25: note = Seed: VKLQTVHSIPLTINKEEALQRPVAS
VKLQTVHSIPFTIHKWEAWQRPVAS

SEQ ID NO: 54299 - protein, 25 aa, synthetic construct
  source 1..25: note = Seed: VKLQTVHSIPLTINKEEALQRPVAS
VKLQTVHSIPFTIHKWEAYQRPVAS

SEQ ID NO: 54300 - protein, 25 aa, synthetic construct
  source 1..25: note = Seed: VKLQTVHSIPLTINKEEALQRPVAS
VKLQTVHSIPFTIHKYEAAQRPVAS

SEQ ID NO: 54301 - protein, 25 aa, synthetic construct
  source 1..25: note = Seed: VKLQTVHSIPLTINKEEALQRPVAS
VKLQTVHSIPFTIHKYEAFQRPVAS

SEQ ID NO: 54302 - protein, 25 aa, synthetic construct
  source 1..25: note = Seed: VKLQTVHSIPLTINKEEALQRPVAS
VKLQTVHSIPFTIHKYEAIQRPVAS

SEQ ID NO: 54303 - protein, 25 aa, synthetic construct
  source 1..25: note = Seed: VKLQTVHSIPLTINKEEALQRPVAS
VKLQTVHSIPFTIHKYEALQRPVAS

SEQ ID NO: 54304 - protein, 25 aa, synthetic construct
  source 1..25: note = Seed: VKLQTVHSIPLTINKEEALQRPVAS
VKLQTVHSIPFTIHKYEAMQRPVAS

SEQ ID NO: 54305 - protein, 25 aa, synthetic construct
  source 1..25: note = Seed: VKLQTVHSIPLTINKEEALQRPVAS
VKLQTVHSIPFTIHKYEATQRPVAS

SEQ ID NO: 54306 - protein, 25 aa, synthetic construct
  source 1..25: note = Seed: VKLQTVHSIPLTINKEEALQRPVAS
VKLQTVHSIPFTIHKYEAVQRPVAS

SEQ ID NO: 54307 - protein, 25 aa, synthetic construct
  source 1..25: note = Seed: VKLQTVHSIPLTINKEEALQRPVAS
VKLQTVHSIPFTIHKYEAWQRPVAS

SEQ ID NO: 54308 - protein, 25 aa, synthetic construct
  source 1..25: note = Seed: VKLQTVHSIPLTINKEEALQRPVAS
VKLQTVHSIPFTIHKYEAYQRPVAS

SEQ ID NO: 54309 - protein, 25 aa, synthetic construct
  source 1..25: note = Seed: VKLQTVHSIPLTINKEEALQRPVAS
VKLQTVHSIPFTIIKAEAAQRPVAS

SEQ ID NO: 54310 - protein, 25 aa, synthetic construct
  source 1..25: note = Seed: VKLQTVHSIPLTINKEEALQRPVAS
VKLQTVHSIPFTIIKAEADQRPVAS

SEQ ID NO: 54311 - protein, 25 aa, synthetic construct
  source 1..25: note = Seed: VKLQTVHSIPLTINKEEALQRPVAS
VKLQTVHSIPFTIIKAEAEQRPVAS

SEQ ID NO: 54312 - protein, 25 aa, synthetic construct
  source 1..25: note = Seed: VKLQTVHSIPLTINKEEALQRPVAS
VKLQTVHSIPFTIIKAEAFQRPVAS

SEQ ID NO: 54313 - protein, 25 aa, synthetic construct
  source 1..25: note = Seed: VKLQTVHSIPLTINKEEALQRPVAS
VKLQTVHSIPFTIIKAEAIQRPVAS

SEQ ID NO: 54314 - protein, 25 aa, synthetic construct
  source 1..25: note = Seed: VKLQTVHSIPLTINKEEALQRPVAS
VKLQTVHSIPFTIIKAEALQRPVAS

SEQ ID NO: 54315 - protein, 25 aa, synthetic construct
  source 1..25: note = Seed: VKLQTVHSIPLTINKEEALQRPVAS
VKLQTVHSIPFTIIKAEAMQRPVAS

SEQ ID NO: 54316 - protein, 25 aa, synthetic construct
  source 1..25: note = Seed: VKLQTVHSIPLTINKEEALQRPVAS
VKLQTVHSIPFTIIKAEANQRPVAS

SEQ ID NO: 54317 - protein, 25 aa, synthetic construct
  source 1..25: note = Seed: VKLQTVHSIPLTINKEEALQRPVAS
VKLQTVHSIPFTIIKAEAQQRPVAS

SEQ ID NO: 54318 - protein, 25 aa, synthetic construct
  source 1..25: note = Seed: VKLQTVHSIPLTINKEEALQRPVAS
VKLQTVHSIPFTIIKAEARQRPVAS

SEQ ID NO: 54319 - protein, 25 aa, synthetic construct
  source 1..25: note = Seed: VKLQTVHSIPLTINKEEALQRPVAS
VKLQTVHSIPFTIIKAEASQRPVAS

SEQ ID NO: 54320 - protein, 25 aa, synthetic construct
  source 1..25: note = Seed: VKLQTVHSIPLTINKEEALQRPVAS
VKLQTVHSIPFTIIKAEAVQRPVAS

SEQ ID NO: 54321 - protein, 25 aa, synthetic construct
  source 1..25: note = Seed: VKLQTVHSIPLTINKEEALQRPVAS
VKLQTVHSIPFTIIKAEAYQRPVAS

SEQ ID NO: 54322 - protein, 25 aa, synthetic construct
  source 1..25: note = Seed: VKLQTVHSIPLTINKEEALQRPVAS
VKLQTVHSIPFTIIKDEAIQRPVAS

SEQ ID NO: 54323 - protein, 25 aa, synthetic construct
  source 1..25: note = Seed: VKLQTVHSIPLTINKEEALQRPVAS
VKLQTVHSIPFTIIKDEALQRPVAS

SEQ ID NO: 54324 - protein, 25 aa, synthetic construct
  source 1..25: note = Seed: VKLQTVHSIPLTINKEEALQRPVAS
VKLQTVHSIPFTIIKDEAVQRPVAS

SEQ ID NO: 54325 - protein, 25 aa, synthetic construct
  source 1..25: note = Seed: VKLQTVHSIPLTINKEEALQRPVAS
VKLQTVHSIPFTIIKEEAIQRPVAS

SEQ ID NO: 54326 - protein, 25 aa, synthetic construct
  source 1..25: note = Seed: VKLQTVHSIPLTINKEEALQRPVAS
VKLQTVHSIPFTIIKEEALQRPVAS

SEQ ID NO: 54327 - protein, 25 aa, synthetic construct
  source 1..25: note = Seed: VKLQTVHSIPLTINKEEALQRPVAS
VKLQTVHSIPFTIIKEEAMQRPVAS

SEQ ID NO: 54328 - protein, 25 aa, synthetic construct
  source 1..25: note = Seed: VKLQTVHSIPLTINKEEALQRPVAS
VKLQTVHSIPFTIIKEEAVQRPVAS

SEQ ID NO: 54329 - protein, 25 aa, synthetic construct
  source 1..25: note = Seed: VKLQTVHSIPLTINKEEALQRPVAS
VKLQTVHSIPFTIIKEEAYQRPVAS

SEQ ID NO: 54330 - protein, 25 aa, synthetic construct
  source 1..25: note = Seed: VKLQTVHSIPLTINKEEALQRPVAS
VKLQTVHSIPFTIIKFEAAQRPVAS

SEQ ID NO: 54331 - protein, 25 aa, synthetic construct
  source 1..25: note = Seed: VKLQTVHSIPLTINKEEALQRPVAS
VKLQTVHSIPFTIIKFEACQRPVAS

SEQ ID NO: 54332 - protein, 25 aa, synthetic construct
  source 1..25: note = Seed: VKLQTVHSIPLTINKEEALQRPVAS
VKLQTVHSIPFTIIKFEADQRPVAS

SEQ ID NO: 54333 - protein, 25 aa, synthetic construct
  source 1..25: note = Seed: VKLQTVHSIPLTINKEEALQRPVAS
VKLQTVHSIPFTIIKFEAEQRPVAS

SEQ ID NO: 54334 - protein, 25 aa, synthetic construct
  source 1..25: note = Seed: VKLQTVHSIPLTINKEEALQRPVAS
VKLQTVHSIPFTIIKFEAFQRPVAS

SEQ ID NO: 54335 - protein, 25 aa, synthetic construct
  source 1..25: note = Seed: VKLQTVHSIPLTINKEEALQRPVAS
VKLQTVHSIPFTIIKFEAGQRPVAS

SEQ ID NO: 54336 - protein, 25 aa, synthetic construct
  source 1..25: note = Seed: VKLQTVHSIPLTINKEEALQRPVAS
VKLQTVHSIPFTIIKFEAHQRPVAS

SEQ ID NO: 54337 - protein, 25 aa, synthetic construct
  source 1..25: note = Seed: VKLQTVHSIPLTINKEEALQRPVAS
VKLQTVHSIPFTIIKFEAIQRPVAS

SEQ ID NO: 54338 - protein, 25 aa, synthetic construct
  source 1..25: note = Seed: VKLQTVHSIPLTINKEEALQRPVAS
VKLQTVHSIPFTIIKFEAKQRPVAS

SEQ ID NO: 54339 - protein, 25 aa, synthetic construct
  source 1..25: note = Seed: VKLQTVHSIPLTINKEEALQRPVAS
VKLQTVHSIPFTIIKFEALQRPVAS

SEQ ID NO: 54340 - protein, 25 aa, synthetic construct
  source 1..25: note = Seed: VKLQTVHSIPLTINKEEALQRPVAS
VKLQTVHSIPFTIIKFEAMQRPVAS

SEQ ID NO: 54341 - protein, 25 aa, synthetic construct
  source 1..25: note = Seed: VKLQTVHSIPLTINKEEALQRPVAS
VKLQTVHSIPFTIIKFEANQRPVAS

SEQ ID NO: 54342 - protein, 25 aa, synthetic construct
  source 1..25: note = Seed: VKLQTVHSIPLTINKEEALQRPVAS
VKLQTVHSIPFTIIKFEAPQRPVAS

SEQ ID NO: 54343 - protein, 25 aa, synthetic construct
  source 1..25: note = Seed: VKLQTVHSIPLTINKEEALQRPVAS
VKLQTVHSIPFTIIKFEAQQRPVAS

SEQ ID NO: 54344 - protein, 25 aa, synthetic construct
  source 1..25: note = Seed: VKLQTVHSIPLTINKEEALQRPVAS
VKLQTVHSIPFTIIKFEARQRPVAS

SEQ ID NO: 54345 - protein, 25 aa, synthetic construct
  source 1..25: note = Seed: VKLQTVHSIPLTINKEEALQRPVAS
VKLQTVHSIPFTIIKFEASQRPVAS

SEQ ID NO: 54346 - protein, 25 aa, synthetic construct
  source 1..25: note = Seed: VKLQTVHSIPLTINKEEALQRPVAS
VKLQTVHSIPFTIIKFEATQRPVAS

SEQ ID NO: 54347 - protein, 25 aa, synthetic construct
  source 1..25: note = Seed: VKLQTVHSIPLTINKEEALQRPVAS
VKLQTVHSIPFTIIKFEAVQRPVAS

SEQ ID NO: 54348 - protein, 25 aa, synthetic construct
  source 1..25: note = Seed: VKLQTVHSIPLTINKEEALQRPVAS
VKLQTVHSIPFTIIKFEAWQRPVAS

SEQ ID NO: 54349 - protein, 25 aa, synthetic construct
  source 1..25: note = Seed: VKLQTVHSIPLTINKEEALQRPVAS
VKLQTVHSIPFTIIKFEAYQRPVAS

SEQ ID NO: 54350 - protein, 25 aa, synthetic construct
  source 1..25: note = Seed: VKLQTVHSIPLTINKEEALQRPVAS
VKLQTVHSIPFTIIKHEAAQRPVAS

SEQ ID NO: 54351 - protein, 25 aa, synthetic construct
  source 1..25: note = Seed: VKLQTVHSIPLTINKEEALQRPVAS
VKLQTVHSIPFTIIKHEAIQRPVAS

SEQ ID NO: 54352 - protein, 25 aa, synthetic construct
  source 1..25: note = Seed: VKLQTVHSIPLTINKEEALQRPVAS
VKLQTVHSIPFTIIKHEALQRPVAS

SEQ ID NO: 54353 - protein, 25 aa, synthetic construct
  source 1..25: note = Seed: VKLQTVHSIPLTINKEEALQRPVAS
VKLQTVHSIPFTIIKHEAMQRPVAS

SEQ ID NO: 54354 - protein, 25 aa, synthetic construct
  source 1..25: note = Seed: VKLQTVHSIPLTINKEEALQRPVAS
VKLQTVHSIPFTIIKHEAVQRPVAS

SEQ ID NO: 54355 - protein, 25 aa, synthetic construct
  source 1..25: note = Seed: VKLQTVHSIPLTINKEEALQRPVAS
VKLQTVHSIPFTIIKHEAYQRPVAS

SEQ ID NO: 54356 - protein, 25 aa, synthetic construct
  source 1..25: note = Seed: VKLQTVHSIPLTINKEEALQRPVAS
VKLQTVHSIPFTIIKIEAAQRPVAS

SEQ ID NO: 54357 - protein, 25 aa, synthetic construct
  source 1..25: note = Seed: VKLQTVHSIPLTINKEEALQRPVAS
VKLQTVHSIPFTIIKIEACQRPVAS

SEQ ID NO: 54358 - protein, 25 aa, synthetic construct
  source 1..25: note = Seed: VKLQTVHSIPLTINKEEALQRPVAS
VKLQTVHSIPFTIIKIEADQRPVAS

SEQ ID NO: 54359 - protein, 25 aa, synthetic construct
  source 1..25: note = Seed: VKLQTVHSIPLTINKEEALQRPVAS
VKLQTVHSIPFTIIKIEAEQRPVAS

SEQ ID NO: 54360 - protein, 25 aa, synthetic construct
  source 1..25: note = Seed: VKLQTVHSIPLTINKEEALQRPVAS
VKLQTVHSIPFTIIKIEAFQRPVAS

SEQ ID NO: 54361 - protein, 25 aa, synthetic construct
  source 1..25: note = Seed: VKLQTVHSIPLTINKEEALQRPVAS
VKLQTVHSIPFTIIKIEAGQRPVAS

SEQ ID NO: 54362 - protein, 25 aa, synthetic construct
  source 1..25: note = Seed: VKLQTVHSIPLTINKEEALQRPVAS
VKLQTVHSIPFTIIKIEAHQRPVAS

SEQ ID NO: 54363 - protein, 25 aa, synthetic construct
  source 1..25: note = Seed: VKLQTVHSIPLTINKEEALQRPVAS
VKLQTVHSIPFTIIKIEAIQRPVAS

SEQ ID NO: 54364 - protein, 25 aa, synthetic construct
  source 1..25: note = Seed: VKLQTVHSIPLTINKEEALQRPVAS
VKLQTVHSIPFTIIKIEAKQRPVAS

SEQ ID NO: 54365 - protein, 25 aa, synthetic construct
  source 1..25: note = Seed: VKLQTVHSIPLTINKEEALQRPVAS
VKLQTVHSIPFTIIKIEALQRPVAS

SEQ ID NO: 54366 - protein, 25 aa, synthetic construct
  source 1..25: note = Seed: VKLQTVHSIPLTINKEEALQRPVAS
VKLQTVHSIPFTIIKIEAMQRPVAS

SEQ ID NO: 54367 - protein, 25 aa, synthetic construct
  source 1..25: note = Seed: VKLQTVHSIPLTINKEEALQRPVAS
VKLQTVHSIPFTIIKIEANQRPVAS

SEQ ID NO: 54368 - protein, 25 aa, synthetic construct
  source 1..25: note = Seed: VKLQTVHSIPLTINKEEALQRPVAS
VKLQTVHSIPFTIIKIEAQQRPVAS

SEQ ID NO: 54369 - protein, 25 aa, synthetic construct
  source 1..25: note = Seed: VKLQTVHSIPLTINKEEALQRPVAS
VKLQTVHSIPFTIIKIEARQRPVAS

SEQ ID NO: 54370 - protein, 25 aa, synthetic construct
  source 1..25: note = Seed: VKLQTVHSIPLTINKEEALQRPVAS
VKLQTVHSIPFTIIKIEASQRPVAS

SEQ ID NO: 54371 - protein, 25 aa, synthetic construct
  source 1..25: note = Seed: VKLQTVHSIPLTINKEEALQRPVAS
VKLQTVHSIPFTIIKIEATQRPVAS

SEQ ID NO: 54372 - protein, 25 aa, synthetic construct
  source 1..25: note = Seed: VKLQTVHSIPLTINKEEALQRPVAS
VKLQTVHSIPFTIIKIEAVQRPVAS

SEQ ID NO: 54373 - protein, 25 aa, synthetic construct
  source 1..25: note = Seed: VKLQTVHSIPLTINKEEALQRPVAS
VKLQTVHSIPFTIIKIEAYQRPVAS

SEQ ID NO: 54374 - protein, 25 aa, synthetic construct
  source 1..25: note = Seed: VKLQTVHSIPLTINKEEALQRPVAS
VKLQTVHSIPFTIIKKEAFQRPVAS

SEQ ID NO: 54375 - protein, 25 aa, synthetic construct
  source 1..25: note = Seed: VKLQTVHSIPLTINKEEALQRPVAS
VKLQTVHSIPFTIIKKEAIQRPVAS

SEQ ID NO: 54376 - protein, 25 aa, synthetic construct
  source 1..25: note = Seed: VKLQTVHSIPLTINKEEALQRPVAS
VKLQTVHSIPFTIIKKEALQRPVAS

SEQ ID NO: 54377 - protein, 25 aa, synthetic construct
  source 1..25: note = Seed: VKLQTVHSIPLTINKEEALQRPVAS
VKLQTVHSIPFTIIKKEAMQRPVAS

SEQ ID NO: 54378 - protein, 25 aa, synthetic construct
  source 1..25: note = Seed: VKLQTVHSIPLTINKEEALQRPVAS
VKLQTVHSIPFTIIKKEARQRPVAS

SEQ ID NO: 54379 - protein, 25 aa, synthetic construct
  source 1..25: note = Seed: VKLQTVHSIPLTINKEEALQRPVAS
VKLQTVHSIPFTIIKKEAVQRPVAS

SEQ ID NO: 54380 - protein, 25 aa, synthetic construct
  source 1..25: note = Seed: VKLQTVHSIPLTINKEEALQRPVAS
VKLQTVHSIPFTIIKKEAYQRPVAS

SEQ ID NO: 54381 - protein, 25 aa, synthetic construct
  source 1..25: note = Seed: VKLQTVHSIPLTINKEEALQRPVAS
VKLQTVHSIPFTIIKLEAAQRPVAS

SEQ ID NO: 54382 - protein, 25 aa, synthetic construct
  source 1..25: note = Seed: VKLQTVHSIPLTINKEEALQRPVAS
VKLQTVHSIPFTIIKLEACQRPVAS

SEQ ID NO: 54383 - protein, 25 aa, synthetic construct
  source 1..25: note = Seed: VKLQTVHSIPLTINKEEALQRPVAS
VKLQTVHSIPFTIIKLEADQRPVAS

SEQ ID NO: 54384 - protein, 25 aa, synthetic construct
  source 1..25: note = Seed: VKLQTVHSIPLTINKEEALQRPVAS
VKLQTVHSIPFTIIKLEAEQRPVAS

SEQ ID NO: 54385 - protein, 25 aa, synthetic construct
  source 1..25: note = Seed: VKLQTVHSIPLTINKEEALQRPVAS
VKLQTVHSIPFTIIKLEAFQRPVAS

SEQ ID NO: 54386 - protein, 25 aa, synthetic construct
  source 1..25: note = Seed: VKLQTVHSIPLTINKEEALQRPVAS
VKLQTVHSIPFTIIKLEAGQRPVAS

SEQ ID NO: 54387 - protein, 25 aa, synthetic construct
  source 1..25: note = Seed: VKLQTVHSIPLTINKEEALQRPVAS
VKLQTVHSIPFTIIKLEAHQRPVAS

SEQ ID NO: 54388 - protein, 25 aa, synthetic construct
  source 1..25: note = Seed: VKLQTVHSIPLTINKEEALQRPVAS
VKLQTVHSIPFTIIKLEAIQRPVAS

SEQ ID NO: 54389 - protein, 25 aa, synthetic construct
  source 1..25: note = Seed: VKLQTVHSIPLTINKEEALQRPVAS
VKLQTVHSIPFTIIKLEAKQRPVAS

SEQ ID NO: 54390 - protein, 25 aa, synthetic construct
  source 1..25: note = Seed: VKLQTVHSIPLTINKEEALQRPVAS
VKLQTVHSIPFTIIKLEALQRPVAS

SEQ ID NO: 54391 - protein, 25 aa, synthetic construct
  source 1..25: note = Seed: VKLQTVHSIPLTINKEEALQRPVAS
VKLQTVHSIPFTIIKLEAMQRPVAS

SEQ ID NO: 54392 - protein, 25 aa, synthetic construct
  source 1..25: note = Seed: VKLQTVHSIPLTINKEEALQRPVAS
VKLQTVHSIPFTIIKLEANQRPVAS

SEQ ID NO: 54393 - protein, 25 aa, synthetic construct
  source 1..25: note = Seed: VKLQTVHSIPLTINKEEALQRPVAS
VKLQTVHSIPFTIIKLEAPQRPVAS

SEQ ID NO: 54394 - protein, 25 aa, synthetic construct
  source 1..25: note = Seed: VKLQTVHSIPLTINKEEALQRPVAS
VKLQTVHSIPFTIIKLEAQQRPVAS

SEQ ID NO: 54395 - protein, 25 aa, synthetic construct
  source 1..25: note = Seed: VKLQTVHSIPLTINKEEALQRPVAS
VKLQTVHSIPFTIIKLEARQRPVAS

SEQ ID NO: 54396 - protein, 25 aa, synthetic construct
  source 1..25: note = Seed: VKLQTVHSIPLTINKEEALQRPVAS
VKLQTVHSIPFTIIKLEASQRPVAS

SEQ ID NO: 54397 - protein, 25 aa, synthetic construct
  source 1..25: note = Seed: VKLQTVHSIPLTINKEEALQRPVAS
VKLQTVHSIPFTIIKLEATQRPVAS

SEQ ID NO: 54398 - protein, 25 aa, synthetic construct
  source 1..25: note = Seed: VKLQTVHSIPLTINKEEALQRPVAS
VKLQTVHSIPFTIIKLEAVQRPVAS

SEQ ID NO: 54399 - protein, 25 aa, synthetic construct
  source 1..25: note = Seed: VKLQTVHSIPLTINKEEALQRPVAS
VKLQTVHSIPFTIIKLEAYQRPVAS

SEQ ID NO: 54400 - protein, 25 aa, synthetic construct
  source 1..25: note = Seed: VKLQTVHSIPLTINKEEALQRPVAS
VKLQTVHSIPFTIIKMEAAQRPVAS

SEQ ID NO: 54401 - protein, 25 aa, synthetic construct
  source 1..25: note = Seed: VKLQTVHSIPLTINKEEALQRPVAS
VKLQTVHSIPFTIIKMEADQRPVAS

SEQ ID NO: 54402 - protein, 25 aa, synthetic construct
  source 1..25: note = Seed: VKLQTVHSIPLTINKEEALQRPVAS
VKLQTVHSIPFTIIKMEAEQRPVAS

SEQ ID NO: 54403 - protein, 25 aa, synthetic construct
  source 1..25: note = Seed: VKLQTVHSIPLTINKEEALQRPVAS
VKLQTVHSIPFTIIKMEAFQRPVAS

SEQ ID NO: 54404 - protein, 25 aa, synthetic construct
  source 1..25: note = Seed: VKLQTVHSIPLTINKEEALQRPVAS
VKLQTVHSIPFTIIKMEAGQRPVAS

SEQ ID NO: 54405 - protein, 25 aa, synthetic construct
  source 1..25: note = Seed: VKLQTVHSIPLTINKEEALQRPVAS
VKLQTVHSIPFTIIKMEAHQRPVAS

SEQ ID NO: 54406 - protein, 25 aa, synthetic construct
  source 1..25: note = Seed: VKLQTVHSIPLTINKEEALQRPVAS
VKLQTVHSIPFTIIKMEAIQRPVAS

SEQ ID NO: 54407 - protein, 25 aa, synthetic construct
  source 1..25: note = Seed: VKLQTVHSIPLTINKEEALQRPVAS
VKLQTVHSIPFTIIKMEALQRPVAS

SEQ ID NO: 54408 - protein, 25 aa, synthetic construct
  source 1..25: note = Seed: VKLQTVHSIPLTINKEEALQRPVAS
VKLQTVHSIPFTIIKMEAMQRPVAS

SEQ ID NO: 54409 - protein, 25 aa, synthetic construct
  source 1..25: note = Seed: VKLQTVHSIPLTINKEEALQRPVAS
VKLQTVHSIPFTIIKMEANQRPVAS

SEQ ID NO: 54410 - protein, 25 aa, synthetic construct
  source 1..25: note = Seed: VKLQTVHSIPLTINKEEALQRPVAS
VKLQTVHSIPFTIIKMEAQQRPVAS

SEQ ID NO: 54411 - protein, 25 aa, synthetic construct
  source 1..25: note = Seed: VKLQTVHSIPLTINKEEALQRPVAS
VKLQTVHSIPFTIIKMEARQRPVAS

SEQ ID NO: 54412 - protein, 25 aa, synthetic construct
  source 1..25: note = Seed: VKLQTVHSIPLTINKEEALQRPVAS
VKLQTVHSIPFTIIKMEASQRPVAS

SEQ ID NO: 54413 - protein, 25 aa, synthetic construct
  source 1..25: note = Seed: VKLQTVHSIPLTINKEEALQRPVAS
VKLQTVHSIPFTIIKMEATQRPVAS

SEQ ID NO: 54414 - protein, 25 aa, synthetic construct
  source 1..25: note = Seed: VKLQTVHSIPLTINKEEALQRPVAS
VKLQTVHSIPFTIIKMEAVQRPVAS

SEQ ID NO: 54415 - protein, 25 aa, synthetic construct
  source 1..25: note = Seed: VKLQTVHSIPLTINKEEALQRPVAS
VKLQTVHSIPFTIIKMEAYQRPVAS

SEQ ID NO: 54416 - protein, 25 aa, synthetic construct
  source 1..25: note = Seed: VKLQTVHSIPLTINKEEALQRPVAS
VKLQTVHSIPFTIIKNEAAQRPVAS

SEQ ID NO: 54417 - protein, 25 aa, synthetic construct
  source 1..25: note = Seed: VKLQTVHSIPLTINKEEALQRPVAS
VKLQTVHSIPFTIIKNEADQRPVAS

SEQ ID NO: 54418 - protein, 25 aa, synthetic construct
  source 1..25: note = Seed: VKLQTVHSIPLTINKEEALQRPVAS
VKLQTVHSIPFTIIKNEAEQRPVAS

SEQ ID NO: 54419 - protein, 25 aa, synthetic construct
  source 1..25: note = Seed: VKLQTVHSIPLTINKEEALQRPVAS
VKLQTVHSIPFTIIKNEAFQRPVAS

SEQ ID NO: 54420 - protein, 25 aa, synthetic construct
  source 1..25: note = Seed: VKLQTVHSIPLTINKEEALQRPVAS
VKLQTVHSIPFTIIKNEAGQRPVAS

SEQ ID NO: 54421 - protein, 25 aa, synthetic construct
  source 1..25: note = Seed: VKLQTVHSIPLTINKEEALQRPVAS
VKLQTVHSIPFTIIKNEAHQRPVAS

SEQ ID NO: 54422 - protein, 25 aa, synthetic construct
  source 1..25: note = Seed: VKLQTVHSIPLTINKEEALQRPVAS
VKLQTVHSIPFTIIKNEAIQRPVAS

SEQ ID NO: 54423 - protein, 25 aa, synthetic construct
  source 1..25: note = Seed: VKLQTVHSIPLTINKEEALQRPVAS
VKLQTVHSIPFTIIKNEALQRPVAS

SEQ ID NO: 54424 - protein, 25 aa, synthetic construct
  source 1..25: note = Seed: VKLQTVHSIPLTINKEEALQRPVAS
VKLQTVHSIPFTIIKNEAMQRPVAS

SEQ ID NO: 54425 - protein, 25 aa, synthetic construct
  source 1..25: note = Seed: VKLQTVHSIPLTINKEEALQRPVAS
VKLQTVHSIPFTIIKNEANQRPVAS

SEQ ID NO: 54426 - protein, 25 aa, synthetic construct
  source 1..25: note = Seed: VKLQTVHSIPLTINKEEALQRPVAS
VKLQTVHSIPFTIIKNEAQQRPVAS

SEQ ID NO: 54427 - protein, 25 aa, synthetic construct
  source 1..25: note = Seed: VKLQTVHSIPLTINKEEALQRPVAS
VKLQTVHSIPFTIIKNEASQRPVAS

SEQ ID NO: 54428 - protein, 25 aa, synthetic construct
  source 1..25: note = Seed: VKLQTVHSIPLTINKEEALQRPVAS
VKLQTVHSIPFTIIKNEATQRPVAS

SEQ ID NO: 54429 - protein, 25 aa, synthetic construct
  source 1..25: note = Seed: VKLQTVHSIPLTINKEEALQRPVAS
VKLQTVHSIPFTIIKNEAVQRPVAS

SEQ ID NO: 54430 - protein, 25 aa, synthetic construct
  source 1..25: note = Seed: VKLQTVHSIPLTINKEEALQRPVAS
VKLQTVHSIPFTIIKNEAYQRPVAS

SEQ ID NO: 54431 - protein, 25 aa, synthetic construct
  source 1..25: note = Seed: VKLQTVHSIPLTINKEEALQRPVAS
VKLQTVHSIPFTIIKPEAEQRPVAS

SEQ ID NO: 54432 - protein, 25 aa, synthetic construct
  source 1..25: note = Seed: VKLQTVHSIPLTINKEEALQRPVAS
VKLQTVHSIPFTIIKPEAFQRPVAS

SEQ ID NO: 54433 - protein, 25 aa, synthetic construct
  source 1..25: note = Seed: VKLQTVHSIPLTINKEEALQRPVAS
VKLQTVHSIPFTIIKPEAIQRPVAS

SEQ ID NO: 54434 - protein, 25 aa, synthetic construct
  source 1..25: note = Seed: VKLQTVHSIPLTINKEEALQRPVAS
VKLQTVHSIPFTIIKPEALQRPVAS

SEQ ID NO: 54435 - protein, 25 aa, synthetic construct
  source 1..25: note = Seed: VKLQTVHSIPLTINKEEALQRPVAS
VKLQTVHSIPFTIIKPEAMQRPVAS

SEQ ID NO: 54436 - protein, 25 aa, synthetic construct
  source 1..25: note = Seed: VKLQTVHSIPLTINKEEALQRPVAS
VKLQTVHSIPFTIIKPEAVQRPVAS

SEQ ID NO: 54437 - protein, 25 aa, synthetic construct
  source 1..25: note = Seed: VKLQTVHSIPLTINKEEALQRPVAS
VKLQTVHSIPFTIIKPEAYQRPVAS

SEQ ID NO: 54438 - protein, 25 aa, synthetic construct
  source 1..25: note = Seed: VKLQTVHSIPLTINKEEALQRPVAS
VKLQTVHSIPFTIIKQEAMQRPVAS

SEQ ID NO: 54439 - protein, 25 aa, synthetic construct
  source 1..25: note = Seed: VKLQTVHSIPLTINKEEALQRPVAS
VKLQTVHSIPFTIIKQEAVQRPVAS

SEQ ID NO: 54440 - protein, 25 aa, synthetic construct
  source 1..25: note = Seed: VKLQTVHSIPLTINKEEALQRPVAS
VKLQTVHSIPFTIIKREAAQRPVAS

SEQ ID NO: 54441 - protein, 25 aa, synthetic construct
  source 1..25: note = Seed: VKLQTVHSIPLTINKEEALQRPVAS
VKLQTVHSIPFTIIKREAFQRPVAS

SEQ ID NO: 54442 - protein, 25 aa, synthetic construct
  source 1..25: note = Seed: VKLQTVHSIPLTINKEEALQRPVAS
VKLQTVHSIPFTIIKREAIQRPVAS

SEQ ID NO: 54443 - protein, 25 aa, synthetic construct
  source 1..25: note = Seed: VKLQTVHSIPLTINKEEALQRPVAS
VKLQTVHSIPFTIIKREALQRPVAS

SEQ ID NO: 54444 - protein, 25 aa, synthetic construct
  source 1..25: note = Seed: VKLQTVHSIPLTINKEEALQRPVAS
VKLQTVHSIPFTIIKREAMQRPVAS

SEQ ID NO: 54445 - protein, 25 aa, synthetic construct
  source 1..25: note = Seed: VKLQTVHSIPLTINKEEALQRPVAS
VKLQTVHSIPFTIIKREARQRPVAS

SEQ ID NO: 54446 - protein, 25 aa, synthetic construct
  source 1..25: note = Seed: VKLQTVHSIPLTINKEEALQRPVAS
VKLQTVHSIPFTIIKREAVQRPVAS

SEQ ID NO: 54447 - protein, 25 aa, synthetic construct
  source 1..25: note = Seed: VKLQTVHSIPLTINKEEALQRPVAS
VKLQTVHSIPFTIIKREAYQRPVAS

SEQ ID NO: 54448 - protein, 25 aa, synthetic construct
  source 1..25: note = Seed: VKLQTVHSIPLTINKEEALQRPVAS
VKLQTVHSIPFTIIKSEAAQRPVAS

SEQ ID NO: 54449 - protein, 25 aa, synthetic construct
  source 1..25: note = Seed: VKLQTVHSIPLTINKEEALQRPVAS
VKLQTVHSIPFTIIKSEADQRPVAS

SEQ ID NO: 54450 - protein, 25 aa, synthetic construct
  source 1..25: note = Seed: VKLQTVHSIPLTINKEEALQRPVAS
VKLQTVHSIPFTIIKSEAEQRPVAS

SEQ ID NO: 54451 - protein, 25 aa, synthetic construct
  source 1..25: note = Seed: VKLQTVHSIPLTINKEEALQRPVAS
VKLQTVHSIPFTIIKSEAFQRPVAS

SEQ ID NO: 54452 - protein, 25 aa, synthetic construct
  source 1..25: note = Seed: VKLQTVHSIPLTINKEEALQRPVAS
VKLQTVHSIPFTIIKSEAHQRPVAS

SEQ ID NO: 54453 - protein, 25 aa, synthetic construct
  source 1..25: note = Seed: VKLQTVHSIPLTINKEEALQRPVAS
VKLQTVHSIPFTIIKSEAIQRPVAS

SEQ ID NO: 54454 - protein, 25 aa, synthetic construct
  source 1..25: note = Seed: VKLQTVHSIPLTINKEEALQRPVAS
VKLQTVHSIPFTIIKSEALQRPVAS

SEQ ID NO: 54455 - protein, 25 aa, synthetic construct
  source 1..25: note = Seed: VKLQTVHSIPLTINKEEALQRPVAS
VKLQTVHSIPFTIIKSEAMQRPVAS

SEQ ID NO: 54456 - protein, 25 aa, synthetic construct
  source 1..25: note = Seed: VKLQTVHSIPLTINKEEALQRPVAS
VKLQTVHSIPFTIIKSEANQRPVAS

SEQ ID NO: 54457 - protein, 25 aa, synthetic construct
  source 1..25: note = Seed: VKLQTVHSIPLTINKEEALQRPVAS
VKLQTVHSIPFTIIKSEARQRPVAS

SEQ ID NO: 54458 - protein, 25 aa, synthetic construct
  source 1..25: note = Seed: VKLQTVHSIPLTINKEEALQRPVAS
VKLQTVHSIPFTIIKSEASQRPVAS

SEQ ID NO: 54459 - protein, 25 aa, synthetic construct
  source 1..25: note = Seed: VKLQTVHSIPLTINKEEALQRPVAS
VKLQTVHSIPFTIIKSEATQRPVAS

SEQ ID NO: 54460 - protein, 25 aa, synthetic construct
  source 1..25: note = Seed: VKLQTVHSIPLTINKEEALQRPVAS
VKLQTVHSIPFTIIKSEAVQRPVAS

SEQ ID NO: 54461 - protein, 25 aa, synthetic construct
  source 1..25: note = Seed: VKLQTVHSIPLTINKEEALQRPVAS
VKLQTVHSIPFTIIKSEAYQRPVAS

SEQ ID NO: 54462 - protein, 25 aa, synthetic construct
  source 1..25: note = Seed: VKLQTVHSIPLTINKEEALQRPVAS
VKLQTVHSIPFTIIKTEAAQRPVAS

SEQ ID NO: 54463 - protein, 25 aa, synthetic construct
  source 1..25: note = Seed: VKLQTVHSIPLTINKEEALQRPVAS
VKLQTVHSIPFTIIKTEADQRPVAS

SEQ ID NO: 54464 - protein, 25 aa, synthetic construct
  source 1..25: note = Seed: VKLQTVHSIPLTINKEEALQRPVAS
VKLQTVHSIPFTIIKTEAEQRPVAS

SEQ ID NO: 54465 - protein, 25 aa, synthetic construct
  source 1..25: note = Seed: VKLQTVHSIPLTINKEEALQRPVAS
VKLQTVHSIPFTIIKTEAFQRPVAS

SEQ ID NO: 54466 - protein, 25 aa, synthetic construct
  source 1..25: note = Seed: VKLQTVHSIPLTINKEEALQRPVAS
VKLQTVHSIPFTIIKTEAHQRPVAS

SEQ ID NO: 54467 - protein, 25 aa, synthetic construct
  source 1..25: note = Seed: VKLQTVHSIPLTINKEEALQRPVAS
VKLQTVHSIPFTIIKTEAIQRPVAS

SEQ ID NO: 54468 - protein, 25 aa, synthetic construct
  source 1..25: note = Seed: VKLQTVHSIPLTINKEEALQRPVAS
VKLQTVHSIPFTIIKTEALQRPVAS

SEQ ID NO: 54469 - protein, 25 aa, synthetic construct
  source 1..25: note = Seed: VKLQTVHSIPLTINKEEALQRPVAS
VKLQTVHSIPFTIIKTEAMQRPVAS

SEQ ID NO: 54470 - protein, 25 aa, synthetic construct
  source 1..25: note = Seed: VKLQTVHSIPLTINKEEALQRPVAS
VKLQTVHSIPFTIIKTEANQRPVAS

SEQ ID NO: 54471 - protein, 25 aa, synthetic construct
  source 1..25: note = Seed: VKLQTVHSIPLTINKEEALQRPVAS
VKLQTVHSIPFTIIKTEAQQRPVAS

SEQ ID NO: 54472 - protein, 25 aa, synthetic construct
  source 1..25: note = Seed: VKLQTVHSIPLTINKEEALQRPVAS
VKLQTVHSIPFTIIKTEARQRPVAS

SEQ ID NO: 54473 - protein, 25 aa, synthetic construct
  source 1..25: note = Seed: VKLQTVHSIPLTINKEEALQRPVAS
VKLQTVHSIPFTIIKTEASQRPVAS

SEQ ID NO: 54474 - protein, 25 aa, synthetic construct
  source 1..25: note = Seed: VKLQTVHSIPLTINKEEALQRPVAS
VKLQTVHSIPFTIIKTEATQRPVAS

SEQ ID NO: 54475 - protein, 25 aa, synthetic construct
  source 1..25: note = Seed: VKLQTVHSIPLTINKEEALQRPVAS
VKLQTVHSIPFTIIKTEAVQRPVAS

SEQ ID NO: 54476 - protein, 25 aa, synthetic construct
  source 1..25: note = Seed: VKLQTVHSIPLTINKEEALQRPVAS
VKLQTVHSIPFTIIKTEAYQRPVAS

SEQ ID NO: 54477 - protein, 25 aa, synthetic construct
  source 1..25: note = Seed: VKLQTVHSIPLTINKEEALQRPVAS
VKLQTVHSIPFTIIKVEAAQRPVAS

SEQ ID NO: 54478 - protein, 25 aa, synthetic construct
  source 1..25: note = Seed: VKLQTVHSIPLTINKEEALQRPVAS
VKLQTVHSIPFTIIKVEADQRPVAS

SEQ ID NO: 54479 - protein, 25 aa, synthetic construct
  source 1..25: note = Seed: VKLQTVHSIPLTINKEEALQRPVAS
VKLQTVHSIPFTIIKVEAEQRPVAS

SEQ ID NO: 54480 - protein, 25 aa, synthetic construct
  source 1..25: note = Seed: VKLQTVHSIPLTINKEEALQRPVAS
VKLQTVHSIPFTIIKVEAFQRPVAS

SEQ ID NO: 54481 - protein, 25 aa, synthetic construct
  source 1..25: note = Seed: VKLQTVHSIPLTINKEEALQRPVAS
VKLQTVHSIPFTIIKVEAHQRPVAS

SEQ ID NO: 54482 - protein, 25 aa, synthetic construct
  source 1..25: note = Seed: VKLQTVHSIPLTINKEEALQRPVAS
VKLQTVHSIPFTIIKVEAIQRPVAS

SEQ ID NO: 54483 - protein, 25 aa, synthetic construct
  source 1..25: note = Seed: VKLQTVHSIPLTINKEEALQRPVAS
VKLQTVHSIPFTIIKVEAKQRPVAS

SEQ ID NO: 54484 - protein, 25 aa, synthetic construct
  source 1..25: note = Seed: VKLQTVHSIPLTINKEEALQRPVAS
VKLQTVHSIPFTIIKVEALQRPVAS

SEQ ID NO: 54485 - protein, 25 aa, synthetic construct
  source 1..25: note = Seed: VKLQTVHSIPLTINKEEALQRPVAS
VKLQTVHSIPFTIIKVEAMQRPVAS

SEQ ID NO: 54486 - protein, 25 aa, synthetic construct
  source 1..25: note = Seed: VKLQTVHSIPLTINKEEALQRPVAS
VKLQTVHSIPFTIIKVEANQRPVAS

SEQ ID NO: 54487 - protein, 25 aa, synthetic construct
  source 1..25: note = Seed: VKLQTVHSIPLTINKEEALQRPVAS
VKLQTVHSIPFTIIKVEAQQRPVAS

SEQ ID NO: 54488 - protein, 25 aa, synthetic construct
  source 1..25: note = Seed: VKLQTVHSIPLTINKEEALQRPVAS
VKLQTVHSIPFTIIKVEARQRPVAS

SEQ ID NO: 54489 - protein, 25 aa, synthetic construct
  source 1..25: note = Seed: VKLQTVHSIPLTINKEEALQRPVAS
VKLQTVHSIPFTIIKVEASQRPVAS

SEQ ID NO: 54490 - protein, 25 aa, synthetic construct
  source 1..25: note = Seed: VKLQTVHSIPLTINKEEALQRPVAS
VKLQTVHSIPFTIIKVEATQRPVAS

SEQ ID NO: 54491 - protein, 25 aa, synthetic construct
  source 1..25: note = Seed: VKLQTVHSIPLTINKEEALQRPVAS
VKLQTVHSIPFTIIKVEAVQRPVAS

SEQ ID NO: 54492 - protein, 25 aa, synthetic construct
  source 1..25: note = Seed: VKLQTVHSIPLTINKEEALQRPVAS
VKLQTVHSIPFTIIKVEAYQRPVAS

SEQ ID NO: 54493 - protein, 25 aa, synthetic construct
  source 1..25: note = Seed: VKLQTVHSIPLTINKEEALQRPVAS
VKLQTVHSIPFTIIKWEAAQRPVAS

SEQ ID NO: 54494 - protein, 25 aa, synthetic construct
  source 1..25: note = Seed: VKLQTVHSIPLTINKEEALQRPVAS
VKLQTVHSIPFTIIKWEACQRPVAS

SEQ ID NO: 54495 - protein, 25 aa, synthetic construct
  source 1..25: note = Seed: VKLQTVHSIPLTINKEEALQRPVAS
VKLQTVHSIPFTIIKWEADQRPVAS

SEQ ID NO: 54496 - protein, 25 aa, synthetic construct
  source 1..25: note = Seed: VKLQTVHSIPLTINKEEALQRPVAS
VKLQTVHSIPFTIIKWEAEQRPVAS

SEQ ID NO: 54497 - protein, 25 aa, synthetic construct
  source 1..25: note = Seed: VKLQTVHSIPLTINKEEALQRPVAS
VKLQTVHSIPFTIIKWEAFQRPVAS

SEQ ID NO: 54498 - protein, 25 aa, synthetic construct
  source 1..25: note = Seed: VKLQTVHSIPLTINKEEALQRPVAS
VKLQTVHSIPFTIIKWEAGQRPVAS

SEQ ID NO: 54499 - protein, 25 aa, synthetic construct
  source 1..25: note = Seed: VKLQTVHSIPLTINKEEALQRPVAS
VKLQTVHSIPFTIIKWEAHQRPVAS

SEQ ID NO: 54500 - protein, 25 aa, synthetic construct
  source 1..25: note = Seed: VKLQTVHSIPLTINKEEALQRPVAS
VKLQTVHSIPFTIIKWEAIQRPVAS

SEQ ID NO: 54501 - protein, 25 aa, synthetic construct
  source 1..25: note = Seed: VKLQTVHSIPLTINKEEALQRPVAS
VKLQTVHSIPFTIIKWEALQRPVAS

SEQ ID NO: 54502 - protein, 25 aa, synthetic construct
  source 1..25: note = Seed: VKLQTVHSIPLTINKEEALQRPVAS
VKLQTVHSIPFTIIKWEAMQRPVAS

SEQ ID NO: 54503 - protein, 25 aa, synthetic construct
  source 1..25: note = Seed: VKLQTVHSIPLTINKEEALQRPVAS
VKLQTVHSIPFTIIKWEANQRPVAS

SEQ ID NO: 54504 - protein, 25 aa, synthetic construct
  source 1..25: note = Seed: VKLQTVHSIPLTINKEEALQRPVAS
VKLQTVHSIPFTIIKWEAPQRPVAS

SEQ ID NO: 54505 - protein, 25 aa, synthetic construct
  source 1..25: note = Seed: VKLQTVHSIPLTINKEEALQRPVAS
VKLQTVHSIPFTIIKWEAQQRPVAS

SEQ ID NO: 54506 - protein, 25 aa, synthetic construct
  source 1..25: note = Seed: VKLQTVHSIPLTINKEEALQRPVAS
VKLQTVHSIPFTIIKWEASQRPVAS

SEQ ID NO: 54507 - protein, 25 aa, synthetic construct
  source 1..25: note = Seed: VKLQTVHSIPLTINKEEALQRPVAS
VKLQTVHSIPFTIIKWEATQRPVAS

SEQ ID NO: 54508 - protein, 25 aa, synthetic construct
  source 1..25: note = Seed: VKLQTVHSIPLTINKEEALQRPVAS
VKLQTVHSIPFTIIKWEAVQRPVAS

SEQ ID NO: 54509 - protein, 25 aa, synthetic construct
  source 1..25: note = Seed: VKLQTVHSIPLTINKEEALQRPVAS
VKLQTVHSIPFTIIKWEAYQRPVAS

SEQ ID NO: 54510 - protein, 25 aa, synthetic construct
  source 1..25: note = Seed: VKLQTVHSIPLTINKEEALQRPVAS
VKLQTVHSIPFTIIKYEAAQRPVAS

SEQ ID NO: 54511 - protein, 25 aa, synthetic construct
  source 1..25: note = Seed: VKLQTVHSIPLTINKEEALQRPVAS
VKLQTVHSIPFTIIKYEACQRPVAS

SEQ ID NO: 54512 - protein, 25 aa, synthetic construct
  source 1..25: note = Seed: VKLQTVHSIPLTINKEEALQRPVAS
VKLQTVHSIPFTIIKYEADQRPVAS

SEQ ID NO: 54513 - protein, 25 aa, synthetic construct
  source 1..25: note = Seed: VKLQTVHSIPLTINKEEALQRPVAS
VKLQTVHSIPFTIIKYEAEQRPVAS

SEQ ID NO: 54514 - protein, 25 aa, synthetic construct
  source 1..25: note = Seed: VKLQTVHSIPLTINKEEALQRPVAS
VKLQTVHSIPFTIIKYEAFQRPVAS

SEQ ID NO: 54515 - protein, 25 aa, synthetic construct
  source 1..25: note = Seed: VKLQTVHSIPLTINKEEALQRPVAS
VKLQTVHSIPFTIIKYEAGQRPVAS

SEQ ID NO: 54516 - protein, 25 aa, synthetic construct
  source 1..25: note = Seed: VKLQTVHSIPLTINKEEALQRPVAS
VKLQTVHSIPFTIIKYEAHQRPVAS

SEQ ID NO: 54517 - protein, 25 aa, synthetic construct
  source 1..25: note = Seed: VKLQTVHSIPLTINKEEALQRPVAS
VKLQTVHSIPFTIIKYEAIQRPVAS

SEQ ID NO: 54518 - protein, 25 aa, synthetic construct
  source 1..25: note = Seed: VKLQTVHSIPLTINKEEALQRPVAS
VKLQTVHSIPFTIIKYEALQRPVAS

SEQ ID NO: 54519 - protein, 25 aa, synthetic construct
  source 1..25: note = Seed: VKLQTVHSIPLTINKEEALQRPVAS
VKLQTVHSIPFTIIKYEAMQRPVAS

SEQ ID NO: 54520 - protein, 25 aa, synthetic construct
  source 1..25: note = Seed: VKLQTVHSIPLTINKEEALQRPVAS
VKLQTVHSIPFTIIKYEANQRPVAS

SEQ ID NO: 54521 - protein, 25 aa, synthetic construct
  source 1..25: note = Seed: VKLQTVHSIPLTINKEEALQRPVAS
VKLQTVHSIPFTIIKYEAPQRPVAS

SEQ ID NO: 54522 - protein, 25 aa, synthetic construct
  source 1..25: note = Seed: VKLQTVHSIPLTINKEEALQRPVAS
VKLQTVHSIPFTIIKYEAQQRPVAS

SEQ ID NO: 54523 - protein, 25 aa, synthetic construct
  source 1..25: note = Seed: VKLQTVHSIPLTINKEEALQRPVAS
VKLQTVHSIPFTIIKYEARQRPVAS

SEQ ID NO: 54524 - protein, 25 aa, synthetic construct
  source 1..25: note = Seed: VKLQTVHSIPLTINKEEALQRPVAS
VKLQTVHSIPFTIIKYEASQRPVAS

SEQ ID NO: 54525 - protein, 25 aa, synthetic construct
  source 1..25: note = Seed: VKLQTVHSIPLTINKEEALQRPVAS
VKLQTVHSIPFTIIKYEATQRPVAS

SEQ ID NO: 54526 - protein, 25 aa, synthetic construct
  source 1..25: note = Seed: VKLQTVHSIPLTINKEEALQRPVAS
VKLQTVHSIPFTIIKYEAVQRPVAS

SEQ ID NO: 54527 - protein, 25 aa, synthetic construct
  source 1..25: note = Seed: VKLQTVHSIPLTINKEEALQRPVAS
VKLQTVHSIPFTIIKYEAWQRPVAS

SEQ ID NO: 54528 - protein, 25 aa, synthetic construct
  source 1..25: note = Seed: VKLQTVHSIPLTINKEEALQRPVAS
VKLQTVHSIPFTIIKYEAYQRPVAS

SEQ ID NO: 54529 - protein, 25 aa, synthetic construct
  source 1..25: note = Seed: VKLQTVHSIPLTINKEEALQRPVAS
VKLQTVHSIPFTIKKFEAAQRPVAS

SEQ ID NO: 54530 - protein, 25 aa, synthetic construct
  source 1..25: note = Seed: VKLQTVHSIPLTINKEEALQRPVAS
VKLQTVHSIPFTIKKFEACQRPVAS

SEQ ID NO: 54531 - protein, 25 aa, synthetic construct
  source 1..25: note = Seed: VKLQTVHSIPLTINKEEALQRPVAS
VKLQTVHSIPFTIKKFEADQRPVAS

SEQ ID NO: 54532 - protein, 25 aa, synthetic construct
  source 1..25: note = Seed: VKLQTVHSIPLTINKEEALQRPVAS
VKLQTVHSIPFTIKKFEAEQRPVAS

SEQ ID NO: 54533 - protein, 25 aa, synthetic construct
  source 1..25: note = Seed: VKLQTVHSIPLTINKEEALQRPVAS
VKLQTVHSIPFTIKKFEAFQRPVAS

SEQ ID NO: 54534 - protein, 25 aa, synthetic construct
  source 1..25: note = Seed: VKLQTVHSIPLTINKEEALQRPVAS
VKLQTVHSIPFTIKKFEAIQRPVAS

SEQ ID NO: 54535 - protein, 25 aa, synthetic construct
  source 1..25: note = Seed: VKLQTVHSIPLTINKEEALQRPVAS
VKLQTVHSIPFTIKKFEALQRPVAS

SEQ ID NO: 54536 - protein, 25 aa, synthetic construct
  source 1..25: note = Seed: VKLQTVHSIPLTINKEEALQRPVAS
VKLQTVHSIPFTIKKFEAMQRPVAS

SEQ ID NO: 54537 - protein, 25 aa, synthetic construct
  source 1..25: note = Seed: VKLQTVHSIPLTINKEEALQRPVAS
VKLQTVHSIPFTIKKFEANQRPVAS

SEQ ID NO: 54538 - protein, 25 aa, synthetic construct
  source 1..25: note = Seed: VKLQTVHSIPLTINKEEALQRPVAS
VKLQTVHSIPFTIKKFEASQRPVAS

SEQ ID NO: 54539 - protein, 25 aa, synthetic construct
  source 1..25: note = Seed: VKLQTVHSIPLTINKEEALQRPVAS
VKLQTVHSIPFTIKKFEATQRPVAS

SEQ ID NO: 54540 - protein, 25 aa, synthetic construct
  source 1..25: note = Seed: VKLQTVHSIPLTINKEEALQRPVAS
VKLQTVHSIPFTIKKFEAVQRPVAS

SEQ ID NO: 54541 - protein, 25 aa, synthetic construct
  source 1..25: note = Seed: VKLQTVHSIPLTINKEEALQRPVAS
VKLQTVHSIPFTIKKFEAWQRPVAS

SEQ ID NO: 54542 - protein, 25 aa, synthetic construct
  source 1..25: note = Seed: VKLQTVHSIPLTINKEEALQRPVAS
VKLQTVHSIPFTIKKFEAYQRPVAS

SEQ ID NO: 54543 - protein, 25 aa, synthetic construct
  source 1..25: note = Seed: VKLQTVHSIPLTINKEEALQRPVAS
VKLQTVHSIPFTIKKIEAFQRPVAS

SEQ ID NO: 54544 - protein, 25 aa, synthetic construct
  source 1..25: note = Seed: VKLQTVHSIPLTINKEEALQRPVAS
VKLQTVHSIPFTIKKIEAIQRPVAS

SEQ ID NO: 54545 - protein, 25 aa, synthetic construct
  source 1..25: note = Seed: VKLQTVHSIPLTINKEEALQRPVAS
VKLQTVHSIPFTIKKIEALQRPVAS

SEQ ID NO: 54546 - protein, 25 aa, synthetic construct
  source 1..25: note = Seed: VKLQTVHSIPLTINKEEALQRPVAS
VKLQTVHSIPFTIKKLEAFQRPVAS

SEQ ID NO: 54547 - protein, 25 aa, synthetic construct
  source 1..25: note = Seed: VKLQTVHSIPLTINKEEALQRPVAS
VKLQTVHSIPFTIKKLEAIQRPVAS

SEQ ID NO: 54548 - protein, 25 aa, synthetic construct
  source 1..25: note = Seed: VKLQTVHSIPLTINKEEALQRPVAS
VKLQTVHSIPFTIKKLEALQRPVAS

SEQ ID NO: 54549 - protein, 25 aa, synthetic construct
  source 1..25: note = Seed: VKLQTVHSIPLTINKEEALQRPVAS
VKLQTVHSIPFTIKKLEAVQRPVAS

SEQ ID NO: 54550 - protein, 25 aa, synthetic construct
  source 1..25: note = Seed: VKLQTVHSIPLTINKEEALQRPVAS
VKLQTVHSIPFTIKKMEALQRPVAS

SEQ ID NO: 54551 - protein, 25 aa, synthetic construct
  source 1..25: note = Seed: VKLQTVHSIPLTINKEEALQRPVAS
VKLQTVHSIPFTIKKREAFQRPVAS

SEQ ID NO: 54552 - protein, 25 aa, synthetic construct
  source 1..25: note = Seed: VKLQTVHSIPLTINKEEALQRPVAS
VKLQTVHSIPFTIKKREAIQRPVAS

SEQ ID NO: 54553 - protein, 25 aa, synthetic construct
  source 1..25: note = Seed: VKLQTVHSIPLTINKEEALQRPVAS
VKLQTVHSIPFTIKKREALQRPVAS

SEQ ID NO: 54554 - protein, 25 aa, synthetic construct
  source 1..25: note = Seed: VKLQTVHSIPLTINKEEALQRPVAS
VKLQTVHSIPFTIKKSEAFQRPVAS

SEQ ID NO: 54555 - protein, 25 aa, synthetic construct
  source 1..25: note = Seed: VKLQTVHSIPLTINKEEALQRPVAS
VKLQTVHSIPFTIKKVEARQRPVAS

SEQ ID NO: 54556 - protein, 25 aa, synthetic construct
  source 1..25: note = Seed: VKLQTVHSIPLTINKEEALQRPVAS
VKLQTVHSIPFTIKKWEAFQRPVAS

SEQ ID NO: 54557 - protein, 25 aa, synthetic construct
  source 1..25: note = Seed: VKLQTVHSIPLTINKEEALQRPVAS
VKLQTVHSIPFTIKKWEAIQRPVAS

SEQ ID NO: 54558 - protein, 25 aa, synthetic construct
  source 1..25: note = Seed: VKLQTVHSIPLTINKEEALQRPVAS
VKLQTVHSIPFTIKKWEALQRPVAS

SEQ ID NO: 54559 - protein, 25 aa, synthetic construct
  source 1..25: note = Seed: VKLQTVHSIPLTINKEEALQRPVAS
VKLQTVHSIPFTIKKWEAVQRPVAS

SEQ ID NO: 54560 - protein, 25 aa, synthetic construct
  source 1..25: note = Seed: VKLQTVHSIPLTINKEEALQRPVAS
VKLQTVHSIPFTIKKYEAFQRPVAS

SEQ ID NO: 54561 - protein, 25 aa, synthetic construct
  source 1..25: note = Seed: VKLQTVHSIPLTINKEEALQRPVAS
VKLQTVHSIPFTIKKYEAIQRPVAS

SEQ ID NO: 54562 - protein, 25 aa, synthetic construct
  source 1..25: note = Seed: VKLQTVHSIPLTINKEEALQRPVAS
VKLQTVHSIPFTIKKYEALQRPVAS

SEQ ID NO: 54563 - protein, 25 aa, synthetic construct
  source 1..25: note = Seed: VKLQTVHSIPLTINKEEALQRPVAS
VKLQTVHSIPFTIKKYEAVQRPVAS

SEQ ID NO: 54564 - protein, 25 aa, synthetic construct
  source 1..25: note = Seed: VKLQTVHSIPLTINKEEALQRPVAS
VKLQTVHSIPFTILKAEAAQRPVAS

SEQ ID NO: 54565 - protein, 25 aa, synthetic construct
  source 1..25: note = Seed: VKLQTVHSIPLTINKEEALQRPVAS
VKLQTVHSIPFTILKAEADQRPVAS

SEQ ID NO: 54566 - protein, 25 aa, synthetic construct
  source 1..25: note = Seed: VKLQTVHSIPLTINKEEALQRPVAS
VKLQTVHSIPFTILKAEAEQRPVAS

SEQ ID NO: 54567 - protein, 25 aa, synthetic construct
  source 1..25: note = Seed: VKLQTVHSIPLTINKEEALQRPVAS
VKLQTVHSIPFTILKAEAFQRPVAS

SEQ ID NO: 54568 - protein, 25 aa, synthetic construct
  source 1..25: note = Seed: VKLQTVHSIPLTINKEEALQRPVAS
VKLQTVHSIPFTILKAEAIQRPVAS

SEQ ID NO: 54569 - protein, 25 aa, synthetic construct
  source 1..25: note = Seed: VKLQTVHSIPLTINKEEALQRPVAS
VKLQTVHSIPFTILKAEALQRPVAS

SEQ ID NO: 54570 - protein, 25 aa, synthetic construct
  source 1..25: note = Seed: VKLQTVHSIPLTINKEEALQRPVAS
VKLQTVHSIPFTILKAEAMQRPVAS

SEQ ID NO: 54571 - protein, 25 aa, synthetic construct
  source 1..25: note = Seed: VKLQTVHSIPLTINKEEALQRPVAS
VKLQTVHSIPFTILKAEAQQRPVAS

SEQ ID NO: 54572 - protein, 25 aa, synthetic construct
  source 1..25: note = Seed: VKLQTVHSIPLTINKEEALQRPVAS
VKLQTVHSIPFTILKAEARQRPVAS

SEQ ID NO: 54573 - protein, 25 aa, synthetic construct
  source 1..25: note = Seed: VKLQTVHSIPLTINKEEALQRPVAS
VKLQTVHSIPFTILKAEAVQRPVAS

SEQ ID NO: 54574 - protein, 25 aa, synthetic construct
  source 1..25: note = Seed: VKLQTVHSIPLTINKEEALQRPVAS
VKLQTVHSIPFTILKAEAYQRPVAS

SEQ ID NO: 54575 - protein, 25 aa, synthetic construct
  source 1..25: note = Seed: VKLQTVHSIPLTINKEEALQRPVAS
VKLQTVHSIPFTILKDEAIQRPVAS

SEQ ID NO: 54576 - protein, 25 aa, synthetic construct
  source 1..25: note = Seed: VKLQTVHSIPLTINKEEALQRPVAS
VKLQTVHSIPFTILKDEAVQRPVAS

SEQ ID NO: 54577 - protein, 25 aa, synthetic construct
  source 1..25: note = Seed: VKLQTVHSIPLTINKEEALQRPVAS
VKLQTVHSIPFTILKEEAEQRPVAS

SEQ ID NO: 54578 - protein, 25 aa, synthetic construct
  source 1..25: note = Seed: VKLQTVHSIPLTINKEEALQRPVAS
VKLQTVHSIPFTILKEEAIQRPVAS

SEQ ID NO: 54579 - protein, 25 aa, synthetic construct
  source 1..25: note = Seed: VKLQTVHSIPLTINKEEALQRPVAS
VKLQTVHSIPFTILKEEAVQRPVAS

SEQ ID NO: 54580 - protein, 25 aa, synthetic construct
  source 1..25: note = Seed: VKLQTVHSIPLTINKEEALQRPVAS
VKLQTVHSIPFTILKFEAAQRPVAS

SEQ ID NO: 54581 - protein, 25 aa, synthetic construct
  source 1..25: note = Seed: VKLQTVHSIPLTINKEEALQRPVAS
VKLQTVHSIPFTILKFEACQRPVAS

SEQ ID NO: 54582 - protein, 25 aa, synthetic construct
  source 1..25: note = Seed: VKLQTVHSIPLTINKEEALQRPVAS
VKLQTVHSIPFTILKFEADQRPVAS

SEQ ID NO: 54583 - protein, 25 aa, synthetic construct
  source 1..25: note = Seed: VKLQTVHSIPLTINKEEALQRPVAS
VKLQTVHSIPFTILKFEAEQRPVAS

SEQ ID NO: 54584 - protein, 25 aa, synthetic construct
  source 1..25: note = Seed: VKLQTVHSIPLTINKEEALQRPVAS
VKLQTVHSIPFTILKFEAFQRPVAS

SEQ ID NO: 54585 - protein, 25 aa, synthetic construct
  source 1..25: note = Seed: VKLQTVHSIPLTINKEEALQRPVAS
VKLQTVHSIPFTILKFEAGQRPVAS

SEQ ID NO: 54586 - protein, 25 aa, synthetic construct
  source 1..25: note = Seed: VKLQTVHSIPLTINKEEALQRPVAS
VKLQTVHSIPFTILKFEAHQRPVAS

SEQ ID NO: 54587 - protein, 25 aa, synthetic construct
  source 1..25: note = Seed: VKLQTVHSIPLTINKEEALQRPVAS
VKLQTVHSIPFTILKFEAIQRPVAS

SEQ ID NO: 54588 - protein, 25 aa, synthetic construct
  source 1..25: note = Seed: VKLQTVHSIPLTINKEEALQRPVAS
VKLQTVHSIPFTILKFEAKQRPVAS

SEQ ID NO: 54589 - protein, 25 aa, synthetic construct
  source 1..25: note = Seed: VKLQTVHSIPLTINKEEALQRPVAS
VKLQTVHSIPFTILKFEALQRPVAS

SEQ ID NO: 54590 - protein, 25 aa, synthetic construct
  source 1..25: note = Seed: VKLQTVHSIPLTINKEEALQRPVAS
VKLQTVHSIPFTILKFEAMQRPVAS

SEQ ID NO: 54591 - protein, 25 aa, synthetic construct
  source 1..25: note = Seed: VKLQTVHSIPLTINKEEALQRPVAS
VKLQTVHSIPFTILKFEANQRPVAS

SEQ ID NO: 54592 - protein, 25 aa, synthetic construct
  source 1..25: note = Seed: VKLQTVHSIPLTINKEEALQRPVAS
VKLQTVHSIPFTILKFEAPQRPVAS

SEQ ID NO: 54593 - protein, 25 aa, synthetic construct
  source 1..25: note = Seed: VKLQTVHSIPLTINKEEALQRPVAS
VKLQTVHSIPFTILKFEAQQRPVAS

SEQ ID NO: 54594 - protein, 25 aa, synthetic construct
  source 1..25: note = Seed: VKLQTVHSIPLTINKEEALQRPVAS
VKLQTVHSIPFTILKFEARQRPVAS

SEQ ID NO: 54595 - protein, 25 aa, synthetic construct
  source 1..25: note = Seed: VKLQTVHSIPLTINKEEALQRPVAS
VKLQTVHSIPFTILKFEASQRPVAS

SEQ ID NO: 54596 - protein, 25 aa, synthetic construct
  source 1..25: note = Seed: VKLQTVHSIPLTINKEEALQRPVAS
VKLQTVHSIPFTILKFEATQRPVAS

SEQ ID NO: 54597 - protein, 25 aa, synthetic construct
  source 1..25: note = Seed: VKLQTVHSIPLTINKEEALQRPVAS
VKLQTVHSIPFTILKFEAVQRPVAS

SEQ ID NO: 54598 - protein, 25 aa, synthetic construct
  source 1..25: note = Seed: VKLQTVHSIPLTINKEEALQRPVAS
VKLQTVHSIPFTILKFEAWQRPVAS

SEQ ID NO: 54599 - protein, 25 aa, synthetic construct
  source 1..25: note = Seed: VKLQTVHSIPLTINKEEALQRPVAS
VKLQTVHSIPFTILKFEAYQRPVAS

SEQ ID NO: 54600 - protein, 25 aa, synthetic construct
  source 1..25: note = Seed: VKLQTVHSIPLTINKEEALQRPVAS
VKLQTVHSIPFTILKHEAMQRPVAS

SEQ ID NO: 54601 - protein, 25 aa, synthetic construct
  source 1..25: note = Seed: VKLQTVHSIPLTINKEEALQRPVAS
VKLQTVHSIPFTILKHEAVQRPVAS

SEQ ID NO: 54602 - protein, 25 aa, synthetic construct
  source 1..25: note = Seed: VKLQTVHSIPLTINKEEALQRPVAS
VKLQTVHSIPFTILKHEAYQRPVAS

SEQ ID NO: 54603 - protein, 25 aa, synthetic construct
  source 1..25: note = Seed: VKLQTVHSIPLTINKEEALQRPVAS
VKLQTVHSIPFTILKIEAAQRPVAS

SEQ ID NO: 54604 - protein, 25 aa, synthetic construct
  source 1..25: note = Seed: VKLQTVHSIPLTINKEEALQRPVAS
VKLQTVHSIPFTILKIEADQRPVAS

SEQ ID NO: 54605 - protein, 25 aa, synthetic construct
  source 1..25: note = Seed: VKLQTVHSIPLTINKEEALQRPVAS
VKLQTVHSIPFTILKIEAEQRPVAS

SEQ ID NO: 54606 - protein, 25 aa, synthetic construct
  source 1..25: note = Seed: VKLQTVHSIPLTINKEEALQRPVAS
VKLQTVHSIPFTILKIEAFQRPVAS

SEQ ID NO: 54607 - protein, 25 aa, synthetic construct
  source 1..25: note = Seed: VKLQTVHSIPLTINKEEALQRPVAS
VKLQTVHSIPFTILKIEAGQRPVAS

SEQ ID NO: 54608 - protein, 25 aa, synthetic construct
  source 1..25: note = Seed: VKLQTVHSIPLTINKEEALQRPVAS
VKLQTVHSIPFTILKIEAHQRPVAS

SEQ ID NO: 54609 - protein, 25 aa, synthetic construct
  source 1..25: note = Seed: VKLQTVHSIPLTINKEEALQRPVAS
VKLQTVHSIPFTILKIEAIQRPVAS

SEQ ID NO: 54610 - protein, 25 aa, synthetic construct
  source 1..25: note = Seed: VKLQTVHSIPLTINKEEALQRPVAS
VKLQTVHSIPFTILKIEALQRPVAS

SEQ ID NO: 54611 - protein, 25 aa, synthetic construct
  source 1..25: note = Seed: VKLQTVHSIPLTINKEEALQRPVAS
VKLQTVHSIPFTILKIEAMQRPVAS

SEQ ID NO: 54612 - protein, 25 aa, synthetic construct
  source 1..25: note = Seed: VKLQTVHSIPLTINKEEALQRPVAS
VKLQTVHSIPFTILKIEANQRPVAS

SEQ ID NO: 54613 - protein, 25 aa, synthetic construct
  source 1..25: note = Seed: VKLQTVHSIPLTINKEEALQRPVAS
VKLQTVHSIPFTILKIEAQQRPVAS

SEQ ID NO: 54614 - protein, 25 aa, synthetic construct
  source 1..25: note = Seed: VKLQTVHSIPLTINKEEALQRPVAS
VKLQTVHSIPFTILKIEARQRPVAS

SEQ ID NO: 54615 - protein, 25 aa, synthetic construct
  source 1..25: note = Seed: VKLQTVHSIPLTINKEEALQRPVAS
VKLQTVHSIPFTILKIEASQRPVAS

SEQ ID NO: 54616 - protein, 25 aa, synthetic construct
  source 1..25: note = Seed: VKLQTVHSIPLTINKEEALQRPVAS
VKLQTVHSIPFTILKIEATQRPVAS

SEQ ID NO: 54617 - protein, 25 aa, synthetic construct
  source 1..25: note = Seed: VKLQTVHSIPLTINKEEALQRPVAS
VKLQTVHSIPFTILKIEAVQRPVAS

SEQ ID NO: 54618 - protein, 25 aa, synthetic construct
  source 1..25: note = Seed: VKLQTVHSIPLTINKEEALQRPVAS
VKLQTVHSIPFTILKIEAYQRPVAS

SEQ ID NO: 54619 - protein, 25 aa, synthetic construct
  source 1..25: note = Seed: VKLQTVHSIPLTINKEEALQRPVAS
VKLQTVHSIPFTILKKEALQRPVAS

SEQ ID NO: 54620 - protein, 25 aa, synthetic construct
  source 1..25: note = Seed: VKLQTVHSIPLTINKEEALQRPVAS
VKLQTVHSIPFTILKLEAAQRPVAS

SEQ ID NO: 54621 - protein, 25 aa, synthetic construct
  source 1..25: note = Seed: VKLQTVHSIPLTINKEEALQRPVAS
VKLQTVHSIPFTILKLEADQRPVAS

SEQ ID NO: 54622 - protein, 25 aa, synthetic construct
  source 1..25: note = Seed: VKLQTVHSIPLTINKEEALQRPVAS
VKLQTVHSIPFTILKLEAEQRPVAS

SEQ ID NO: 54623 - protein, 25 aa, synthetic construct
  source 1..25: note = Seed: VKLQTVHSIPLTINKEEALQRPVAS
VKLQTVHSIPFTILKLEAFQRPVAS

SEQ ID NO: 54624 - protein, 25 aa, synthetic construct
  source 1..25: note = Seed: VKLQTVHSIPLTINKEEALQRPVAS
VKLQTVHSIPFTILKLEAGQRPVAS

SEQ ID NO: 54625 - protein, 25 aa, synthetic construct
  source 1..25: note = Seed: VKLQTVHSIPLTINKEEALQRPVAS
VKLQTVHSIPFTILKLEAHQRPVAS

SEQ ID NO: 54626 - protein, 25 aa, synthetic construct
  source 1..25: note = Seed: VKLQTVHSIPLTINKEEALQRPVAS
VKLQTVHSIPFTILKLEAIQRPVAS

SEQ ID NO: 54627 - protein, 25 aa, synthetic construct
  source 1..25: note = Seed: VKLQTVHSIPLTINKEEALQRPVAS
VKLQTVHSIPFTILKLEALQRPVAS

SEQ ID NO: 54628 - protein, 25 aa, synthetic construct
  source 1..25: note = Seed: VKLQTVHSIPLTINKEEALQRPVAS
VKLQTVHSIPFTILKLEAMQRPVAS

SEQ ID NO: 54629 - protein, 25 aa, synthetic construct
  source 1..25: note = Seed: VKLQTVHSIPLTINKEEALQRPVAS
VKLQTVHSIPFTILKLEANQRPVAS

SEQ ID NO: 54630 - protein, 25 aa, synthetic construct
  source 1..25: note = Seed: VKLQTVHSIPLTINKEEALQRPVAS
VKLQTVHSIPFTILKLEAQQRPVAS

SEQ ID NO: 54631 - protein, 25 aa, synthetic construct
  source 1..25: note = Seed: VKLQTVHSIPLTINKEEALQRPVAS
VKLQTVHSIPFTILKLEARQRPVAS

SEQ ID NO: 54632 - protein, 25 aa, synthetic construct
  source 1..25: note = Seed: VKLQTVHSIPLTINKEEALQRPVAS
VKLQTVHSIPFTILKLEASQRPVAS

SEQ ID NO: 54633 - protein, 25 aa, synthetic construct
  source 1..25: note = Seed: VKLQTVHSIPLTINKEEALQRPVAS
VKLQTVHSIPFTILKLEATQRPVAS

SEQ ID NO: 54634 - protein, 25 aa, synthetic construct
  source 1..25: note = Seed: VKLQTVHSIPLTINKEEALQRPVAS
VKLQTVHSIPFTILKLEAVQRPVAS

SEQ ID NO: 54635 - protein, 25 aa, synthetic construct
  source 1..25: note = Seed: VKLQTVHSIPLTINKEEALQRPVAS
VKLQTVHSIPFTILKLEAYQRPVAS

SEQ ID NO: 54636 - protein, 25 aa, synthetic construct
  source 1..25: note = Seed: VKLQTVHSIPLTINKEEALQRPVAS
VKLQTVHSIPFTILKMEAAQRPVAS

SEQ ID NO: 54637 - protein, 25 aa, synthetic construct
  source 1..25: note = Seed: VKLQTVHSIPLTINKEEALQRPVAS
VKLQTVHSIPFTILKMEADQRPVAS

SEQ ID NO: 54638 - protein, 25 aa, synthetic construct
  source 1..25: note = Seed: VKLQTVHSIPLTINKEEALQRPVAS
VKLQTVHSIPFTILKMEAEQRPVAS

SEQ ID NO: 54639 - protein, 25 aa, synthetic construct
  source 1..25: note = Seed: VKLQTVHSIPLTINKEEALQRPVAS
VKLQTVHSIPFTILKMEAFQRPVAS

SEQ ID NO: 54640 - protein, 25 aa, synthetic construct
  source 1..25: note = Seed: VKLQTVHSIPLTINKEEALQRPVAS
VKLQTVHSIPFTILKMEAIQRPVAS

SEQ ID NO: 54641 - protein, 25 aa, synthetic construct
  source 1..25: note = Seed: VKLQTVHSIPLTINKEEALQRPVAS
VKLQTVHSIPFTILKMEALQRPVAS

SEQ ID NO: 54642 - protein, 25 aa, synthetic construct
  source 1..25: note = Seed: VKLQTVHSIPLTINKEEALQRPVAS
VKLQTVHSIPFTILKMEAMQRPVAS

SEQ ID NO: 54643 - protein, 25 aa, synthetic construct
  source 1..25: note = Seed: VKLQTVHSIPLTINKEEALQRPVAS
VKLQTVHSIPFTILKMEANQRPVAS

SEQ ID NO: 54644 - protein, 25 aa, synthetic construct
  source 1..25: note = Seed: VKLQTVHSIPLTINKEEALQRPVAS
VKLQTVHSIPFTILKMEAQQRPVAS

SEQ ID NO: 54645 - protein, 25 aa, synthetic construct
  source 1..25: note = Seed: VKLQTVHSIPLTINKEEALQRPVAS
VKLQTVHSIPFTILKMEARQRPVAS

SEQ ID NO: 54646 - protein, 25 aa, synthetic construct
  source 1..25: note = Seed: VKLQTVHSIPLTINKEEALQRPVAS
VKLQTVHSIPFTILKMEASQRPVAS

SEQ ID NO: 54647 - protein, 25 aa, synthetic construct
  source 1..25: note = Seed: VKLQTVHSIPLTINKEEALQRPVAS
VKLQTVHSIPFTILKMEATQRPVAS

SEQ ID NO: 54648 - protein, 25 aa, synthetic construct
  source 1..25: note = Seed: VKLQTVHSIPLTINKEEALQRPVAS
VKLQTVHSIPFTILKMEAVQRPVAS

SEQ ID NO: 54649 - protein, 25 aa, synthetic construct
  source 1..25: note = Seed: VKLQTVHSIPLTINKEEALQRPVAS
VKLQTVHSIPFTILKMEAYQRPVAS

SEQ ID NO: 54650 - protein, 25 aa, synthetic construct
  source 1..25: note = Seed: VKLQTVHSIPLTINKEEALQRPVAS
VKLQTVHSIPFTILKNEAAQRPVAS

SEQ ID NO: 54651 - protein, 25 aa, synthetic construct
  source 1..25: note = Seed: VKLQTVHSIPLTINKEEALQRPVAS
VKLQTVHSIPFTILKNEADQRPVAS

SEQ ID NO: 54652 - protein, 25 aa, synthetic construct
  source 1..25: note = Seed: VKLQTVHSIPLTINKEEALQRPVAS
VKLQTVHSIPFTILKNEAEQRPVAS

SEQ ID NO: 54653 - protein, 25 aa, synthetic construct
  source 1..25: note = Seed: VKLQTVHSIPLTINKEEALQRPVAS
VKLQTVHSIPFTILKNEAHQRPVAS

SEQ ID NO: 54654 - protein, 25 aa, synthetic construct
  source 1..25: note = Seed: VKLQTVHSIPLTINKEEALQRPVAS
VKLQTVHSIPFTILKNEAIQRPVAS

SEQ ID NO: 54655 - protein, 25 aa, synthetic construct
  source 1..25: note = Seed: VKLQTVHSIPLTINKEEALQRPVAS
VKLQTVHSIPFTILKNEALQRPVAS

SEQ ID NO: 54656 - protein, 25 aa, synthetic construct
  source 1..25: note = Seed: VKLQTVHSIPLTINKEEALQRPVAS
VKLQTVHSIPFTILKNEAMQRPVAS

SEQ ID NO: 54657 - protein, 25 aa, synthetic construct
  source 1..25: note = Seed: VKLQTVHSIPLTINKEEALQRPVAS
VKLQTVHSIPFTILKNEANQRPVAS

SEQ ID NO: 54658 - protein, 25 aa, synthetic construct
  source 1..25: note = Seed: VKLQTVHSIPLTINKEEALQRPVAS
VKLQTVHSIPFTILKNEASQRPVAS

SEQ ID NO: 54659 - protein, 25 aa, synthetic construct
  source 1..25: note = Seed: VKLQTVHSIPLTINKEEALQRPVAS
VKLQTVHSIPFTILKNEATQRPVAS

SEQ ID NO: 54660 - protein, 25 aa, synthetic construct
  source 1..25: note = Seed: VKLQTVHSIPLTINKEEALQRPVAS
VKLQTVHSIPFTILKNEAVQRPVAS

SEQ ID NO: 54661 - protein, 25 aa, synthetic construct
  source 1..25: note = Seed: VKLQTVHSIPLTINKEEALQRPVAS
VKLQTVHSIPFTILKPEAIQRPVAS

SEQ ID NO: 54662 - protein, 25 aa, synthetic construct
  source 1..25: note = Seed: VKLQTVHSIPLTINKEEALQRPVAS
VKLQTVHSIPFTILKPEALQRPVAS

SEQ ID NO: 54663 - protein, 25 aa, synthetic construct
  source 1..25: note = Seed: VKLQTVHSIPLTINKEEALQRPVAS
VKLQTVHSIPFTILKPEAMQRPVAS

SEQ ID NO: 54664 - protein, 25 aa, synthetic construct
  source 1..25: note = Seed: VKLQTVHSIPLTINKEEALQRPVAS
VKLQTVHSIPFTILKPEAVQRPVAS

SEQ ID NO: 54665 - protein, 25 aa, synthetic construct
  source 1..25: note = Seed: VKLQTVHSIPLTINKEEALQRPVAS
VKLQTVHSIPFTILKREAFQRPVAS

SEQ ID NO: 54666 - protein, 25 aa, synthetic construct
  source 1..25: note = Seed: VKLQTVHSIPLTINKEEALQRPVAS
VKLQTVHSIPFTILKREAIQRPVAS

SEQ ID NO: 54667 - protein, 25 aa, synthetic construct
  source 1..25: note = Seed: VKLQTVHSIPLTINKEEALQRPVAS
VKLQTVHSIPFTILKREALQRPVAS

SEQ ID NO: 54668 - protein, 25 aa, synthetic construct
  source 1..25: note = Seed: VKLQTVHSIPLTINKEEALQRPVAS
VKLQTVHSIPFTILKREAMQRPVAS

SEQ ID NO: 54669 - protein, 25 aa, synthetic construct
  source 1..25: note = Seed: VKLQTVHSIPLTINKEEALQRPVAS
VKLQTVHSIPFTILKREARQRPVAS

SEQ ID NO: 54670 - protein, 25 aa, synthetic construct
  source 1..25: note = Seed: VKLQTVHSIPLTINKEEALQRPVAS
VKLQTVHSIPFTILKREAVQRPVAS

SEQ ID NO: 54671 - protein, 25 aa, synthetic construct
  source 1..25: note = Seed: VKLQTVHSIPLTINKEEALQRPVAS
VKLQTVHSIPFTILKREAYQRPVAS

SEQ ID NO: 54672 - protein, 25 aa, synthetic construct
  source 1..25: note = Seed: VKLQTVHSIPLTINKEEALQRPVAS
VKLQTVHSIPFTILKSEAAQRPVAS

SEQ ID NO: 54673 - protein, 25 aa, synthetic construct
  source 1..25: note = Seed: VKLQTVHSIPLTINKEEALQRPVAS
VKLQTVHSIPFTILKSEADQRPVAS

SEQ ID NO: 54674 - protein, 25 aa, synthetic construct
  source 1..25: note = Seed: VKLQTVHSIPLTINKEEALQRPVAS
VKLQTVHSIPFTILKSEAEQRPVAS

SEQ ID NO: 54675 - protein, 25 aa, synthetic construct
  source 1..25: note = Seed: VKLQTVHSIPLTINKEEALQRPVAS
VKLQTVHSIPFTILKSEAIQRPVAS

SEQ ID NO: 54676 - protein, 25 aa, synthetic construct
  source 1..25: note = Seed: VKLQTVHSIPLTINKEEALQRPVAS
VKLQTVHSIPFTILKSEALQRPVAS

SEQ ID NO: 54677 - protein, 25 aa, synthetic construct
  source 1..25: note = Seed: VKLQTVHSIPLTINKEEALQRPVAS
VKLQTVHSIPFTILKSEASQRPVAS

SEQ ID NO: 54678 - protein, 25 aa, synthetic construct
  source 1..25: note = Seed: VKLQTVHSIPLTINKEEALQRPVAS
VKLQTVHSIPFTILKSEAVQRPVAS

SEQ ID NO: 54679 - protein, 25 aa, synthetic construct
  source 1..25: note = Seed: VKLQTVHSIPLTINKEEALQRPVAS
VKLQTVHSIPFTILKTEAAQRPVAS

SEQ ID NO: 54680 - protein, 25 aa, synthetic construct
  source 1..25: note = Seed: VKLQTVHSIPLTINKEEALQRPVAS
VKLQTVHSIPFTILKTEADQRPVAS

SEQ ID NO: 54681 - protein, 25 aa, synthetic construct
  source 1..25: note = Seed: VKLQTVHSIPLTINKEEALQRPVAS
VKLQTVHSIPFTILKTEAEQRPVAS

SEQ ID NO: 54682 - protein, 25 aa, synthetic construct
  source 1..25: note = Seed: VKLQTVHSIPLTINKEEALQRPVAS
VKLQTVHSIPFTILKTEAHQRPVAS

SEQ ID NO: 54683 - protein, 25 aa, synthetic construct
  source 1..25: note = Seed: VKLQTVHSIPLTINKEEALQRPVAS
VKLQTVHSIPFTILKTEAIQRPVAS

SEQ ID NO: 54684 - protein, 25 aa, synthetic construct
  source 1..25: note = Seed: VKLQTVHSIPLTINKEEALQRPVAS
VKLQTVHSIPFTILKTEALQRPVAS

SEQ ID NO: 54685 - protein, 25 aa, synthetic construct
  source 1..25: note = Seed: VKLQTVHSIPLTINKEEALQRPVAS
VKLQTVHSIPFTILKTEAMQRPVAS

SEQ ID NO: 54686 - protein, 25 aa, synthetic construct
  source 1..25: note = Seed: VKLQTVHSIPLTINKEEALQRPVAS
VKLQTVHSIPFTILKTEARQRPVAS

SEQ ID NO: 54687 - protein, 25 aa, synthetic construct
  source 1..25: note = Seed: VKLQTVHSIPLTINKEEALQRPVAS
VKLQTVHSIPFTILKTEASQRPVAS

SEQ ID NO: 54688 - protein, 25 aa, synthetic construct
  source 1..25: note = Seed: VKLQTVHSIPLTINKEEALQRPVAS
VKLQTVHSIPFTILKTEATQRPVAS

SEQ ID NO: 54689 - protein, 25 aa, synthetic construct
  source 1..25: note = Seed: VKLQTVHSIPLTINKEEALQRPVAS
VKLQTVHSIPFTILKTEAVQRPVAS

SEQ ID NO: 54690 - protein, 25 aa, synthetic construct
  source 1..25: note = Seed: VKLQTVHSIPLTINKEEALQRPVAS
VKLQTVHSIPFTILKTEAYQRPVAS

SEQ ID NO: 54691 - protein, 25 aa, synthetic construct
  source 1..25: note = Seed: VKLQTVHSIPLTINKEEALQRPVAS
VKLQTVHSIPFTILKVEAAQRPVAS

SEQ ID NO: 54692 - protein, 25 aa, synthetic construct
  source 1..25: note = Seed: VKLQTVHSIPLTINKEEALQRPVAS
VKLQTVHSIPFTILKVEADQRPVAS

SEQ ID NO: 54693 - protein, 25 aa, synthetic construct
  source 1..25: note = Seed: VKLQTVHSIPLTINKEEALQRPVAS
VKLQTVHSIPFTILKVEAEQRPVAS

SEQ ID NO: 54694 - protein, 25 aa, synthetic construct
  source 1..25: note = Seed: VKLQTVHSIPLTINKEEALQRPVAS
VKLQTVHSIPFTILKVEAFQRPVAS

SEQ ID NO: 54695 - protein, 25 aa, synthetic construct
  source 1..25: note = Seed: VKLQTVHSIPLTINKEEALQRPVAS
VKLQTVHSIPFTILKVEAIQRPVAS

SEQ ID NO: 54696 - protein, 25 aa, synthetic construct
  source 1..25: note = Seed: VKLQTVHSIPLTINKEEALQRPVAS
VKLQTVHSIPFTILKVEALQRPVAS

SEQ ID NO: 54697 - protein, 25 aa, synthetic construct
  source 1..25: note = Seed: VKLQTVHSIPLTINKEEALQRPVAS
VKLQTVHSIPFTILKVEAMQRPVAS

SEQ ID NO: 54698 - protein, 25 aa, synthetic construct
  source 1..25: note = Seed: VKLQTVHSIPLTINKEEALQRPVAS
VKLQTVHSIPFTILKVEANQRPVAS

SEQ ID NO: 54699 - protein, 25 aa, synthetic construct
  source 1..25: note = Seed: VKLQTVHSIPLTINKEEALQRPVAS
VKLQTVHSIPFTILKVEAQQRPVAS

SEQ ID NO: 54700 - protein, 25 aa, synthetic construct
  source 1..25: note = Seed: VKLQTVHSIPLTINKEEALQRPVAS
VKLQTVHSIPFTILKVEARQRPVAS

SEQ ID NO: 54701 - protein, 25 aa, synthetic construct
  source 1..25: note = Seed: VKLQTVHSIPLTINKEEALQRPVAS
VKLQTVHSIPFTILKVEASQRPVAS

SEQ ID NO: 54702 - protein, 25 aa, synthetic construct
  source 1..25: note = Seed: VKLQTVHSIPLTINKEEALQRPVAS
VKLQTVHSIPFTILKVEAVQRPVAS

SEQ ID NO: 54703 - protein, 25 aa, synthetic construct
  source 1..25: note = Seed: VKLQTVHSIPLTINKEEALQRPVAS
VKLQTVHSIPFTILKVEAYQRPVAS

SEQ ID NO: 54704 - protein, 25 aa, synthetic construct
  source 1..25: note = Seed: VKLQTVHSIPLTINKEEALQRPVAS
VKLQTVHSIPFTILKWEAAQRPVAS

SEQ ID NO: 54705 - protein, 25 aa, synthetic construct
  source 1..25: note = Seed: VKLQTVHSIPLTINKEEALQRPVAS
VKLQTVHSIPFTILKWEADQRPVAS

SEQ ID NO: 54706 - protein, 25 aa, synthetic construct
  source 1..25: note = Seed: VKLQTVHSIPLTINKEEALQRPVAS
VKLQTVHSIPFTILKWEAEQRPVAS

SEQ ID NO: 54707 - protein, 25 aa, synthetic construct
  source 1..25: note = Seed: VKLQTVHSIPLTINKEEALQRPVAS
VKLQTVHSIPFTILKWEAFQRPVAS

SEQ ID NO: 54708 - protein, 25 aa, synthetic construct
  source 1..25: note = Seed: VKLQTVHSIPLTINKEEALQRPVAS
VKLQTVHSIPFTILKWEAHQRPVAS

SEQ ID NO: 54709 - protein, 25 aa, synthetic construct
  source 1..25: note = Seed: VKLQTVHSIPLTINKEEALQRPVAS
VKLQTVHSIPFTILKWEAIQRPVAS

SEQ ID NO: 54710 - protein, 25 aa, synthetic construct
  source 1..25: note = Seed: VKLQTVHSIPLTINKEEALQRPVAS
VKLQTVHSIPFTILKWEALQRPVAS

SEQ ID NO: 54711 - protein, 25 aa, synthetic construct
  source 1..25: note = Seed: VKLQTVHSIPLTINKEEALQRPVAS
VKLQTVHSIPFTILKWEAMQRPVAS

SEQ ID NO: 54712 - protein, 25 aa, synthetic construct
  source 1..25: note = Seed: VKLQTVHSIPLTINKEEALQRPVAS
VKLQTVHSIPFTILKWEANQRPVAS

SEQ ID NO: 54713 - protein, 25 aa, synthetic construct
  source 1..25: note = Seed: VKLQTVHSIPLTINKEEALQRPVAS
VKLQTVHSIPFTILKWEAQQRPVAS

SEQ ID NO: 54714 - protein, 25 aa, synthetic construct
  source 1..25: note = Seed: VKLQTVHSIPLTINKEEALQRPVAS
VKLQTVHSIPFTILKWEASQRPVAS

SEQ ID NO: 54715 - protein, 25 aa, synthetic construct
  source 1..25: note = Seed: VKLQTVHSIPLTINKEEALQRPVAS
VKLQTVHSIPFTILKWEATQRPVAS

SEQ ID NO: 54716 - protein, 25 aa, synthetic construct
  source 1..25: note = Seed: VKLQTVHSIPLTINKEEALQRPVAS
VKLQTVHSIPFTILKWEAVQRPVAS

SEQ ID NO: 54717 - protein, 25 aa, synthetic construct
  source 1..25: note = Seed: VKLQTVHSIPLTINKEEALQRPVAS
VKLQTVHSIPFTILKWEAYQRPVAS

SEQ ID NO: 54718 - protein, 25 aa, synthetic construct
  source 1..25: note = Seed: VKLQTVHSIPLTINKEEALQRPVAS
VKLQTVHSIPFTILKYEAAQRPVAS

SEQ ID NO: 54719 - protein, 25 aa, synthetic construct
  source 1..25: note = Seed: VKLQTVHSIPLTINKEEALQRPVAS
VKLQTVHSIPFTILKYEACQRPVAS

SEQ ID NO: 54720 - protein, 25 aa, synthetic construct
  source 1..25: note = Seed: VKLQTVHSIPLTINKEEALQRPVAS
VKLQTVHSIPFTILKYEADQRPVAS

SEQ ID NO: 54721 - protein, 25 aa, synthetic construct
  source 1..25: note = Seed: VKLQTVHSIPLTINKEEALQRPVAS
VKLQTVHSIPFTILKYEAEQRPVAS

SEQ ID NO: 54722 - protein, 25 aa, synthetic construct
  source 1..25: note = Seed: VKLQTVHSIPLTINKEEALQRPVAS
VKLQTVHSIPFTILKYEAFQRPVAS

SEQ ID NO: 54723 - protein, 25 aa, synthetic construct
  source 1..25: note = Seed: VKLQTVHSIPLTINKEEALQRPVAS
VKLQTVHSIPFTILKYEAGQRPVAS

SEQ ID NO: 54724 - protein, 25 aa, synthetic construct
  source 1..25: note = Seed: VKLQTVHSIPLTINKEEALQRPVAS
VKLQTVHSIPFTILKYEAHQRPVAS

SEQ ID NO: 54725 - protein, 25 aa, synthetic construct
  source 1..25: note = Seed: VKLQTVHSIPLTINKEEALQRPVAS
VKLQTVHSIPFTILKYEAIQRPVAS

SEQ ID NO: 54726 - protein, 25 aa, synthetic construct
  source 1..25: note = Seed: VKLQTVHSIPLTINKEEALQRPVAS
VKLQTVHSIPFTILKYEALQRPVAS

SEQ ID NO: 54727 - protein, 25 aa, synthetic construct
  source 1..25: note = Seed: VKLQTVHSIPLTINKEEALQRPVAS
VKLQTVHSIPFTILKYEAMQRPVAS

SEQ ID NO: 54728 - protein, 25 aa, synthetic construct
  source 1..25: note = Seed: VKLQTVHSIPLTINKEEALQRPVAS
VKLQTVHSIPFTILKYEANQRPVAS

SEQ ID NO: 54729 - protein, 25 aa, synthetic construct
  source 1..25: note = Seed: VKLQTVHSIPLTINKEEALQRPVAS
VKLQTVHSIPFTILKYEAPQRPVAS

SEQ ID NO: 54730 - protein, 25 aa, synthetic construct
  source 1..25: note = Seed: VKLQTVHSIPLTINKEEALQRPVAS
VKLQTVHSIPFTILKYEAQQRPVAS

SEQ ID NO: 54731 - protein, 25 aa, synthetic construct
  source 1..25: note = Seed: VKLQTVHSIPLTINKEEALQRPVAS
VKLQTVHSIPFTILKYEARQRPVAS

SEQ ID NO: 54732 - protein, 25 aa, synthetic construct
  source 1..25: note = Seed: VKLQTVHSIPLTINKEEALQRPVAS
VKLQTVHSIPFTILKYEASQRPVAS

SEQ ID NO: 54733 - protein, 25 aa, synthetic construct
  source 1..25: note = Seed: VKLQTVHSIPLTINKEEALQRPVAS
VKLQTVHSIPFTILKYEATQRPVAS

SEQ ID NO: 54734 - protein, 25 aa, synthetic construct
  source 1..25: note = Seed: VKLQTVHSIPLTINKEEALQRPVAS
VKLQTVHSIPFTILKYEAVQRPVAS

SEQ ID NO: 54735 - protein, 25 aa, synthetic construct
  source 1..25: note = Seed: VKLQTVHSIPLTINKEEALQRPVAS
VKLQTVHSIPFTILKYEAYQRPVAS

SEQ ID NO: 54736 - protein, 25 aa, synthetic construct
  source 1..25: note = Seed: VKLQTVHSIPLTINKEEALQRPVAS
VKLQTVHSIPFTIMKAEAAQRPVAS

SEQ ID NO: 54737 - protein, 25 aa, synthetic construct
  source 1..25: note = Seed: VKLQTVHSIPLTINKEEALQRPVAS
VKLQTVHSIPFTIMKAEADQRPVAS

SEQ ID NO: 54738 - protein, 25 aa, synthetic construct
  source 1..25: note = Seed: VKLQTVHSIPLTINKEEALQRPVAS
VKLQTVHSIPFTIMKAEAEQRPVAS

SEQ ID NO: 54739 - protein, 25 aa, synthetic construct
  source 1..25: note = Seed: VKLQTVHSIPLTINKEEALQRPVAS
VKLQTVHSIPFTIMKAEAFQRPVAS

SEQ ID NO: 54740 - protein, 25 aa, synthetic construct
  source 1..25: note = Seed: VKLQTVHSIPLTINKEEALQRPVAS
VKLQTVHSIPFTIMKAEAIQRPVAS

SEQ ID NO: 54741 - protein, 25 aa, synthetic construct
  source 1..25: note = Seed: VKLQTVHSIPLTINKEEALQRPVAS
VKLQTVHSIPFTIMKAEALQRPVAS

SEQ ID NO: 54742 - protein, 25 aa, synthetic construct
  source 1..25: note = Seed: VKLQTVHSIPLTINKEEALQRPVAS
VKLQTVHSIPFTIMKAEAMQRPVAS

SEQ ID NO: 54743 - protein, 25 aa, synthetic construct
  source 1..25: note = Seed: VKLQTVHSIPLTINKEEALQRPVAS
VKLQTVHSIPFTIMKAEARQRPVAS

SEQ ID NO: 54744 - protein, 25 aa, synthetic construct
  source 1..25: note = Seed: VKLQTVHSIPLTINKEEALQRPVAS
VKLQTVHSIPFTIMKAEAVQRPVAS

SEQ ID NO: 54745 - protein, 25 aa, synthetic construct
  source 1..25: note = Seed: VKLQTVHSIPLTINKEEALQRPVAS
VKLQTVHSIPFTIMKAEAYQRPVAS

SEQ ID NO: 54746 - protein, 25 aa, synthetic construct
  source 1..25: note = Seed: VKLQTVHSIPLTINKEEALQRPVAS
VKLQTVHSIPFTIMKCEAVQRPVAS

SEQ ID NO: 54747 - protein, 25 aa, synthetic construct
  source 1..25: note = Seed: VKLQTVHSIPLTINKEEALQRPVAS
VKLQTVHSIPFTIMKDEAIQRPVAS

SEQ ID NO: 54748 - protein, 25 aa, synthetic construct
  source 1..25: note = Seed: VKLQTVHSIPLTINKEEALQRPVAS
VKLQTVHSIPFTIMKDEALQRPVAS

SEQ ID NO: 54749 - protein, 25 aa, synthetic construct
  source 1..25: note = Seed: VKLQTVHSIPLTINKEEALQRPVAS
VKLQTVHSIPFTIMKDEAVQRPVAS

SEQ ID NO: 54750 - protein, 25 aa, synthetic construct
  source 1..25: note = Seed: VKLQTVHSIPLTINKEEALQRPVAS
VKLQTVHSIPFTIMKEEALQRPVAS

SEQ ID NO: 54751 - protein, 25 aa, synthetic construct
  source 1..25: note = Seed: VKLQTVHSIPLTINKEEALQRPVAS
VKLQTVHSIPFTIMKFEAAQRPVAS

SEQ ID NO: 54752 - protein, 25 aa, synthetic construct
  source 1..25: note = Seed: VKLQTVHSIPLTINKEEALQRPVAS
VKLQTVHSIPFTIMKFEACQRPVAS

SEQ ID NO: 54753 - protein, 25 aa, synthetic construct
  source 1..25: note = Seed: VKLQTVHSIPLTINKEEALQRPVAS
VKLQTVHSIPFTIMKFEADQRPVAS

SEQ ID NO: 54754 - protein, 25 aa, synthetic construct
  source 1..25: note = Seed: VKLQTVHSIPLTINKEEALQRPVAS
VKLQTVHSIPFTIMKFEAEQRPVAS

SEQ ID NO: 54755 - protein, 25 aa, synthetic construct
  source 1..25: note = Seed: VKLQTVHSIPLTINKEEALQRPVAS
VKLQTVHSIPFTIMKFEAFQRPVAS

SEQ ID NO: 54756 - protein, 25 aa, synthetic construct
  source 1..25: note = Seed: VKLQTVHSIPLTINKEEALQRPVAS
VKLQTVHSIPFTIMKFEAGQRPVAS

SEQ ID NO: 54757 - protein, 25 aa, synthetic construct
  source 1..25: note = Seed: VKLQTVHSIPLTINKEEALQRPVAS
VKLQTVHSIPFTIMKFEAHQRPVAS

SEQ ID NO: 54758 - protein, 25 aa, synthetic construct
  source 1..25: note = Seed: VKLQTVHSIPLTINKEEALQRPVAS
VKLQTVHSIPFTIMKFEAIQRPVAS

SEQ ID NO: 54759 - protein, 25 aa, synthetic construct
  source 1..25: note = Seed: VKLQTVHSIPLTINKEEALQRPVAS
VKLQTVHSIPFTIMKFEAKQRPVAS

SEQ ID NO: 54760 - protein, 25 aa, synthetic construct
  source 1..25: note = Seed: VKLQTVHSIPLTINKEEALQRPVAS
VKLQTVHSIPFTIMKFEALQRPVAS

SEQ ID NO: 54761 - protein, 25 aa, synthetic construct
  source 1..25: note = Seed: VKLQTVHSIPLTINKEEALQRPVAS
VKLQTVHSIPFTIMKFEAMQRPVAS

SEQ ID NO: 54762 - protein, 25 aa, synthetic construct
  source 1..25: note = Seed: VKLQTVHSIPLTINKEEALQRPVAS
VKLQTVHSIPFTIMKFEANQRPVAS

SEQ ID NO: 54763 - protein, 25 aa, synthetic construct
  source 1..25: note = Seed: VKLQTVHSIPLTINKEEALQRPVAS
VKLQTVHSIPFTIMKFEAPQRPVAS

SEQ ID NO: 54764 - protein, 25 aa, synthetic construct
  source 1..25: note = Seed: VKLQTVHSIPLTINKEEALQRPVAS
VKLQTVHSIPFTIMKFEAQQRPVAS

SEQ ID NO: 54765 - protein, 25 aa, synthetic construct
  source 1..25: note = Seed: VKLQTVHSIPLTINKEEALQRPVAS
VKLQTVHSIPFTIMKFEARQRPVAS

SEQ ID NO: 54766 - protein, 25 aa, synthetic construct
  source 1..25: note = Seed: VKLQTVHSIPLTINKEEALQRPVAS
VKLQTVHSIPFTIMKFEASQRPVAS

SEQ ID NO: 54767 - protein, 25 aa, synthetic construct
  source 1..25: note = Seed: VKLQTVHSIPLTINKEEALQRPVAS
VKLQTVHSIPFTIMKFEATQRPVAS

SEQ ID NO: 54768 - protein, 25 aa, synthetic construct
  source 1..25: note = Seed: VKLQTVHSIPLTINKEEALQRPVAS
VKLQTVHSIPFTIMKFEAVQRPVAS

SEQ ID NO: 54769 - protein, 25 aa, synthetic construct
  source 1..25: note = Seed: VKLQTVHSIPLTINKEEALQRPVAS
VKLQTVHSIPFTIMKFEAWQRPVAS

SEQ ID NO: 54770 - protein, 25 aa, synthetic construct
  source 1..25: note = Seed: VKLQTVHSIPLTINKEEALQRPVAS
VKLQTVHSIPFTIMKFEAYQRPVAS

SEQ ID NO: 54771 - protein, 25 aa, synthetic construct
  source 1..25: note = Seed: VKLQTVHSIPLTINKEEALQRPVAS
VKLQTVHSIPFTIMKHEAIQRPVAS

SEQ ID NO: 54772 - protein, 25 aa, synthetic construct
  source 1..25: note = Seed: VKLQTVHSIPLTINKEEALQRPVAS
VKLQTVHSIPFTIMKHEALQRPVAS

SEQ ID NO: 54773 - protein, 25 aa, synthetic construct
  source 1..25: note = Seed: VKLQTVHSIPLTINKEEALQRPVAS
VKLQTVHSIPFTIMKHEAMQRPVAS

SEQ ID NO: 54774 - protein, 25 aa, synthetic construct
  source 1..25: note = Seed: VKLQTVHSIPLTINKEEALQRPVAS
VKLQTVHSIPFTIMKHEAYQRPVAS

SEQ ID NO: 54775 - protein, 25 aa, synthetic construct
  source 1..25: note = Seed: VKLQTVHSIPLTINKEEALQRPVAS
VKLQTVHSIPFTIMKIEAAQRPVAS

SEQ ID NO: 54776 - protein, 25 aa, synthetic construct
  source 1..25: note = Seed: VKLQTVHSIPLTINKEEALQRPVAS
VKLQTVHSIPFTIMKIEADQRPVAS

SEQ ID NO: 54777 - protein, 25 aa, synthetic construct
  source 1..25: note = Seed: VKLQTVHSIPLTINKEEALQRPVAS
VKLQTVHSIPFTIMKIEAEQRPVAS

SEQ ID NO: 54778 - protein, 25 aa, synthetic construct
  source 1..25: note = Seed: VKLQTVHSIPLTINKEEALQRPVAS
VKLQTVHSIPFTIMKIEAFQRPVAS

SEQ ID NO: 54779 - protein, 25 aa, synthetic construct
  source 1..25: note = Seed: VKLQTVHSIPLTINKEEALQRPVAS
VKLQTVHSIPFTIMKIEAGQRPVAS

SEQ ID NO: 54780 - protein, 25 aa, synthetic construct
  source 1..25: note = Seed: VKLQTVHSIPLTINKEEALQRPVAS
VKLQTVHSIPFTIMKIEAHQRPVAS

SEQ ID NO: 54781 - protein, 25 aa, synthetic construct
  source 1..25: note = Seed: VKLQTVHSIPLTINKEEALQRPVAS
VKLQTVHSIPFTIMKIEAIQRPVAS

SEQ ID NO: 54782 - protein, 25 aa, synthetic construct
  source 1..25: note = Seed: VKLQTVHSIPLTINKEEALQRPVAS
VKLQTVHSIPFTIMKIEAKQRPVAS

SEQ ID NO: 54783 - protein, 25 aa, synthetic construct
  source 1..25: note = Seed: VKLQTVHSIPLTINKEEALQRPVAS
VKLQTVHSIPFTIMKIEALQRPVAS

SEQ ID NO: 54784 - protein, 25 aa, synthetic construct
  source 1..25: note = Seed: VKLQTVHSIPLTINKEEALQRPVAS
VKLQTVHSIPFTIMKIEAMQRPVAS

SEQ ID NO: 54785 - protein, 25 aa, synthetic construct
  source 1..25: note = Seed: VKLQTVHSIPLTINKEEALQRPVAS
VKLQTVHSIPFTIMKIEANQRPVAS

SEQ ID NO: 54786 - protein, 25 aa, synthetic construct
  source 1..25: note = Seed: VKLQTVHSIPLTINKEEALQRPVAS
VKLQTVHSIPFTIMKIEAQQRPVAS

SEQ ID NO: 54787 - protein, 25 aa, synthetic construct
  source 1..25: note = Seed: VKLQTVHSIPLTINKEEALQRPVAS
VKLQTVHSIPFTIMKIEARQRPVAS

SEQ ID NO: 54788 - protein, 25 aa, synthetic construct
  source 1..25: note = Seed: VKLQTVHSIPLTINKEEALQRPVAS
VKLQTVHSIPFTIMKIEASQRPVAS

SEQ ID NO: 54789 - protein, 25 aa, synthetic construct
  source 1..25: note = Seed: VKLQTVHSIPLTINKEEALQRPVAS
VKLQTVHSIPFTIMKIEATQRPVAS

SEQ ID NO: 54790 - protein, 25 aa, synthetic construct
  source 1..25: note = Seed: VKLQTVHSIPLTINKEEALQRPVAS
VKLQTVHSIPFTIMKIEAVQRPVAS

SEQ ID NO: 54791 - protein, 25 aa, synthetic construct
  source 1..25: note = Seed: VKLQTVHSIPLTINKEEALQRPVAS
VKLQTVHSIPFTIMKIEAYQRPVAS

SEQ ID NO: 54792 - protein, 25 aa, synthetic construct
  source 1..25: note = Seed: VKLQTVHSIPLTINKEEALQRPVAS
VKLQTVHSIPFTIMKKEAFQRPVAS

SEQ ID NO: 54793 - protein, 25 aa, synthetic construct
  source 1..25: note = Seed: VKLQTVHSIPLTINKEEALQRPVAS
VKLQTVHSIPFTIMKKEAIQRPVAS

SEQ ID NO: 54794 - protein, 25 aa, synthetic construct
  source 1..25: note = Seed: VKLQTVHSIPLTINKEEALQRPVAS
VKLQTVHSIPFTIMKKEALQRPVAS

SEQ ID NO: 54795 - protein, 25 aa, synthetic construct
  source 1..25: note = Seed: VKLQTVHSIPLTINKEEALQRPVAS
VKLQTVHSIPFTIMKLEAAQRPVAS

SEQ ID NO: 54796 - protein, 25 aa, synthetic construct
  source 1..25: note = Seed: VKLQTVHSIPLTINKEEALQRPVAS
VKLQTVHSIPFTIMKLEACQRPVAS

SEQ ID NO: 54797 - protein, 25 aa, synthetic construct
  source 1..25: note = Seed: VKLQTVHSIPLTINKEEALQRPVAS
VKLQTVHSIPFTIMKLEADQRPVAS

SEQ ID NO: 54798 - protein, 25 aa, synthetic construct
  source 1..25: note = Seed: VKLQTVHSIPLTINKEEALQRPVAS
VKLQTVHSIPFTIMKLEAEQRPVAS

SEQ ID NO: 54799 - protein, 25 aa, synthetic construct
  source 1..25: note = Seed: VKLQTVHSIPLTINKEEALQRPVAS
VKLQTVHSIPFTIMKLEAFQRPVAS

SEQ ID NO: 54800 - protein, 25 aa, synthetic construct
  source 1..25: note = Seed: VKLQTVHSIPLTINKEEALQRPVAS
VKLQTVHSIPFTIMKLEAGQRPVAS

SEQ ID NO: 54801 - protein, 25 aa, synthetic construct
  source 1..25: note = Seed: VKLQTVHSIPLTINKEEALQRPVAS
VKLQTVHSIPFTIMKLEAHQRPVAS

SEQ ID NO: 54802 - protein, 25 aa, synthetic construct
  source 1..25: note = Seed: VKLQTVHSIPLTINKEEALQRPVAS
VKLQTVHSIPFTIMKLEAIQRPVAS

SEQ ID NO: 54803 - protein, 25 aa, synthetic construct
  source 1..25: note = Seed: VKLQTVHSIPLTINKEEALQRPVAS
VKLQTVHSIPFTIMKLEAKQRPVAS

SEQ ID NO: 54804 - protein, 25 aa, synthetic construct
  source 1..25: note = Seed: VKLQTVHSIPLTINKEEALQRPVAS
VKLQTVHSIPFTIMKLEALQRPVAS

SEQ ID NO: 54805 - protein, 25 aa, synthetic construct
  source 1..25: note = Seed: VKLQTVHSIPLTINKEEALQRPVAS
VKLQTVHSIPFTIMKLEAMQRPVAS

SEQ ID NO: 54806 - protein, 25 aa, synthetic construct
  source 1..25: note = Seed: VKLQTVHSIPLTINKEEALQRPVAS
VKLQTVHSIPFTIMKLEANQRPVAS

SEQ ID NO: 54807 - protein, 25 aa, synthetic construct
  source 1..25: note = Seed: VKLQTVHSIPLTINKEEALQRPVAS
VKLQTVHSIPFTIMKLEAQQRPVAS

SEQ ID NO: 54808 - protein, 25 aa, synthetic construct
  source 1..25: note = Seed: VKLQTVHSIPLTINKEEALQRPVAS
VKLQTVHSIPFTIMKLEARQRPVAS

SEQ ID NO: 54809 - protein, 25 aa, synthetic construct
  source 1..25: note = Seed: VKLQTVHSIPLTINKEEALQRPVAS
VKLQTVHSIPFTIMKLEASQRPVAS

SEQ ID NO: 54810 - protein, 25 aa, synthetic construct
  source 1..25: note = Seed: VKLQTVHSIPLTINKEEALQRPVAS
VKLQTVHSIPFTIMKLEATQRPVAS

SEQ ID NO: 54811 - protein, 25 aa, synthetic construct
  source 1..25: note = Seed: VKLQTVHSIPLTINKEEALQRPVAS
VKLQTVHSIPFTIMKLEAVQRPVAS

SEQ ID NO: 54812 - protein, 25 aa, synthetic construct
  source 1..25: note = Seed: VKLQTVHSIPLTINKEEALQRPVAS
VKLQTVHSIPFTIMKLEAYQRPVAS

SEQ ID NO: 54813 - protein, 25 aa, synthetic construct
  source 1..25: note = Seed: VKLQTVHSIPLTINKEEALQRPVAS
VKLQTVHSIPFTIMKMEAAQRPVAS

SEQ ID NO: 54814 - protein, 25 aa, synthetic construct
  source 1..25: note = Seed: VKLQTVHSIPLTINKEEALQRPVAS
VKLQTVHSIPFTIMKMEADQRPVAS

SEQ ID NO: 54815 - protein, 25 aa, synthetic construct
  source 1..25: note = Seed: VKLQTVHSIPLTINKEEALQRPVAS
VKLQTVHSIPFTIMKMEAEQRPVAS

SEQ ID NO: 54816 - protein, 25 aa, synthetic construct
  source 1..25: note = Seed: VKLQTVHSIPLTINKEEALQRPVAS
VKLQTVHSIPFTIMKMEAFQRPVAS

SEQ ID NO: 54817 - protein, 25 aa, synthetic construct
  source 1..25: note = Seed: VKLQTVHSIPLTINKEEALQRPVAS
VKLQTVHSIPFTIMKMEAHQRPVAS

SEQ ID NO: 54818 - protein, 25 aa, synthetic construct
  source 1..25: note = Seed: VKLQTVHSIPLTINKEEALQRPVAS
VKLQTVHSIPFTIMKMEAIQRPVAS

SEQ ID NO: 54819 - protein, 25 aa, synthetic construct
  source 1..25: note = Seed: VKLQTVHSIPLTINKEEALQRPVAS
VKLQTVHSIPFTIMKMEALQRPVAS

SEQ ID NO: 54820 - protein, 25 aa, synthetic construct
  source 1..25: note = Seed: VKLQTVHSIPLTINKEEALQRPVAS
VKLQTVHSIPFTIMKMEAMQRPVAS

SEQ ID NO: 54821 - protein, 25 aa, synthetic construct
  source 1..25: note = Seed: VKLQTVHSIPLTINKEEALQRPVAS
VKLQTVHSIPFTIMKMEANQRPVAS

SEQ ID NO: 54822 - protein, 25 aa, synthetic construct
  source 1..25: note = Seed: VKLQTVHSIPLTINKEEALQRPVAS
VKLQTVHSIPFTIMKMEAQQRPVAS

SEQ ID NO: 54823 - protein, 25 aa, synthetic construct
  source 1..25: note = Seed: VKLQTVHSIPLTINKEEALQRPVAS
VKLQTVHSIPFTIMKMEARQRPVAS

SEQ ID NO: 54824 - protein, 25 aa, synthetic construct
  source 1..25: note = Seed: VKLQTVHSIPLTINKEEALQRPVAS
VKLQTVHSIPFTIMKMEASQRPVAS

SEQ ID NO: 54825 - protein, 25 aa, synthetic construct
  source 1..25: note = Seed: VKLQTVHSIPLTINKEEALQRPVAS
VKLQTVHSIPFTIMKMEATQRPVAS

SEQ ID NO: 54826 - protein, 25 aa, synthetic construct
  source 1..25: note = Seed: VKLQTVHSIPLTINKEEALQRPVAS
VKLQTVHSIPFTIMKMEAVQRPVAS

SEQ ID NO: 54827 - protein, 25 aa, synthetic construct
  source 1..25: note = Seed: VKLQTVHSIPLTINKEEALQRPVAS
VKLQTVHSIPFTIMKMEAYQRPVAS

SEQ ID NO: 54828 - protein, 25 aa, synthetic construct
  source 1..25: note = Seed: VKLQTVHSIPLTINKEEALQRPVAS
VKLQTVHSIPFTIMKNEAAQRPVAS

SEQ ID NO: 54829 - protein, 25 aa, synthetic construct
  source 1..25: note = Seed: VKLQTVHSIPLTINKEEALQRPVAS
VKLQTVHSIPFTIMKNEADQRPVAS

SEQ ID NO: 54830 - protein, 25 aa, synthetic construct
  source 1..25: note = Seed: VKLQTVHSIPLTINKEEALQRPVAS
VKLQTVHSIPFTIMKNEAEQRPVAS

SEQ ID NO: 54831 - protein, 25 aa, synthetic construct
  source 1..25: note = Seed: VKLQTVHSIPLTINKEEALQRPVAS
VKLQTVHSIPFTIMKNEAGQRPVAS

SEQ ID NO: 54832 - protein, 25 aa, synthetic construct
  source 1..25: note = Seed: VKLQTVHSIPLTINKEEALQRPVAS
VKLQTVHSIPFTIMKNEAHQRPVAS

SEQ ID NO: 54833 - protein, 25 aa, synthetic construct
  source 1..25: note = Seed: VKLQTVHSIPLTINKEEALQRPVAS
VKLQTVHSIPFTIMKNEAIQRPVAS

SEQ ID NO: 54834 - protein, 25 aa, synthetic construct
  source 1..25: note = Seed: VKLQTVHSIPLTINKEEALQRPVAS
VKLQTVHSIPFTIMKNEALQRPVAS

SEQ ID NO: 54835 - protein, 25 aa, synthetic construct
  source 1..25: note = Seed: VKLQTVHSIPLTINKEEALQRPVAS
VKLQTVHSIPFTIMKNEAMQRPVAS

SEQ ID NO: 54836 - protein, 25 aa, synthetic construct
  source 1..25: note = Seed: VKLQTVHSIPLTINKEEALQRPVAS
VKLQTVHSIPFTIMKNEANQRPVAS

SEQ ID NO: 54837 - protein, 25 aa, synthetic construct
  source 1..25: note = Seed: VKLQTVHSIPLTINKEEALQRPVAS
VKLQTVHSIPFTIMKNEAQQRPVAS

SEQ ID NO: 54838 - protein, 25 aa, synthetic construct
  source 1..25: note = Seed: VKLQTVHSIPLTINKEEALQRPVAS
VKLQTVHSIPFTIMKNEASQRPVAS

SEQ ID NO: 54839 - protein, 25 aa, synthetic construct
  source 1..25: note = Seed: VKLQTVHSIPLTINKEEALQRPVAS
VKLQTVHSIPFTIMKNEATQRPVAS

SEQ ID NO: 54840 - protein, 25 aa, synthetic construct
  source 1..25: note = Seed: VKLQTVHSIPLTINKEEALQRPVAS
VKLQTVHSIPFTIMKNEAVQRPVAS

SEQ ID NO: 54841 - protein, 25 aa, synthetic construct
  source 1..25: note = Seed: VKLQTVHSIPLTINKEEALQRPVAS
VKLQTVHSIPFTIMKPEAVQRPVAS

SEQ ID NO: 54842 - protein, 25 aa, synthetic construct
  source 1..25: note = Seed: VKLQTVHSIPLTINKEEALQRPVAS
VKLQTVHSIPFTIMKQEALQRPVAS

SEQ ID NO: 54843 - protein, 25 aa, synthetic construct
  source 1..25: note = Seed: VKLQTVHSIPLTINKEEALQRPVAS
VKLQTVHSIPFTIMKREAFQRPVAS

SEQ ID NO: 54844 - protein, 25 aa, synthetic construct
  source 1..25: note = Seed: VKLQTVHSIPLTINKEEALQRPVAS
VKLQTVHSIPFTIMKREAIQRPVAS

SEQ ID NO: 54845 - protein, 25 aa, synthetic construct
  source 1..25: note = Seed: VKLQTVHSIPLTINKEEALQRPVAS
VKLQTVHSIPFTIMKREALQRPVAS

SEQ ID NO: 54846 - protein, 25 aa, synthetic construct
  source 1..25: note = Seed: VKLQTVHSIPLTINKEEALQRPVAS
VKLQTVHSIPFTIMKREAMQRPVAS

SEQ ID NO: 54847 - protein, 25 aa, synthetic construct
  source 1..25: note = Seed: VKLQTVHSIPLTINKEEALQRPVAS
VKLQTVHSIPFTIMKREARQRPVAS

SEQ ID NO: 54848 - protein, 25 aa, synthetic construct
  source 1..25: note = Seed: VKLQTVHSIPLTINKEEALQRPVAS
VKLQTVHSIPFTIMKREAVQRPVAS

SEQ ID NO: 54849 - protein, 25 aa, synthetic construct
  source 1..25: note = Seed: VKLQTVHSIPLTINKEEALQRPVAS
VKLQTVHSIPFTIMKREAYQRPVAS

SEQ ID NO: 54850 - protein, 25 aa, synthetic construct
  source 1..25: note = Seed: VKLQTVHSIPLTINKEEALQRPVAS
VKLQTVHSIPFTIMKSEAAQRPVAS

SEQ ID NO: 54851 - protein, 25 aa, synthetic construct
  source 1..25: note = Seed: VKLQTVHSIPLTINKEEALQRPVAS
VKLQTVHSIPFTIMKSEADQRPVAS

SEQ ID NO: 54852 - protein, 25 aa, synthetic construct
  source 1..25: note = Seed: VKLQTVHSIPLTINKEEALQRPVAS
VKLQTVHSIPFTIMKSEAEQRPVAS

SEQ ID NO: 54853 - protein, 25 aa, synthetic construct
  source 1..25: note = Seed: VKLQTVHSIPLTINKEEALQRPVAS
VKLQTVHSIPFTIMKSEAHQRPVAS

SEQ ID NO: 54854 - protein, 25 aa, synthetic construct
  source 1..25: note = Seed: VKLQTVHSIPLTINKEEALQRPVAS
VKLQTVHSIPFTIMKSEAIQRPVAS

SEQ ID NO: 54855 - protein, 25 aa, synthetic construct
  source 1..25: note = Seed: VKLQTVHSIPLTINKEEALQRPVAS
VKLQTVHSIPFTIMKSEALQRPVAS

SEQ ID NO: 54856 - protein, 25 aa, synthetic construct
  source 1..25: note = Seed: VKLQTVHSIPLTINKEEALQRPVAS
VKLQTVHSIPFTIMKSEAMQRPVAS

SEQ ID NO: 54857 - protein, 25 aa, synthetic construct
  source 1..25: note = Seed: VKLQTVHSIPLTINKEEALQRPVAS
VKLQTVHSIPFTIMKSEANQRPVAS

SEQ ID NO: 54858 - protein, 25 aa, synthetic construct
  source 1..25: note = Seed: VKLQTVHSIPLTINKEEALQRPVAS
VKLQTVHSIPFTIMKSEAQQRPVAS

SEQ ID NO: 54859 - protein, 25 aa, synthetic construct
  source 1..25: note = Seed: VKLQTVHSIPLTINKEEALQRPVAS
VKLQTVHSIPFTIMKSEASQRPVAS

SEQ ID NO: 54860 - protein, 25 aa, synthetic construct
  source 1..25: note = Seed: VKLQTVHSIPLTINKEEALQRPVAS
VKLQTVHSIPFTIMKSEATQRPVAS

SEQ ID NO: 54861 - protein, 25 aa, synthetic construct
  source 1..25: note = Seed: VKLQTVHSIPLTINKEEALQRPVAS
VKLQTVHSIPFTIMKSEAVQRPVAS

SEQ ID NO: 54862 - protein, 25 aa, synthetic construct
  source 1..25: note = Seed: VKLQTVHSIPLTINKEEALQRPVAS
VKLQTVHSIPFTIMKSEAYQRPVAS

SEQ ID NO: 54863 - protein, 25 aa, synthetic construct
  source 1..25: note = Seed: VKLQTVHSIPLTINKEEALQRPVAS
VKLQTVHSIPFTIMKTEAAQRPVAS

SEQ ID NO: 54864 - protein, 25 aa, synthetic construct
  source 1..25: note = Seed: VKLQTVHSIPLTINKEEALQRPVAS
VKLQTVHSIPFTIMKTEADQRPVAS

SEQ ID NO: 54865 - protein, 25 aa, synthetic construct
  source 1..25: note = Seed: VKLQTVHSIPLTINKEEALQRPVAS
VKLQTVHSIPFTIMKTEAEQRPVAS

SEQ ID NO: 54866 - protein, 25 aa, synthetic construct
  source 1..25: note = Seed: VKLQTVHSIPLTINKEEALQRPVAS
VKLQTVHSIPFTIMKTEAFQRPVAS

SEQ ID NO: 54867 - protein, 25 aa, synthetic construct
  source 1..25: note = Seed: VKLQTVHSIPLTINKEEALQRPVAS
VKLQTVHSIPFTIMKTEAHQRPVAS

SEQ ID NO: 54868 - protein, 25 aa, synthetic construct
  source 1..25: note = Seed: VKLQTVHSIPLTINKEEALQRPVAS
VKLQTVHSIPFTIMKTEAIQRPVAS

SEQ ID NO: 54869 - protein, 25 aa, synthetic construct
  source 1..25: note = Seed: VKLQTVHSIPLTINKEEALQRPVAS
VKLQTVHSIPFTIMKTEALQRPVAS

SEQ ID NO: 54870 - protein, 25 aa, synthetic construct
  source 1..25: note = Seed: VKLQTVHSIPLTINKEEALQRPVAS
VKLQTVHSIPFTIMKTEAMQRPVAS

SEQ ID NO: 54871 - protein, 25 aa, synthetic construct
  source 1..25: note = Seed: VKLQTVHSIPLTINKEEALQRPVAS
VKLQTVHSIPFTIMKTEANQRPVAS

SEQ ID NO: 54872 - protein, 25 aa, synthetic construct
  source 1..25: note = Seed: VKLQTVHSIPLTINKEEALQRPVAS
VKLQTVHSIPFTIMKTEAQQRPVAS

SEQ ID NO: 54873 - protein, 25 aa, synthetic construct
  source 1..25: note = Seed: VKLQTVHSIPLTINKEEALQRPVAS
VKLQTVHSIPFTIMKTEASQRPVAS

SEQ ID NO: 54874 - protein, 25 aa, synthetic construct
  source 1..25: note = Seed: VKLQTVHSIPLTINKEEALQRPVAS
VKLQTVHSIPFTIMKTEATQRPVAS

SEQ ID NO: 54875 - protein, 25 aa, synthetic construct
  source 1..25: note = Seed: VKLQTVHSIPLTINKEEALQRPVAS
VKLQTVHSIPFTIMKTEAVQRPVAS

SEQ ID NO: 54876 - protein, 25 aa, synthetic construct
  source 1..25: note = Seed: VKLQTVHSIPLTINKEEALQRPVAS
VKLQTVHSIPFTIMKVEAAQRPVAS

SEQ ID NO: 54877 - protein, 25 aa, synthetic construct
  source 1..25: note = Seed: VKLQTVHSIPLTINKEEALQRPVAS
VKLQTVHSIPFTIMKVEADQRPVAS

SEQ ID NO: 54878 - protein, 25 aa, synthetic construct
  source 1..25: note = Seed: VKLQTVHSIPLTINKEEALQRPVAS
VKLQTVHSIPFTIMKVEAEQRPVAS

SEQ ID NO: 54879 - protein, 25 aa, synthetic construct
  source 1..25: note = Seed: VKLQTVHSIPLTINKEEALQRPVAS
VKLQTVHSIPFTIMKVEAFQRPVAS

SEQ ID NO: 54880 - protein, 25 aa, synthetic construct
  source 1..25: note = Seed: VKLQTVHSIPLTINKEEALQRPVAS
VKLQTVHSIPFTIMKVEAHQRPVAS

SEQ ID NO: 54881 - protein, 25 aa, synthetic construct
  source 1..25: note = Seed: VKLQTVHSIPLTINKEEALQRPVAS
VKLQTVHSIPFTIMKVEAIQRPVAS

SEQ ID NO: 54882 - protein, 25 aa, synthetic construct
  source 1..25: note = Seed: VKLQTVHSIPLTINKEEALQRPVAS
VKLQTVHSIPFTIMKVEALQRPVAS

SEQ ID NO: 54883 - protein, 25 aa, synthetic construct
  source 1..25: note = Seed: VKLQTVHSIPLTINKEEALQRPVAS
VKLQTVHSIPFTIMKVEAMQRPVAS

SEQ ID NO: 54884 - protein, 25 aa, synthetic construct
  source 1..25: note = Seed: VKLQTVHSIPLTINKEEALQRPVAS
VKLQTVHSIPFTIMKVEANQRPVAS

SEQ ID NO: 54885 - protein, 25 aa, synthetic construct
  source 1..25: note = Seed: VKLQTVHSIPLTINKEEALQRPVAS
VKLQTVHSIPFTIMKVEAQQRPVAS

SEQ ID NO: 54886 - protein, 25 aa, synthetic construct
  source 1..25: note = Seed: VKLQTVHSIPLTINKEEALQRPVAS
VKLQTVHSIPFTIMKVEARQRPVAS

SEQ ID NO: 54887 - protein, 25 aa, synthetic construct
  source 1..25: note = Seed: VKLQTVHSIPLTINKEEALQRPVAS
VKLQTVHSIPFTIMKVEASQRPVAS

SEQ ID NO: 54888 - protein, 25 aa, synthetic construct
  source 1..25: note = Seed: VKLQTVHSIPLTINKEEALQRPVAS
VKLQTVHSIPFTIMKVEATQRPVAS

SEQ ID NO: 54889 - protein, 25 aa, synthetic construct
  source 1..25: note = Seed: VKLQTVHSIPLTINKEEALQRPVAS
VKLQTVHSIPFTIMKVEAVQRPVAS

SEQ ID NO: 54890 - protein, 25 aa, synthetic construct
  source 1..25: note = Seed: VKLQTVHSIPLTINKEEALQRPVAS
VKLQTVHSIPFTIMKVEAYQRPVAS

SEQ ID NO: 54891 - protein, 25 aa, synthetic construct
  source 1..25: note = Seed: VKLQTVHSIPLTINKEEALQRPVAS
VKLQTVHSIPFTIMKWEAAQRPVAS

SEQ ID NO: 54892 - protein, 25 aa, synthetic construct
  source 1..25: note = Seed: VKLQTVHSIPLTINKEEALQRPVAS
VKLQTVHSIPFTIMKWEADQRPVAS

SEQ ID NO: 54893 - protein, 25 aa, synthetic construct
  source 1..25: note = Seed: VKLQTVHSIPLTINKEEALQRPVAS
VKLQTVHSIPFTIMKWEAEQRPVAS

SEQ ID NO: 54894 - protein, 25 aa, synthetic construct
  source 1..25: note = Seed: VKLQTVHSIPLTINKEEALQRPVAS
VKLQTVHSIPFTIMKWEAFQRPVAS

SEQ ID NO: 54895 - protein, 25 aa, synthetic construct
  source 1..25: note = Seed: VKLQTVHSIPLTINKEEALQRPVAS
VKLQTVHSIPFTIMKWEAGQRPVAS

SEQ ID NO: 54896 - protein, 25 aa, synthetic construct
  source 1..25: note = Seed: VKLQTVHSIPLTINKEEALQRPVAS
VKLQTVHSIPFTIMKWEAIQRPVAS

SEQ ID NO: 54897 - protein, 25 aa, synthetic construct
  source 1..25: note = Seed: VKLQTVHSIPLTINKEEALQRPVAS
VKLQTVHSIPFTIMKWEALQRPVAS

SEQ ID NO: 54898 - protein, 25 aa, synthetic construct
  source 1..25: note = Seed: VKLQTVHSIPLTINKEEALQRPVAS
VKLQTVHSIPFTIMKWEAMQRPVAS

SEQ ID NO: 54899 - protein, 25 aa, synthetic construct
  source 1..25: note = Seed: VKLQTVHSIPLTINKEEALQRPVAS
VKLQTVHSIPFTIMKWEANQRPVAS

SEQ ID NO: 54900 - protein, 25 aa, synthetic construct
  source 1..25: note = Seed: VKLQTVHSIPLTINKEEALQRPVAS
VKLQTVHSIPFTIMKWEASQRPVAS

SEQ ID NO: 54901 - protein, 25 aa, synthetic construct
  source 1..25: note = Seed: VKLQTVHSIPLTINKEEALQRPVAS
VKLQTVHSIPFTIMKWEATQRPVAS

SEQ ID NO: 54902 - protein, 25 aa, synthetic construct
  source 1..25: note = Seed: VKLQTVHSIPLTINKEEALQRPVAS
VKLQTVHSIPFTIMKWEAVQRPVAS

SEQ ID NO: 54903 - protein, 25 aa, synthetic construct
  source 1..25: note = Seed: VKLQTVHSIPLTINKEEALQRPVAS
VKLQTVHSIPFTIMKWEAYQRPVAS

SEQ ID NO: 54904 - protein, 25 aa, synthetic construct
  source 1..25: note = Seed: VKLQTVHSIPLTINKEEALQRPVAS
VKLQTVHSIPFTIMKYEAAQRPVAS

SEQ ID NO: 54905 - protein, 25 aa, synthetic construct
  source 1..25: note = Seed: VKLQTVHSIPLTINKEEALQRPVAS
VKLQTVHSIPFTIMKYEACQRPVAS

SEQ ID NO: 54906 - protein, 25 aa, synthetic construct
  source 1..25: note = Seed: VKLQTVHSIPLTINKEEALQRPVAS
VKLQTVHSIPFTIMKYEADQRPVAS

SEQ ID NO: 54907 - protein, 25 aa, synthetic construct
  source 1..25: note = Seed: VKLQTVHSIPLTINKEEALQRPVAS
VKLQTVHSIPFTIMKYEAEQRPVAS

SEQ ID NO: 54908 - protein, 25 aa, synthetic construct
  source 1..25: note = Seed: VKLQTVHSIPLTINKEEALQRPVAS
VKLQTVHSIPFTIMKYEAFQRPVAS

SEQ ID NO: 54909 - protein, 25 aa, synthetic construct
  source 1..25: note = Seed: VKLQTVHSIPLTINKEEALQRPVAS
VKLQTVHSIPFTIMKYEAGQRPVAS

SEQ ID NO: 54910 - protein, 25 aa, synthetic construct
  source 1..25: note = Seed: VKLQTVHSIPLTINKEEALQRPVAS
VKLQTVHSIPFTIMKYEAIQRPVAS

SEQ ID NO: 54911 - protein, 25 aa, synthetic construct
  source 1..25: note = Seed: VKLQTVHSIPLTINKEEALQRPVAS
VKLQTVHSIPFTIMKYEALQRPVAS

SEQ ID NO: 54912 - protein, 25 aa, synthetic construct
  source 1..25: note = Seed: VKLQTVHSIPLTINKEEALQRPVAS
VKLQTVHSIPFTIMKYEAMQRPVAS

SEQ ID NO: 54913 - protein, 25 aa, synthetic construct
  source 1..25: note = Seed: VKLQTVHSIPLTINKEEALQRPVAS
VKLQTVHSIPFTIMKYEANQRPVAS

SEQ ID NO: 54914 - protein, 25 aa, synthetic construct
  source 1..25: note = Seed: VKLQTVHSIPLTINKEEALQRPVAS
VKLQTVHSIPFTIMKYEAQQRPVAS

SEQ ID NO: 54915 - protein, 25 aa, synthetic construct
  source 1..25: note = Seed: VKLQTVHSIPLTINKEEALQRPVAS
VKLQTVHSIPFTIMKYEARQRPVAS

SEQ ID NO: 54916 - protein, 25 aa, synthetic construct
  source 1..25: note = Seed: VKLQTVHSIPLTINKEEALQRPVAS
VKLQTVHSIPFTIMKYEASQRPVAS

SEQ ID NO: 54917 - protein, 25 aa, synthetic construct
  source 1..25: note = Seed: VKLQTVHSIPLTINKEEALQRPVAS
VKLQTVHSIPFTIMKYEATQRPVAS

SEQ ID NO: 54918 - protein, 25 aa, synthetic construct
  source 1..25: note = Seed: VKLQTVHSIPLTINKEEALQRPVAS
VKLQTVHSIPFTIMKYEAVQRPVAS

SEQ ID NO: 54919 - protein, 25 aa, synthetic construct
  source 1..25: note = Seed: VKLQTVHSIPLTINKEEALQRPVAS
VKLQTVHSIPFTIMKYEAYQRPVAS

SEQ ID NO: 54920 - protein, 25 aa, synthetic construct
  source 1..25: note = Seed: VKLQTVHSIPLTINKEEALQRPVAS
VKLQTVHSIPFTINKAEAAQRPVAS

SEQ ID NO: 54921 - protein, 25 aa, synthetic construct
  source 1..25: note = Seed: VKLQTVHSIPLTINKEEALQRPVAS
VKLQTVHSIPFTINKAEAFQRPVAS

SEQ ID NO: 54922 - protein, 25 aa, synthetic construct
  source 1..25: note = Seed: VKLQTVHSIPLTINKEEALQRPVAS
VKLQTVHSIPFTINKAEAIQRPVAS

SEQ ID NO: 54923 - protein, 25 aa, synthetic construct
  source 1..25: note = Seed: VKLQTVHSIPLTINKEEALQRPVAS
VKLQTVHSIPFTINKAEALQRPVAS

SEQ ID NO: 54924 - protein, 25 aa, synthetic construct
  source 1..25: note = Seed: VKLQTVHSIPLTINKEEALQRPVAS
VKLQTVHSIPFTINKAEAMQRPVAS

SEQ ID NO: 54925 - protein, 25 aa, synthetic construct
  source 1..25: note = Seed: VKLQTVHSIPLTINKEEALQRPVAS
VKLQTVHSIPFTINKAEASQRPVAS

SEQ ID NO: 54926 - protein, 25 aa, synthetic construct
  source 1..25: note = Seed: VKLQTVHSIPLTINKEEALQRPVAS
VKLQTVHSIPFTINKAEATQRPVAS

SEQ ID NO: 54927 - protein, 25 aa, synthetic construct
  source 1..25: note = Seed: VKLQTVHSIPLTINKEEALQRPVAS
VKLQTVHSIPFTINKAEAVQRPVAS

SEQ ID NO: 54928 - protein, 25 aa, synthetic construct
  source 1..25: note = Seed: VKLQTVHSIPLTINKEEALQRPVAS
VKLQTVHSIPFTINKAEAWQRPVAS

SEQ ID NO: 54929 - protein, 25 aa, synthetic construct
  source 1..25: note = Seed: VKLQTVHSIPLTINKEEALQRPVAS
VKLQTVHSIPFTINKAEAYQRPVAS

SEQ ID NO: 54930 - protein, 25 aa, synthetic construct
  source 1..25: note = Seed: VKLQTVHSIPLTINKEEALQRPVAS
VKLQTVHSIPFTINKFEAAQRPVAS

SEQ ID NO: 54931 - protein, 25 aa, synthetic construct
  source 1..25: note = Seed: VKLQTVHSIPLTINKEEALQRPVAS
VKLQTVHSIPFTINKFEACQRPVAS

SEQ ID NO: 54932 - protein, 25 aa, synthetic construct
  source 1..25: note = Seed: VKLQTVHSIPLTINKEEALQRPVAS
VKLQTVHSIPFTINKFEADQRPVAS

SEQ ID NO: 54933 - protein, 25 aa, synthetic construct
  source 1..25: note = Seed: VKLQTVHSIPLTINKEEALQRPVAS
VKLQTVHSIPFTINKFEAEQRPVAS

SEQ ID NO: 54934 - protein, 25 aa, synthetic construct
  source 1..25: note = Seed: VKLQTVHSIPLTINKEEALQRPVAS
VKLQTVHSIPFTINKFEAFQRPVAS

SEQ ID NO: 54935 - protein, 25 aa, synthetic construct
  source 1..25: note = Seed: VKLQTVHSIPLTINKEEALQRPVAS
VKLQTVHSIPFTINKFEAGQRPVAS

SEQ ID NO: 54936 - protein, 25 aa, synthetic construct
  source 1..25: note = Seed: VKLQTVHSIPLTINKEEALQRPVAS
VKLQTVHSIPFTINKFEAHQRPVAS

SEQ ID NO: 54937 - protein, 25 aa, synthetic construct
  source 1..25: note = Seed: VKLQTVHSIPLTINKEEALQRPVAS
VKLQTVHSIPFTINKFEAIQRPVAS

SEQ ID NO: 54938 - protein, 25 aa, synthetic construct
  source 1..25: note = Seed: VKLQTVHSIPLTINKEEALQRPVAS
VKLQTVHSIPFTINKFEAKQRPVAS

SEQ ID NO: 54939 - protein, 25 aa, synthetic construct
  source 1..25: note = Seed: VKLQTVHSIPLTINKEEALQRPVAS
VKLQTVHSIPFTINKFEALQRPVAS

SEQ ID NO: 54940 - protein, 25 aa, synthetic construct
  source 1..25: note = Seed: VKLQTVHSIPLTINKEEALQRPVAS
VKLQTVHSIPFTINKFEAMQRPVAS

SEQ ID NO: 54941 - protein, 25 aa, synthetic construct
  source 1..25: note = Seed: VKLQTVHSIPLTINKEEALQRPVAS
VKLQTVHSIPFTINKFEANQRPVAS

SEQ ID NO: 54942 - protein, 25 aa, synthetic construct
  source 1..25: note = Seed: VKLQTVHSIPLTINKEEALQRPVAS
VKLQTVHSIPFTINKFEAPQRPVAS

SEQ ID NO: 54943 - protein, 25 aa, synthetic construct
  source 1..25: note = Seed: VKLQTVHSIPLTINKEEALQRPVAS
VKLQTVHSIPFTINKFEAQQRPVAS

SEQ ID NO: 54944 - protein, 25 aa, synthetic construct
  source 1..25: note = Seed: VKLQTVHSIPLTINKEEALQRPVAS
VKLQTVHSIPFTINKFEARQRPVAS

SEQ ID NO: 54945 - protein, 25 aa, synthetic construct
  source 1..25: note = Seed: VKLQTVHSIPLTINKEEALQRPVAS
VKLQTVHSIPFTINKFEASQRPVAS

SEQ ID NO: 54946 - protein, 25 aa, synthetic construct
  source 1..25: note = Seed: VKLQTVHSIPLTINKEEALQRPVAS
VKLQTVHSIPFTINKFEATQRPVAS

SEQ ID NO: 54947 - protein, 25 aa, synthetic construct
  source 1..25: note = Seed: VKLQTVHSIPLTINKEEALQRPVAS
VKLQTVHSIPFTINKFEAVQRPVAS

SEQ ID NO: 54948 - protein, 25 aa, synthetic construct
  source 1..25: note = Seed: VKLQTVHSIPLTINKEEALQRPVAS
VKLQTVHSIPFTINKFEAWQRPVAS

SEQ ID NO: 54949 - protein, 25 aa, synthetic construct
  source 1..25: note = Seed: VKLQTVHSIPLTINKEEALQRPVAS
VKLQTVHSIPFTINKFEAYQRPVAS

SEQ ID NO: 54950 - protein, 25 aa, synthetic construct
  source 1..25: note = Seed: VKLQTVHSIPLTINKEEALQRPVAS
VKLQTVHSIPFTINKGEAAQRPVAS

SEQ ID NO: 54951 - protein, 25 aa, synthetic construct
  source 1..25: note = Seed: VKLQTVHSIPLTINKEEALQRPVAS
VKLQTVHSIPFTINKGEAFQRPVAS

SEQ ID NO: 54952 - protein, 25 aa, synthetic construct
  source 1..25: note = Seed: VKLQTVHSIPLTINKEEALQRPVAS
VKLQTVHSIPFTINKGEAIQRPVAS

SEQ ID NO: 54953 - protein, 25 aa, synthetic construct
  source 1..25: note = Seed: VKLQTVHSIPLTINKEEALQRPVAS
VKLQTVHSIPFTINKGEALQRPVAS

SEQ ID NO: 54954 - protein, 25 aa, synthetic construct
  source 1..25: note = Seed: VKLQTVHSIPLTINKEEALQRPVAS
VKLQTVHSIPFTINKGEAMQRPVAS

SEQ ID NO: 54955 - protein, 25 aa, synthetic construct
  source 1..25: note = Seed: VKLQTVHSIPLTINKEEALQRPVAS
VKLQTVHSIPFTINKGEAVQRPVAS

SEQ ID NO: 54956 - protein, 25 aa, synthetic construct
  source 1..25: note = Seed: VKLQTVHSIPLTINKEEALQRPVAS
VKLQTVHSIPFTINKGEAYQRPVAS

SEQ ID NO: 54957 - protein, 25 aa, synthetic construct
  source 1..25: note = Seed: VKLQTVHSIPLTINKEEALQRPVAS
VKLQTVHSIPFTINKHEAIQRPVAS

SEQ ID NO: 54958 - protein, 25 aa, synthetic construct
  source 1..25: note = Seed: VKLQTVHSIPLTINKEEALQRPVAS
VKLQTVHSIPFTINKHEALQRPVAS

SEQ ID NO: 54959 - protein, 25 aa, synthetic construct
  source 1..25: note = Seed: VKLQTVHSIPLTINKEEALQRPVAS
VKLQTVHSIPFTINKHEAVQRPVAS

SEQ ID NO: 54960 - protein, 25 aa, synthetic construct
  source 1..25: note = Seed: VKLQTVHSIPLTINKEEALQRPVAS
VKLQTVHSIPFTINKIEAAQRPVAS

SEQ ID NO: 54961 - protein, 25 aa, synthetic construct
  source 1..25: note = Seed: VKLQTVHSIPLTINKEEALQRPVAS
VKLQTVHSIPFTINKIEAFQRPVAS

SEQ ID NO: 54962 - protein, 25 aa, synthetic construct
  source 1..25: note = Seed: VKLQTVHSIPLTINKEEALQRPVAS
VKLQTVHSIPFTINKIEAIQRPVAS

SEQ ID NO: 54963 - protein, 25 aa, synthetic construct
  source 1..25: note = Seed: VKLQTVHSIPLTINKEEALQRPVAS
VKLQTVHSIPFTINKIEALQRPVAS

SEQ ID NO: 54964 - protein, 25 aa, synthetic construct
  source 1..25: note = Seed: VKLQTVHSIPLTINKEEALQRPVAS
VKLQTVHSIPFTINKIEAMQRPVAS

SEQ ID NO: 54965 - protein, 25 aa, synthetic construct
  source 1..25: note = Seed: VKLQTVHSIPLTINKEEALQRPVAS
VKLQTVHSIPFTINKIEANQRPVAS

SEQ ID NO: 54966 - protein, 25 aa, synthetic construct
  source 1..25: note = Seed: VKLQTVHSIPLTINKEEALQRPVAS
VKLQTVHSIPFTINKIEASQRPVAS

SEQ ID NO: 54967 - protein, 25 aa, synthetic construct
  source 1..25: note = Seed: VKLQTVHSIPLTINKEEALQRPVAS
VKLQTVHSIPFTINKIEATQRPVAS

SEQ ID NO: 54968 - protein, 25 aa, synthetic construct
  source 1..25: note = Seed: VKLQTVHSIPLTINKEEALQRPVAS
VKLQTVHSIPFTINKIEAVQRPVAS

SEQ ID NO: 54969 - protein, 25 aa, synthetic construct
  source 1..25: note = Seed: VKLQTVHSIPLTINKEEALQRPVAS
VKLQTVHSIPFTINKIEAYQRPVAS

SEQ ID NO: 54970 - protein, 25 aa, synthetic construct
  source 1..25: note = Seed: VKLQTVHSIPLTINKEEALQRPVAS
VKLQTVHSIPFTINKLEAAQRPVAS

SEQ ID NO: 54971 - protein, 25 aa, synthetic construct
  source 1..25: note = Seed: VKLQTVHSIPLTINKEEALQRPVAS
VKLQTVHSIPFTINKLEACQRPVAS

SEQ ID NO: 54972 - protein, 25 aa, synthetic construct
  source 1..25: note = Seed: VKLQTVHSIPLTINKEEALQRPVAS
VKLQTVHSIPFTINKLEADQRPVAS

SEQ ID NO: 54973 - protein, 25 aa, synthetic construct
  source 1..25: note = Seed: VKLQTVHSIPLTINKEEALQRPVAS
VKLQTVHSIPFTINKLEAEQRPVAS

SEQ ID NO: 54974 - protein, 25 aa, synthetic construct
  source 1..25: note = Seed: VKLQTVHSIPLTINKEEALQRPVAS
VKLQTVHSIPFTINKLEAFQRPVAS

SEQ ID NO: 54975 - protein, 25 aa, synthetic construct
  source 1..25: note = Seed: VKLQTVHSIPLTINKEEALQRPVAS
VKLQTVHSIPFTINKLEAIQRPVAS

SEQ ID NO: 54976 - protein, 25 aa, synthetic construct
  source 1..25: note = Seed: VKLQTVHSIPLTINKEEALQRPVAS
VKLQTVHSIPFTINKLEALQRPVAS

SEQ ID NO: 54977 - protein, 25 aa, synthetic construct
  source 1..25: note = Seed: VKLQTVHSIPLTINKEEALQRPVAS
VKLQTVHSIPFTINKLEAMQRPVAS

SEQ ID NO: 54978 - protein, 25 aa, synthetic construct
  source 1..25: note = Seed: VKLQTVHSIPLTINKEEALQRPVAS
VKLQTVHSIPFTINKLEANQRPVAS

SEQ ID NO: 54979 - protein, 25 aa, synthetic construct
  source 1..25: note = Seed: VKLQTVHSIPLTINKEEALQRPVAS
VKLQTVHSIPFTINKLEAQQRPVAS

SEQ ID NO: 54980 - protein, 25 aa, synthetic construct
  source 1..25: note = Seed: VKLQTVHSIPLTINKEEALQRPVAS
VKLQTVHSIPFTINKLEASQRPVAS

SEQ ID NO: 54981 - protein, 25 aa, synthetic construct
  source 1..25: note = Seed: VKLQTVHSIPLTINKEEALQRPVAS
VKLQTVHSIPFTINKLEATQRPVAS

SEQ ID NO: 54982 - protein, 25 aa, synthetic construct
  source 1..25: note = Seed: VKLQTVHSIPLTINKEEALQRPVAS
VKLQTVHSIPFTINKLEAVQRPVAS

SEQ ID NO: 54983 - protein, 25 aa, synthetic construct
  source 1..25: note = Seed: VKLQTVHSIPLTINKEEALQRPVAS
VKLQTVHSIPFTINKLEAYQRPVAS

SEQ ID NO: 54984 - protein, 25 aa, synthetic construct
  source 1..25: note = Seed: VKLQTVHSIPLTINKEEALQRPVAS
VKLQTVHSIPFTINKMEAFQRPVAS

SEQ ID NO: 54985 - protein, 25 aa, synthetic construct
  source 1..25: note = Seed: VKLQTVHSIPLTINKEEALQRPVAS
VKLQTVHSIPFTINKMEAIQRPVAS

SEQ ID NO: 54986 - protein, 25 aa, synthetic construct
  source 1..25: note = Seed: VKLQTVHSIPLTINKEEALQRPVAS
VKLQTVHSIPFTINKMEALQRPVAS

SEQ ID NO: 54987 - protein, 25 aa, synthetic construct
  source 1..25: note = Seed: VKLQTVHSIPLTINKEEALQRPVAS
VKLQTVHSIPFTINKMEAMQRPVAS

SEQ ID NO: 54988 - protein, 25 aa, synthetic construct
  source 1..25: note = Seed: VKLQTVHSIPLTINKEEALQRPVAS
VKLQTVHSIPFTINKMEAVQRPVAS

SEQ ID NO: 54989 - protein, 25 aa, synthetic construct
  source 1..25: note = Seed: VKLQTVHSIPLTINKEEALQRPVAS
VKLQTVHSIPFTINKMEAYQRPVAS

SEQ ID NO: 54990 - protein, 25 aa, synthetic construct
  source 1..25: note = Seed: VKLQTVHSIPLTINKEEALQRPVAS
VKLQTVHSIPFTINKNEAAQRPVAS

SEQ ID NO: 54991 - protein, 25 aa, synthetic construct
  source 1..25: note = Seed: VKLQTVHSIPLTINKEEALQRPVAS
VKLQTVHSIPFTINKNEAFQRPVAS

SEQ ID NO: 54992 - protein, 25 aa, synthetic construct
  source 1..25: note = Seed: VKLQTVHSIPLTINKEEALQRPVAS
VKLQTVHSIPFTINKNEAIQRPVAS

SEQ ID NO: 54993 - protein, 25 aa, synthetic construct
  source 1..25: note = Seed: VKLQTVHSIPLTINKEEALQRPVAS
VKLQTVHSIPFTINKNEALQRPVAS

SEQ ID NO: 54994 - protein, 25 aa, synthetic construct
  source 1..25: note = Seed: VKLQTVHSIPLTINKEEALQRPVAS
VKLQTVHSIPFTINKNEAMQRPVAS

SEQ ID NO: 54995 - protein, 25 aa, synthetic construct
  source 1..25: note = Seed: VKLQTVHSIPLTINKEEALQRPVAS
VKLQTVHSIPFTINKNEANQRPVAS

SEQ ID NO: 54996 - protein, 25 aa, synthetic construct
  source 1..25: note = Seed: VKLQTVHSIPLTINKEEALQRPVAS
VKLQTVHSIPFTINKNEASQRPVAS

SEQ ID NO: 54997 - protein, 25 aa, synthetic construct
  source 1..25: note = Seed: VKLQTVHSIPLTINKEEALQRPVAS
VKLQTVHSIPFTINKNEATQRPVAS

SEQ ID NO: 54998 - protein, 25 aa, synthetic construct
  source 1..25: note = Seed: VKLQTVHSIPLTINKEEALQRPVAS
VKLQTVHSIPFTINKNEAVQRPVAS

SEQ ID NO: 54999 - protein, 25 aa, synthetic construct
  source 1..25: note = Seed: VKLQTVHSIPLTINKEEALQRPVAS
VKLQTVHSIPFTINKNEAWQRPVAS

SEQ ID NO: 55000 - protein, 25 aa, synthetic construct
  source 1..25: note = Seed: VKLQTVHSIPLTINKEEALQRPVAS
VKLQTVHSIPFTINKNEAYQRPVAS

SEQ ID NO: 55001 - protein, 25 aa, synthetic construct
  source 1..25: note = Seed: VKLQTVHSIPLTINKEEALQRPVAS
VKLQTVHSIPFTINKPEAFQRPVAS

SEQ ID NO: 55002 - protein, 25 aa, synthetic construct
  source 1..25: note = Seed: VKLQTVHSIPLTINKEEALQRPVAS
VKLQTVHSIPFTINKPEAIQRPVAS

SEQ ID NO: 55003 - protein, 25 aa, synthetic construct
  source 1..25: note = Seed: VKLQTVHSIPLTINKEEALQRPVAS
VKLQTVHSIPFTINKPEALQRPVAS

SEQ ID NO: 55004 - protein, 25 aa, synthetic construct
  source 1..25: note = Seed: VKLQTVHSIPLTINKEEALQRPVAS
VKLQTVHSIPFTINKPEAMQRPVAS

SEQ ID NO: 55005 - protein, 25 aa, synthetic construct
  source 1..25: note = Seed: VKLQTVHSIPLTINKEEALQRPVAS
VKLQTVHSIPFTINKPEAVQRPVAS

SEQ ID NO: 55006 - protein, 25 aa, synthetic construct
  source 1..25: note = Seed: VKLQTVHSIPLTINKEEALQRPVAS
VKLQTVHSIPFTINKPEAYQRPVAS

SEQ ID NO: 55007 - protein, 25 aa, synthetic construct
  source 1..25: note = Seed: VKLQTVHSIPLTINKEEALQRPVAS
VKLQTVHSIPFTINKQEAIQRPVAS

SEQ ID NO: 55008 - protein, 25 aa, synthetic construct
  source 1..25: note = Seed: VKLQTVHSIPLTINKEEALQRPVAS
VKLQTVHSIPFTINKSEAAQRPVAS

SEQ ID NO: 55009 - protein, 25 aa, synthetic construct
  source 1..25: note = Seed: VKLQTVHSIPLTINKEEALQRPVAS
VKLQTVHSIPFTINKSEAFQRPVAS

SEQ ID NO: 55010 - protein, 25 aa, synthetic construct
  source 1..25: note = Seed: VKLQTVHSIPLTINKEEALQRPVAS
VKLQTVHSIPFTINKSEAIQRPVAS

SEQ ID NO: 55011 - protein, 25 aa, synthetic construct
  source 1..25: note = Seed: VKLQTVHSIPLTINKEEALQRPVAS
VKLQTVHSIPFTINKSEALQRPVAS

SEQ ID NO: 55012 - protein, 25 aa, synthetic construct
  source 1..25: note = Seed: VKLQTVHSIPLTINKEEALQRPVAS
VKLQTVHSIPFTINKSEAMQRPVAS

SEQ ID NO: 55013 - protein, 25 aa, synthetic construct
  source 1..25: note = Seed: VKLQTVHSIPLTINKEEALQRPVAS
VKLQTVHSIPFTINKSEATQRPVAS

SEQ ID NO: 55014 - protein, 25 aa, synthetic construct
  source 1..25: note = Seed: VKLQTVHSIPLTINKEEALQRPVAS
VKLQTVHSIPFTINKSEAVQRPVAS

SEQ ID NO: 55015 - protein, 25 aa, synthetic construct
  source 1..25: note = Seed: VKLQTVHSIPLTINKEEALQRPVAS
VKLQTVHSIPFTINKSEAWQRPVAS

SEQ ID NO: 55016 - protein, 25 aa, synthetic construct
  source 1..25: note = Seed: VKLQTVHSIPLTINKEEALQRPVAS
VKLQTVHSIPFTINKSEAYQRPVAS

SEQ ID NO: 55017 - protein, 25 aa, synthetic construct
  source 1..25: note = Seed: VKLQTVHSIPLTINKEEALQRPVAS
VKLQTVHSIPFTINKTEAFQRPVAS

SEQ ID NO: 55018 - protein, 25 aa, synthetic construct
  source 1..25: note = Seed: VKLQTVHSIPLTINKEEALQRPVAS
VKLQTVHSIPFTINKTEAIQRPVAS

SEQ ID NO: 55019 - protein, 25 aa, synthetic construct
  source 1..25: note = Seed: VKLQTVHSIPLTINKEEALQRPVAS
VKLQTVHSIPFTINKTEALQRPVAS

SEQ ID NO: 55020 - protein, 25 aa, synthetic construct
  source 1..25: note = Seed: VKLQTVHSIPLTINKEEALQRPVAS
VKLQTVHSIPFTINKTEAMQRPVAS

SEQ ID NO: 55021 - protein, 25 aa, synthetic construct
  source 1..25: note = Seed: VKLQTVHSIPLTINKEEALQRPVAS
VKLQTVHSIPFTINKTEAVQRPVAS

SEQ ID NO: 55022 - protein, 25 aa, synthetic construct
  source 1..25: note = Seed: VKLQTVHSIPLTINKEEALQRPVAS
VKLQTVHSIPFTINKTEAYQRPVAS

SEQ ID NO: 55023 - protein, 25 aa, synthetic construct
  source 1..25: note = Seed: VKLQTVHSIPLTINKEEALQRPVAS
VKLQTVHSIPFTINKVEAAQRPVAS

SEQ ID NO: 55024 - protein, 25 aa, synthetic construct
  source 1..25: note = Seed: VKLQTVHSIPLTINKEEALQRPVAS
VKLQTVHSIPFTINKVEAFQRPVAS

SEQ ID NO: 55025 - protein, 25 aa, synthetic construct
  source 1..25: note = Seed: VKLQTVHSIPLTINKEEALQRPVAS
VKLQTVHSIPFTINKVEAIQRPVAS

SEQ ID NO: 55026 - protein, 25 aa, synthetic construct
  source 1..25: note = Seed: VKLQTVHSIPLTINKEEALQRPVAS
VKLQTVHSIPFTINKVEALQRPVAS

SEQ ID NO: 55027 - protein, 25 aa, synthetic construct
  source 1..25: note = Seed: VKLQTVHSIPLTINKEEALQRPVAS
VKLQTVHSIPFTINKVEAMQRPVAS

SEQ ID NO: 55028 - protein, 25 aa, synthetic construct
  source 1..25: note = Seed: VKLQTVHSIPLTINKEEALQRPVAS
VKLQTVHSIPFTINKVEAVQRPVAS

SEQ ID NO: 55029 - protein, 25 aa, synthetic construct
  source 1..25: note = Seed: VKLQTVHSIPLTINKEEALQRPVAS
VKLQTVHSIPFTINKVEAYQRPVAS

SEQ ID NO: 55030 - protein, 25 aa, synthetic construct
  source 1..25: note = Seed: VKLQTVHSIPLTINKEEALQRPVAS
VKLQTVHSIPFTINKWEAAQRPVAS

SEQ ID NO: 55031 - protein, 25 aa, synthetic construct
  source 1..25: note = Seed: VKLQTVHSIPLTINKEEALQRPVAS
VKLQTVHSIPFTINKWEAFQRPVAS

SEQ ID NO: 55032 - protein, 25 aa, synthetic construct
  source 1..25: note = Seed: VKLQTVHSIPLTINKEEALQRPVAS
VKLQTVHSIPFTINKWEAIQRPVAS

SEQ ID NO: 55033 - protein, 25 aa, synthetic construct
  source 1..25: note = Seed: VKLQTVHSIPLTINKEEALQRPVAS
VKLQTVHSIPFTINKWEALQRPVAS

SEQ ID NO: 55034 - protein, 25 aa, synthetic construct
  source 1..25: note = Seed: VKLQTVHSIPLTINKEEALQRPVAS
VKLQTVHSIPFTINKWEAMQRPVAS

SEQ ID NO: 55035 - protein, 25 aa, synthetic construct
  source 1..25: note = Seed: VKLQTVHSIPLTINKEEALQRPVAS
VKLQTVHSIPFTINKWEAVQRPVAS

SEQ ID NO: 55036 - protein, 25 aa, synthetic construct
  source 1..25: note = Seed: VKLQTVHSIPLTINKEEALQRPVAS
VKLQTVHSIPFTINKWEAYQRPVAS

SEQ ID NO: 55037 - protein, 25 aa, synthetic construct
  source 1..25: note = Seed: VKLQTVHSIPLTINKEEALQRPVAS
VKLQTVHSIPFTINKYEAAQRPVAS

SEQ ID NO: 55038 - protein, 25 aa, synthetic construct
  source 1..25: note = Seed: VKLQTVHSIPLTINKEEALQRPVAS
VKLQTVHSIPFTINKYEACQRPVAS

SEQ ID NO: 55039 - protein, 25 aa, synthetic construct
  source 1..25: note = Seed: VKLQTVHSIPLTINKEEALQRPVAS
VKLQTVHSIPFTINKYEAEQRPVAS

SEQ ID NO: 55040 - protein, 25 aa, synthetic construct
  source 1..25: note = Seed: VKLQTVHSIPLTINKEEALQRPVAS
VKLQTVHSIPFTINKYEAFQRPVAS

SEQ ID NO: 55041 - protein, 25 aa, synthetic construct
  source 1..25: note = Seed: VKLQTVHSIPLTINKEEALQRPVAS
VKLQTVHSIPFTINKYEAIQRPVAS

SEQ ID NO: 55042 - protein, 25 aa, synthetic construct
  source 1..25: note = Seed: VKLQTVHSIPLTINKEEALQRPVAS
VKLQTVHSIPFTINKYEALQRPVAS

SEQ ID NO: 55043 - protein, 25 aa, synthetic construct
  source 1..25: note = Seed: VKLQTVHSIPLTINKEEALQRPVAS
VKLQTVHSIPFTINKYEAMQRPVAS

SEQ ID NO: 55044 - protein, 25 aa, synthetic construct
  source 1..25: note = Seed: VKLQTVHSIPLTINKEEALQRPVAS
VKLQTVHSIPFTINKYEASQRPVAS

SEQ ID NO: 55045 - protein, 25 aa, synthetic construct
  source 1..25: note = Seed: VKLQTVHSIPLTINKEEALQRPVAS
VKLQTVHSIPFTINKYEATQRPVAS

SEQ ID NO: 55046 - protein, 25 aa, synthetic construct
  source 1..25: note = Seed: VKLQTVHSIPLTINKEEALQRPVAS
VKLQTVHSIPFTINKYEAVQRPVAS

SEQ ID NO: 55047 - protein, 25 aa, synthetic construct
  source 1..25: note = Seed: VKLQTVHSIPLTINKEEALQRPVAS
VKLQTVHSIPFTINKYEAYQRPVAS

SEQ ID NO: 55048 - protein, 25 aa, synthetic construct
  source 1..25: note = Seed: VKLQTVHSIPLTINKEEALQRPVAS
VKLQTVHSIPFTIPKFEAFQRPVAS

SEQ ID NO: 55049 - protein, 25 aa, synthetic construct
  source 1..25: note = Seed: VKLQTVHSIPLTINKEEALQRPVAS
VKLQTVHSIPFTIPKFEAIQRPVAS

SEQ ID NO: 55050 - protein, 25 aa, synthetic construct
  source 1..25: note = Seed: VKLQTVHSIPLTINKEEALQRPVAS
VKLQTVHSIPFTIPKFEALQRPVAS

SEQ ID NO: 55051 - protein, 25 aa, synthetic construct
  source 1..25: note = Seed: VKLQTVHSIPLTINKEEALQRPVAS
VKLQTVHSIPFTIPKFEAMQRPVAS

SEQ ID NO: 55052 - protein, 25 aa, synthetic construct
  source 1..25: note = Seed: VKLQTVHSIPLTINKEEALQRPVAS
VKLQTVHSIPFTIPKFEAVQRPVAS

SEQ ID NO: 55053 - protein, 25 aa, synthetic construct
  source 1..25: note = Seed: VKLQTVHSIPLTINKEEALQRPVAS
VKLQTVHSIPFTIPKFEAYQRPVAS

SEQ ID NO: 55054 - protein, 25 aa, synthetic construct
  source 1..25: note = Seed: VKLQTVHSIPLTINKEEALQRPVAS
VKLQTVHSIPFTIQKAEALQRPVAS

SEQ ID NO: 55055 - protein, 25 aa, synthetic construct
  source 1..25: note = Seed: VKLQTVHSIPLTINKEEALQRPVAS
VKLQTVHSIPFTIQKFEAAQRPVAS

SEQ ID NO: 55056 - protein, 25 aa, synthetic construct
  source 1..25: note = Seed: VKLQTVHSIPLTINKEEALQRPVAS
VKLQTVHSIPFTIQKFEACQRPVAS

SEQ ID NO: 55057 - protein, 25 aa, synthetic construct
  source 1..25: note = Seed: VKLQTVHSIPLTINKEEALQRPVAS
VKLQTVHSIPFTIQKFEADQRPVAS

SEQ ID NO: 55058 - protein, 25 aa, synthetic construct
  source 1..25: note = Seed: VKLQTVHSIPLTINKEEALQRPVAS
VKLQTVHSIPFTIQKFEAEQRPVAS

SEQ ID NO: 55059 - protein, 25 aa, synthetic construct
  source 1..25: note = Seed: VKLQTVHSIPLTINKEEALQRPVAS
VKLQTVHSIPFTIQKFEAFQRPVAS

SEQ ID NO: 55060 - protein, 25 aa, synthetic construct
  source 1..25: note = Seed: VKLQTVHSIPLTINKEEALQRPVAS
VKLQTVHSIPFTIQKFEAGQRPVAS

SEQ ID NO: 55061 - protein, 25 aa, synthetic construct
  source 1..25: note = Seed: VKLQTVHSIPLTINKEEALQRPVAS
VKLQTVHSIPFTIQKFEAHQRPVAS

SEQ ID NO: 55062 - protein, 25 aa, synthetic construct
  source 1..25: note = Seed: VKLQTVHSIPLTINKEEALQRPVAS
VKLQTVHSIPFTIQKFEAIQRPVAS

SEQ ID NO: 55063 - protein, 25 aa, synthetic construct
  source 1..25: note = Seed: VKLQTVHSIPLTINKEEALQRPVAS
VKLQTVHSIPFTIQKFEAKQRPVAS

SEQ ID NO: 55064 - protein, 25 aa, synthetic construct
  source 1..25: note = Seed: VKLQTVHSIPLTINKEEALQRPVAS
VKLQTVHSIPFTIQKFEALQRPVAS

SEQ ID NO: 55065 - protein, 25 aa, synthetic construct
  source 1..25: note = Seed: VKLQTVHSIPLTINKEEALQRPVAS
VKLQTVHSIPFTIQKFEAMQRPVAS

SEQ ID NO: 55066 - protein, 25 aa, synthetic construct
  source 1..25: note = Seed: VKLQTVHSIPLTINKEEALQRPVAS
VKLQTVHSIPFTIQKFEANQRPVAS

SEQ ID NO: 55067 - protein, 25 aa, synthetic construct
  source 1..25: note = Seed: VKLQTVHSIPLTINKEEALQRPVAS
VKLQTVHSIPFTIQKFEAPQRPVAS

SEQ ID NO: 55068 - protein, 25 aa, synthetic construct
  source 1..25: note = Seed: VKLQTVHSIPLTINKEEALQRPVAS
VKLQTVHSIPFTIQKFEAQQRPVAS

SEQ ID NO: 55069 - protein, 25 aa, synthetic construct
  source 1..25: note = Seed: VKLQTVHSIPLTINKEEALQRPVAS
VKLQTVHSIPFTIQKFEARQRPVAS

SEQ ID NO: 55070 - protein, 25 aa, synthetic construct
  source 1..25: note = Seed: VKLQTVHSIPLTINKEEALQRPVAS
VKLQTVHSIPFTIQKFEASQRPVAS

SEQ ID NO: 55071 - protein, 25 aa, synthetic construct
  source 1..25: note = Seed: VKLQTVHSIPLTINKEEALQRPVAS
VKLQTVHSIPFTIQKFEATQRPVAS

SEQ ID NO: 55072 - protein, 25 aa, synthetic construct
  source 1..25: note = Seed: VKLQTVHSIPLTINKEEALQRPVAS
VKLQTVHSIPFTIQKFEAVQRPVAS

SEQ ID NO: 55073 - protein, 25 aa, synthetic construct
  source 1..25: note = Seed: VKLQTVHSIPLTINKEEALQRPVAS
VKLQTVHSIPFTIQKFEAWQRPVAS

SEQ ID NO: 55074 - protein, 25 aa, synthetic construct
  source 1..25: note = Seed: VKLQTVHSIPLTINKEEALQRPVAS
VKLQTVHSIPFTIQKFEAYQRPVAS

SEQ ID NO: 55075 - protein, 25 aa, synthetic construct
  source 1..25: note = Seed: VKLQTVHSIPLTINKEEALQRPVAS
VKLQTVHSIPFTIQKIEAFQRPVAS

SEQ ID NO: 55076 - protein, 25 aa, synthetic construct
  source 1..25: note = Seed: VKLQTVHSIPLTINKEEALQRPVAS
VKLQTVHSIPFTIQKIEAIQRPVAS

SEQ ID NO: 55077 - protein, 25 aa, synthetic construct
  source 1..25: note = Seed: VKLQTVHSIPLTINKEEALQRPVAS
VKLQTVHSIPFTIQKIEALQRPVAS

SEQ ID NO: 55078 - protein, 25 aa, synthetic construct
  source 1..25: note = Seed: VKLQTVHSIPLTINKEEALQRPVAS
VKLQTVHSIPFTIQKIEAMQRPVAS

SEQ ID NO: 55079 - protein, 25 aa, synthetic construct
  source 1..25: note = Seed: VKLQTVHSIPLTINKEEALQRPVAS
VKLQTVHSIPFTIQKIEAVQRPVAS

SEQ ID NO: 55080 - protein, 25 aa, synthetic construct
  source 1..25: note = Seed: VKLQTVHSIPLTINKEEALQRPVAS
VKLQTVHSIPFTIQKIEAYQRPVAS

SEQ ID NO: 55081 - protein, 25 aa, synthetic construct
  source 1..25: note = Seed: VKLQTVHSIPLTINKEEALQRPVAS
VKLQTVHSIPFTIQKLEAAQRPVAS

SEQ ID NO: 55082 - protein, 25 aa, synthetic construct
  source 1..25: note = Seed: VKLQTVHSIPLTINKEEALQRPVAS
VKLQTVHSIPFTIQKLEAFQRPVAS

SEQ ID NO: 55083 - protein, 25 aa, synthetic construct
  source 1..25: note = Seed: VKLQTVHSIPLTINKEEALQRPVAS
VKLQTVHSIPFTIQKLEAIQRPVAS

SEQ ID NO: 55084 - protein, 25 aa, synthetic construct
  source 1..25: note = Seed: VKLQTVHSIPLTINKEEALQRPVAS
VKLQTVHSIPFTIQKLEALQRPVAS

SEQ ID NO: 55085 - protein, 25 aa, synthetic construct
  source 1..25: note = Seed: VKLQTVHSIPLTINKEEALQRPVAS
VKLQTVHSIPFTIQKLEAMQRPVAS

SEQ ID NO: 55086 - protein, 25 aa, synthetic construct
  source 1..25: note = Seed: VKLQTVHSIPLTINKEEALQRPVAS
VKLQTVHSIPFTIQKLEASQRPVAS

SEQ ID NO: 55087 - protein, 25 aa, synthetic construct
  source 1..25: note = Seed: VKLQTVHSIPLTINKEEALQRPVAS
VKLQTVHSIPFTIQKLEATQRPVAS

SEQ ID NO: 55088 - protein, 25 aa, synthetic construct
  source 1..25: note = Seed: VKLQTVHSIPLTINKEEALQRPVAS
VKLQTVHSIPFTIQKLEAVQRPVAS

SEQ ID NO: 55089 - protein, 25 aa, synthetic construct
  source 1..25: note = Seed: VKLQTVHSIPLTINKEEALQRPVAS
VKLQTVHSIPFTIQKLEAWQRPVAS

SEQ ID NO: 55090 - protein, 25 aa, synthetic construct
  source 1..25: note = Seed: VKLQTVHSIPLTINKEEALQRPVAS
VKLQTVHSIPFTIQKLEAYQRPVAS

SEQ ID NO: 55091 - protein, 25 aa, synthetic construct
  source 1..25: note = Seed: VKLQTVHSIPLTINKEEALQRPVAS
VKLQTVHSIPFTIQKMEAFQRPVAS

SEQ ID NO: 55092 - protein, 25 aa, synthetic construct
  source 1..25: note = Seed: VKLQTVHSIPLTINKEEALQRPVAS
VKLQTVHSIPFTIQKMEAIQRPVAS

SEQ ID NO: 55093 - protein, 25 aa, synthetic construct
  source 1..25: note = Seed: VKLQTVHSIPLTINKEEALQRPVAS
VKLQTVHSIPFTIQKMEALQRPVAS

SEQ ID NO: 55094 - protein, 25 aa, synthetic construct
  source 1..25: note = Seed: VKLQTVHSIPLTINKEEALQRPVAS
VKLQTVHSIPFTIQKMEAMQRPVAS

SEQ ID NO: 55095 - protein, 25 aa, synthetic construct
  source 1..25: note = Seed: VKLQTVHSIPLTINKEEALQRPVAS
VKLQTVHSIPFTIQKMEAVQRPVAS

SEQ ID NO: 55096 - protein, 25 aa, synthetic construct
  source 1..25: note = Seed: VKLQTVHSIPLTINKEEALQRPVAS
VKLQTVHSIPFTIQKNEAIQRPVAS

SEQ ID NO: 55097 - protein, 25 aa, synthetic construct
  source 1..25: note = Seed: VKLQTVHSIPLTINKEEALQRPVAS
VKLQTVHSIPFTIQKNEAVQRPVAS

SEQ ID NO: 55098 - protein, 25 aa, synthetic construct
  source 1..25: note = Seed: VKLQTVHSIPLTINKEEALQRPVAS
VKLQTVHSIPFTIQKREAFQRPVAS

SEQ ID NO: 55099 - protein, 25 aa, synthetic construct
  source 1..25: note = Seed: VKLQTVHSIPLTINKEEALQRPVAS
VKLQTVHSIPFTIQKREALQRPVAS

SEQ ID NO: 55100 - protein, 25 aa, synthetic construct
  source 1..25: note = Seed: VKLQTVHSIPLTINKEEALQRPVAS
VKLQTVHSIPFTIQKVEAFQRPVAS

SEQ ID NO: 55101 - protein, 25 aa, synthetic construct
  source 1..25: note = Seed: VKLQTVHSIPLTINKEEALQRPVAS
VKLQTVHSIPFTIQKVEAIQRPVAS

SEQ ID NO: 55102 - protein, 25 aa, synthetic construct
  source 1..25: note = Seed: VKLQTVHSIPLTINKEEALQRPVAS
VKLQTVHSIPFTIQKVEALQRPVAS

SEQ ID NO: 55103 - protein, 25 aa, synthetic construct
  source 1..25: note = Seed: VKLQTVHSIPLTINKEEALQRPVAS
VKLQTVHSIPFTIQKVEAMQRPVAS

SEQ ID NO: 55104 - protein, 25 aa, synthetic construct
  source 1..25: note = Seed: VKLQTVHSIPLTINKEEALQRPVAS
VKLQTVHSIPFTIQKVEAVQRPVAS

SEQ ID NO: 55105 - protein, 25 aa, synthetic construct
  source 1..25: note = Seed: VKLQTVHSIPLTINKEEALQRPVAS
VKLQTVHSIPFTIQKWEAAQRPVAS

SEQ ID NO: 55106 - protein, 25 aa, synthetic construct
  source 1..25: note = Seed: VKLQTVHSIPLTINKEEALQRPVAS
VKLQTVHSIPFTIQKWEAFQRPVAS

SEQ ID NO: 55107 - protein, 25 aa, synthetic construct
  source 1..25: note = Seed: VKLQTVHSIPLTINKEEALQRPVAS
VKLQTVHSIPFTIQKWEAIQRPVAS

SEQ ID NO: 55108 - protein, 25 aa, synthetic construct
  source 1..25: note = Seed: VKLQTVHSIPLTINKEEALQRPVAS
VKLQTVHSIPFTIQKWEALQRPVAS

SEQ ID NO: 55109 - protein, 25 aa, synthetic construct
  source 1..25: note = Seed: VKLQTVHSIPLTINKEEALQRPVAS
VKLQTVHSIPFTIQKWEAMQRPVAS

SEQ ID NO: 55110 - protein, 25 aa, synthetic construct
  source 1..25: note = Seed: VKLQTVHSIPLTINKEEALQRPVAS
VKLQTVHSIPFTIQKWEAVQRPVAS

SEQ ID NO: 55111 - protein, 25 aa, synthetic construct
  source 1..25: note = Seed: VKLQTVHSIPLTINKEEALQRPVAS
VKLQTVHSIPFTIQKWEAYQRPVAS

SEQ ID NO: 55112 - protein, 25 aa, synthetic construct
  source 1..25: note = Seed: VKLQTVHSIPLTINKEEALQRPVAS
VKLQTVHSIPFTIQKYEAAQRPVAS

SEQ ID NO: 55113 - protein, 25 aa, synthetic construct
  source 1..25: note = Seed: VKLQTVHSIPLTINKEEALQRPVAS
VKLQTVHSIPFTIQKYEAFQRPVAS

SEQ ID NO: 55114 - protein, 25 aa, synthetic construct
  source 1..25: note = Seed: VKLQTVHSIPLTINKEEALQRPVAS
VKLQTVHSIPFTIQKYEAIQRPVAS

SEQ ID NO: 55115 - protein, 25 aa, synthetic construct
  source 1..25: note = Seed: VKLQTVHSIPLTINKEEALQRPVAS
VKLQTVHSIPFTIQKYEALQRPVAS

SEQ ID NO: 55116 - protein, 25 aa, synthetic construct
  source 1..25: note = Seed: VKLQTVHSIPLTINKEEALQRPVAS
VKLQTVHSIPFTIQKYEAMQRPVAS

SEQ ID NO: 55117 - protein, 25 aa, synthetic construct
  source 1..25: note = Seed: VKLQTVHSIPLTINKEEALQRPVAS
VKLQTVHSIPFTIQKYEAVQRPVAS

SEQ ID NO: 55118 - protein, 25 aa, synthetic construct
  source 1..25: note = Seed: VKLQTVHSIPLTINKEEALQRPVAS
VKLQTVHSIPFTIQKYEAWQRPVAS

SEQ ID NO: 55119 - protein, 25 aa, synthetic construct
  source 1..25: note = Seed: VKLQTVHSIPLTINKEEALQRPVAS
VKLQTVHSIPFTIQKYEAYQRPVAS

SEQ ID NO: 55120 - protein, 25 aa, synthetic construct
  source 1..25: note = Seed: VKLQTVHSIPLTINKEEALQRPVAS
VKLQTVHSIPFTIRKAEAFQRPVAS

SEQ ID NO: 55121 - protein, 25 aa, synthetic construct
  source 1..25: note = Seed: VKLQTVHSIPLTINKEEALQRPVAS
VKLQTVHSIPFTIRKFEAAQRPVAS

SEQ ID NO: 55122 - protein, 25 aa, synthetic construct
  source 1..25: note = Seed: VKLQTVHSIPLTINKEEALQRPVAS
VKLQTVHSIPFTIRKFEAEQRPVAS

SEQ ID NO: 55123 - protein, 25 aa, synthetic construct
  source 1..25: note = Seed: VKLQTVHSIPLTINKEEALQRPVAS
VKLQTVHSIPFTIRKFEAFQRPVAS

SEQ ID NO: 55124 - protein, 25 aa, synthetic construct
  source 1..25: note = Seed: VKLQTVHSIPLTINKEEALQRPVAS
VKLQTVHSIPFTIRKFEAIQRPVAS

SEQ ID NO: 55125 - protein, 25 aa, synthetic construct
  source 1..25: note = Seed: VKLQTVHSIPLTINKEEALQRPVAS
VKLQTVHSIPFTIRKFEALQRPVAS

SEQ ID NO: 55126 - protein, 25 aa, synthetic construct
  source 1..25: note = Seed: VKLQTVHSIPLTINKEEALQRPVAS
VKLQTVHSIPFTIRKFEAMQRPVAS

SEQ ID NO: 55127 - protein, 25 aa, synthetic construct
  source 1..25: note = Seed: VKLQTVHSIPLTINKEEALQRPVAS
VKLQTVHSIPFTIRKFEASQRPVAS

SEQ ID NO: 55128 - protein, 25 aa, synthetic construct
  source 1..25: note = Seed: VKLQTVHSIPLTINKEEALQRPVAS
VKLQTVHSIPFTIRKFEATQRPVAS

SEQ ID NO: 55129 - protein, 25 aa, synthetic construct
  source 1..25: note = Seed: VKLQTVHSIPLTINKEEALQRPVAS
VKLQTVHSIPFTIRKFEAVQRPVAS

SEQ ID NO: 55130 - protein, 25 aa, synthetic construct
  source 1..25: note = Seed: VKLQTVHSIPLTINKEEALQRPVAS
VKLQTVHSIPFTIRKFEAWQRPVAS

SEQ ID NO: 55131 - protein, 25 aa, synthetic construct
  source 1..25: note = Seed: VKLQTVHSIPLTINKEEALQRPVAS
VKLQTVHSIPFTIRKFEAYQRPVAS

SEQ ID NO: 55132 - protein, 25 aa, synthetic construct
  source 1..25: note = Seed: VKLQTVHSIPLTINKEEALQRPVAS
VKLQTVHSIPFTIRKKEAFQRPVAS

SEQ ID NO: 55133 - protein, 25 aa, synthetic construct
  source 1..25: note = Seed: VKLQTVHSIPLTINKEEALQRPVAS
VKLQTVHSIPFTIRKKEAIQRPVAS

SEQ ID NO: 55134 - protein, 25 aa, synthetic construct
  source 1..25: note = Seed: VKLQTVHSIPLTINKEEALQRPVAS
VKLQTVHSIPFTIRKKEALQRPVAS

SEQ ID NO: 55135 - protein, 25 aa, synthetic construct
  source 1..25: note = Seed: VKLQTVHSIPLTINKEEALQRPVAS
VKLQTVHSIPFTIRKLEAFQRPVAS

SEQ ID NO: 55136 - protein, 25 aa, synthetic construct
  source 1..25: note = Seed: VKLQTVHSIPLTINKEEALQRPVAS
VKLQTVHSIPFTIRKLEAIQRPVAS

SEQ ID NO: 55137 - protein, 25 aa, synthetic construct
  source 1..25: note = Seed: VKLQTVHSIPLTINKEEALQRPVAS
VKLQTVHSIPFTIRKLEALQRPVAS

SEQ ID NO: 55138 - protein, 25 aa, synthetic construct
  source 1..25: note = Seed: VKLQTVHSIPLTINKEEALQRPVAS
VKLQTVHSIPFTIRKREAFQRPVAS

SEQ ID NO: 55139 - protein, 25 aa, synthetic construct
  source 1..25: note = Seed: VKLQTVHSIPLTINKEEALQRPVAS
VKLQTVHSIPFTIRKREAIQRPVAS

SEQ ID NO: 55140 - protein, 25 aa, synthetic construct
  source 1..25: note = Seed: VKLQTVHSIPLTINKEEALQRPVAS
VKLQTVHSIPFTIRKREALQRPVAS

SEQ ID NO: 55141 - protein, 25 aa, synthetic construct
  source 1..25: note = Seed: VKLQTVHSIPLTINKEEALQRPVAS
VKLQTVHSIPFTIRKREAMQRPVAS

SEQ ID NO: 55142 - protein, 25 aa, synthetic construct
  source 1..25: note = Seed: VKLQTVHSIPLTINKEEALQRPVAS
VKLQTVHSIPFTIRKREAVQRPVAS

SEQ ID NO: 55143 - protein, 25 aa, synthetic construct
  source 1..25: note = Seed: VKLQTVHSIPLTINKEEALQRPVAS
VKLQTVHSIPFTIRKREAWQRPVAS

SEQ ID NO: 55144 - protein, 25 aa, synthetic construct
  source 1..25: note = Seed: VKLQTVHSIPLTINKEEALQRPVAS
VKLQTVHSIPFTIRKREAYQRPVAS

SEQ ID NO: 55145 - protein, 25 aa, synthetic construct
  source 1..25: note = Seed: VKLQTVHSIPLTINKEEALQRPVAS
VKLQTVHSIPFTIRKSEAFQRPVAS

SEQ ID NO: 55146 - protein, 25 aa, synthetic construct
  source 1..25: note = Seed: VKLQTVHSIPLTINKEEALQRPVAS
VKLQTVHSIPFTIRKSEAMQRPVAS

SEQ ID NO: 55147 - protein, 25 aa, synthetic construct
  source 1..25: note = Seed: VKLQTVHSIPLTINKEEALQRPVAS
VKLQTVHSIPFTIRKTEAFQRPVAS

SEQ ID NO: 55148 - protein, 25 aa, synthetic construct
  source 1..25: note = Seed: VKLQTVHSIPLTINKEEALQRPVAS
VKLQTVHSIPFTIRKWEAFQRPVAS

SEQ ID NO: 55149 - protein, 25 aa, synthetic construct
  source 1..25: note = Seed: VKLQTVHSIPLTINKEEALQRPVAS
VKLQTVHSIPFTIRKWEAIQRPVAS

SEQ ID NO: 55150 - protein, 25 aa, synthetic construct
  source 1..25: note = Seed: VKLQTVHSIPLTINKEEALQRPVAS
VKLQTVHSIPFTIRKWEALQRPVAS

SEQ ID NO: 55151 - protein, 25 aa, synthetic construct
  source 1..25: note = Seed: VKLQTVHSIPLTINKEEALQRPVAS
VKLQTVHSIPFTIRKYEAFQRPVAS

SEQ ID NO: 55152 - protein, 25 aa, synthetic construct
  source 1..25: note = Seed: VKLQTVHSIPLTINKEEALQRPVAS
VKLQTVHSIPFTIRKYEALQRPVAS

SEQ ID NO: 55153 - protein, 25 aa, synthetic construct
  source 1..25: note = Seed: VKLQTVHSIPLTINKEEALQRPVAS
VKLQTVHSIPFTISKAEAIQRPVAS

SEQ ID NO: 55154 - protein, 25 aa, synthetic construct
  source 1..25: note = Seed: VKLQTVHSIPLTINKEEALQRPVAS
VKLQTVHSIPFTISKAEALQRPVAS

SEQ ID NO: 55155 - protein, 25 aa, synthetic construct
  source 1..25: note = Seed: VKLQTVHSIPLTINKEEALQRPVAS
VKLQTVHSIPFTISKAEAVQRPVAS

SEQ ID NO: 55156 - protein, 25 aa, synthetic construct
  source 1..25: note = Seed: VKLQTVHSIPLTINKEEALQRPVAS
VKLQTVHSIPFTISKFEAAQRPVAS

SEQ ID NO: 55157 - protein, 25 aa, synthetic construct
  source 1..25: note = Seed: VKLQTVHSIPLTINKEEALQRPVAS
VKLQTVHSIPFTISKFEACQRPVAS

SEQ ID NO: 55158 - protein, 25 aa, synthetic construct
  source 1..25: note = Seed: VKLQTVHSIPLTINKEEALQRPVAS
VKLQTVHSIPFTISKFEADQRPVAS

SEQ ID NO: 55159 - protein, 25 aa, synthetic construct
  source 1..25: note = Seed: VKLQTVHSIPLTINKEEALQRPVAS
VKLQTVHSIPFTISKFEAEQRPVAS

SEQ ID NO: 55160 - protein, 25 aa, synthetic construct
  source 1..25: note = Seed: VKLQTVHSIPLTINKEEALQRPVAS
VKLQTVHSIPFTISKFEAFQRPVAS

SEQ ID NO: 55161 - protein, 25 aa, synthetic construct
  source 1..25: note = Seed: VKLQTVHSIPLTINKEEALQRPVAS
VKLQTVHSIPFTISKFEAGQRPVAS

SEQ ID NO: 55162 - protein, 25 aa, synthetic construct
  source 1..25: note = Seed: VKLQTVHSIPLTINKEEALQRPVAS
VKLQTVHSIPFTISKFEAHQRPVAS

SEQ ID NO: 55163 - protein, 25 aa, synthetic construct
  source 1..25: note = Seed: VKLQTVHSIPLTINKEEALQRPVAS
VKLQTVHSIPFTISKFEAIQRPVAS

SEQ ID NO: 55164 - protein, 25 aa, synthetic construct
  source 1..25: note = Seed: VKLQTVHSIPLTINKEEALQRPVAS
VKLQTVHSIPFTISKFEAKQRPVAS

SEQ ID NO: 55165 - protein, 25 aa, synthetic construct
  source 1..25: note = Seed: VKLQTVHSIPLTINKEEALQRPVAS
VKLQTVHSIPFTISKFEALQRPVAS

SEQ ID NO: 55166 - protein, 25 aa, synthetic construct
  source 1..25: note = Seed: VKLQTVHSIPLTINKEEALQRPVAS
VKLQTVHSIPFTISKFEAMQRPVAS

SEQ ID NO: 55167 - protein, 25 aa, synthetic construct
  source 1..25: note = Seed: VKLQTVHSIPLTINKEEALQRPVAS
VKLQTVHSIPFTISKFEANQRPVAS

SEQ ID NO: 55168 - protein, 25 aa, synthetic construct
  source 1..25: note = Seed: VKLQTVHSIPLTINKEEALQRPVAS
VKLQTVHSIPFTISKFEAPQRPVAS

SEQ ID NO: 55169 - protein, 25 aa, synthetic construct
  source 1..25: note = Seed: VKLQTVHSIPLTINKEEALQRPVAS
VKLQTVHSIPFTISKFEAQQRPVAS

SEQ ID NO: 55170 - protein, 25 aa, synthetic construct
  source 1..25: note = Seed: VKLQTVHSIPLTINKEEALQRPVAS
VKLQTVHSIPFTISKFEARQRPVAS

SEQ ID NO: 55171 - protein, 25 aa, synthetic construct
  source 1..25: note = Seed: VKLQTVHSIPLTINKEEALQRPVAS
VKLQTVHSIPFTISKFEASQRPVAS

SEQ ID NO: 55172 - protein, 25 aa, synthetic construct
  source 1..25: note = Seed: VKLQTVHSIPLTINKEEALQRPVAS
VKLQTVHSIPFTISKFEATQRPVAS

SEQ ID NO: 55173 - protein, 25 aa, synthetic construct
  source 1..25: note = Seed: VKLQTVHSIPLTINKEEALQRPVAS
VKLQTVHSIPFTISKFEAVQRPVAS

SEQ ID NO: 55174 - protein, 25 aa, synthetic construct
  source 1..25: note = Seed: VKLQTVHSIPLTINKEEALQRPVAS
VKLQTVHSIPFTISKFEAWQRPVAS

SEQ ID NO: 55175 - protein, 25 aa, synthetic construct
  source 1..25: note = Seed: VKLQTVHSIPLTINKEEALQRPVAS
VKLQTVHSIPFTISKFEAYQRPVAS

SEQ ID NO: 55176 - protein, 25 aa, synthetic construct
  source 1..25: note = Seed: VKLQTVHSIPLTINKEEALQRPVAS
VKLQTVHSIPFTISKIEAAQRPVAS

SEQ ID NO: 55177 - protein, 25 aa, synthetic construct
  source 1..25: note = Seed: VKLQTVHSIPLTINKEEALQRPVAS
VKLQTVHSIPFTISKIEADQRPVAS

SEQ ID NO: 55178 - protein, 25 aa, synthetic construct
  source 1..25: note = Seed: VKLQTVHSIPLTINKEEALQRPVAS
VKLQTVHSIPFTISKIEAFQRPVAS

SEQ ID NO: 55179 - protein, 25 aa, synthetic construct
  source 1..25: note = Seed: VKLQTVHSIPLTINKEEALQRPVAS
VKLQTVHSIPFTISKIEAIQRPVAS

SEQ ID NO: 55180 - protein, 25 aa, synthetic construct
  source 1..25: note = Seed: VKLQTVHSIPLTINKEEALQRPVAS
VKLQTVHSIPFTISKIEALQRPVAS

SEQ ID NO: 55181 - protein, 25 aa, synthetic construct
  source 1..25: note = Seed: VKLQTVHSIPLTINKEEALQRPVAS
VKLQTVHSIPFTISKIEAMQRPVAS

SEQ ID NO: 55182 - protein, 25 aa, synthetic construct
  source 1..25: note = Seed: VKLQTVHSIPLTINKEEALQRPVAS
VKLQTVHSIPFTISKIEANQRPVAS

SEQ ID NO: 55183 - protein, 25 aa, synthetic construct
  source 1..25: note = Seed: VKLQTVHSIPLTINKEEALQRPVAS
VKLQTVHSIPFTISKIEASQRPVAS

SEQ ID NO: 55184 - protein, 25 aa, synthetic construct
  source 1..25: note = Seed: VKLQTVHSIPLTINKEEALQRPVAS
VKLQTVHSIPFTISKIEATQRPVAS

SEQ ID NO: 55185 - protein, 25 aa, synthetic construct
  source 1..25: note = Seed: VKLQTVHSIPLTINKEEALQRPVAS
VKLQTVHSIPFTISKIEAVQRPVAS

SEQ ID NO: 55186 - protein, 25 aa, synthetic construct
  source 1..25: note = Seed: VKLQTVHSIPLTINKEEALQRPVAS
VKLQTVHSIPFTISKIEAYQRPVAS

SEQ ID NO: 55187 - protein, 25 aa, synthetic construct
  source 1..25: note = Seed: VKLQTVHSIPLTINKEEALQRPVAS
VKLQTVHSIPFTISKLEAAQRPVAS

SEQ ID NO: 55188 - protein, 25 aa, synthetic construct
  source 1..25: note = Seed: VKLQTVHSIPLTINKEEALQRPVAS
VKLQTVHSIPFTISKLEACQRPVAS

SEQ ID NO: 55189 - protein, 25 aa, synthetic construct
  source 1..25: note = Seed: VKLQTVHSIPLTINKEEALQRPVAS
VKLQTVHSIPFTISKLEADQRPVAS

SEQ ID NO: 55190 - protein, 25 aa, synthetic construct
  source 1..25: note = Seed: VKLQTVHSIPLTINKEEALQRPVAS
VKLQTVHSIPFTISKLEAEQRPVAS

SEQ ID NO: 55191 - protein, 25 aa, synthetic construct
  source 1..25: note = Seed: VKLQTVHSIPLTINKEEALQRPVAS
VKLQTVHSIPFTISKLEAFQRPVAS

SEQ ID NO: 55192 - protein, 25 aa, synthetic construct
  source 1..25: note = Seed: VKLQTVHSIPLTINKEEALQRPVAS
VKLQTVHSIPFTISKLEAGQRPVAS

SEQ ID NO: 55193 - protein, 25 aa, synthetic construct
  source 1..25: note = Seed: VKLQTVHSIPLTINKEEALQRPVAS
VKLQTVHSIPFTISKLEAIQRPVAS

SEQ ID NO: 55194 - protein, 25 aa, synthetic construct
  source 1..25: note = Seed: VKLQTVHSIPLTINKEEALQRPVAS
VKLQTVHSIPFTISKLEALQRPVAS

SEQ ID NO: 55195 - protein, 25 aa, synthetic construct
  source 1..25: note = Seed: VKLQTVHSIPLTINKEEALQRPVAS
VKLQTVHSIPFTISKLEAMQRPVAS

SEQ ID NO: 55196 - protein, 25 aa, synthetic construct
  source 1..25: note = Seed: VKLQTVHSIPLTINKEEALQRPVAS
VKLQTVHSIPFTISKLEANQRPVAS

SEQ ID NO: 55197 - protein, 25 aa, synthetic construct
  source 1..25: note = Seed: VKLQTVHSIPLTINKEEALQRPVAS
VKLQTVHSIPFTISKLEAQQRPVAS

SEQ ID NO: 55198 - protein, 25 aa, synthetic construct
  source 1..25: note = Seed: VKLQTVHSIPLTINKEEALQRPVAS
VKLQTVHSIPFTISKLEASQRPVAS

SEQ ID NO: 55199 - protein, 25 aa, synthetic construct
  source 1..25: note = Seed: VKLQTVHSIPLTINKEEALQRPVAS
VKLQTVHSIPFTISKLEATQRPVAS

SEQ ID NO: 55200 - protein, 25 aa, synthetic construct
  source 1..25: note = Seed: VKLQTVHSIPLTINKEEALQRPVAS
VKLQTVHSIPFTISKLEAVQRPVAS

SEQ ID NO: 55201 - protein, 25 aa, synthetic construct
  source 1..25: note = Seed: VKLQTVHSIPLTINKEEALQRPVAS
VKLQTVHSIPFTISKLEAYQRPVAS

SEQ ID NO: 55202 - protein, 25 aa, synthetic construct
  source 1..25: note = Seed: VKLQTVHSIPLTINKEEALQRPVAS
VKLQTVHSIPFTISKMEAAQRPVAS

SEQ ID NO: 55203 - protein, 25 aa, synthetic construct
  source 1..25: note = Seed: VKLQTVHSIPLTINKEEALQRPVAS
VKLQTVHSIPFTISKMEACQRPVAS

SEQ ID NO: 55204 - protein, 25 aa, synthetic construct
  source 1..25: note = Seed: VKLQTVHSIPLTINKEEALQRPVAS
VKLQTVHSIPFTISKMEAFQRPVAS

SEQ ID NO: 55205 - protein, 25 aa, synthetic construct
  source 1..25: note = Seed: VKLQTVHSIPLTINKEEALQRPVAS
VKLQTVHSIPFTISKMEAIQRPVAS

SEQ ID NO: 55206 - protein, 25 aa, synthetic construct
  source 1..25: note = Seed: VKLQTVHSIPLTINKEEALQRPVAS
VKLQTVHSIPFTISKMEALQRPVAS

SEQ ID NO: 55207 - protein, 25 aa, synthetic construct
  source 1..25: note = Seed: VKLQTVHSIPLTINKEEALQRPVAS
VKLQTVHSIPFTISKMEAMQRPVAS

SEQ ID NO: 55208 - protein, 25 aa, synthetic construct
  source 1..25: note = Seed: VKLQTVHSIPLTINKEEALQRPVAS
VKLQTVHSIPFTISKMEANQRPVAS

SEQ ID NO: 55209 - protein, 25 aa, synthetic construct
  source 1..25: note = Seed: VKLQTVHSIPLTINKEEALQRPVAS
VKLQTVHSIPFTISKMEASQRPVAS

SEQ ID NO: 55210 - protein, 25 aa, synthetic construct
  source 1..25: note = Seed: VKLQTVHSIPLTINKEEALQRPVAS
VKLQTVHSIPFTISKMEATQRPVAS

SEQ ID NO: 55211 - protein, 25 aa, synthetic construct
  source 1..25: note = Seed: VKLQTVHSIPLTINKEEALQRPVAS
VKLQTVHSIPFTISKMEAVQRPVAS

SEQ ID NO: 55212 - protein, 25 aa, synthetic construct
  source 1..25: note = Seed: VKLQTVHSIPLTINKEEALQRPVAS
VKLQTVHSIPFTISKMEAYQRPVAS

SEQ ID NO: 55213 - protein, 25 aa, synthetic construct
  source 1..25: note = Seed: VKLQTVHSIPLTINKEEALQRPVAS
VKLQTVHSIPFTISKNEAIQRPVAS

SEQ ID NO: 55214 - protein, 25 aa, synthetic construct
  source 1..25: note = Seed: VKLQTVHSIPLTINKEEALQRPVAS
VKLQTVHSIPFTISKNEALQRPVAS

SEQ ID NO: 55215 - protein, 25 aa, synthetic construct
  source 1..25: note = Seed: VKLQTVHSIPLTINKEEALQRPVAS
VKLQTVHSIPFTISKNEAVQRPVAS

SEQ ID NO: 55216 - protein, 25 aa, synthetic construct
  source 1..25: note = Seed: VKLQTVHSIPLTINKEEALQRPVAS
VKLQTVHSIPFTISKVEAFQRPVAS

SEQ ID NO: 55217 - protein, 25 aa, synthetic construct
  source 1..25: note = Seed: VKLQTVHSIPLTINKEEALQRPVAS
VKLQTVHSIPFTISKVEAIQRPVAS

SEQ ID NO: 55218 - protein, 25 aa, synthetic construct
  source 1..25: note = Seed: VKLQTVHSIPLTINKEEALQRPVAS
VKLQTVHSIPFTISKVEALQRPVAS

SEQ ID NO: 55219 - protein, 25 aa, synthetic construct
  source 1..25: note = Seed: VKLQTVHSIPLTINKEEALQRPVAS
VKLQTVHSIPFTISKVEAVQRPVAS

SEQ ID NO: 55220 - protein, 25 aa, synthetic construct
  source 1..25: note = Seed: VKLQTVHSIPLTINKEEALQRPVAS
VKLQTVHSIPFTISKWEAAQRPVAS

SEQ ID NO: 55221 - protein, 25 aa, synthetic construct
  source 1..25: note = Seed: VKLQTVHSIPLTINKEEALQRPVAS
VKLQTVHSIPFTISKWEACQRPVAS

SEQ ID NO: 55222 - protein, 25 aa, synthetic construct
  source 1..25: note = Seed: VKLQTVHSIPLTINKEEALQRPVAS
VKLQTVHSIPFTISKWEADQRPVAS

SEQ ID NO: 55223 - protein, 25 aa, synthetic construct
  source 1..25: note = Seed: VKLQTVHSIPLTINKEEALQRPVAS
VKLQTVHSIPFTISKWEAEQRPVAS

SEQ ID NO: 55224 - protein, 25 aa, synthetic construct
  source 1..25: note = Seed: VKLQTVHSIPLTINKEEALQRPVAS
VKLQTVHSIPFTISKWEAFQRPVAS

SEQ ID NO: 55225 - protein, 25 aa, synthetic construct
  source 1..25: note = Seed: VKLQTVHSIPLTINKEEALQRPVAS
VKLQTVHSIPFTISKWEAHQRPVAS

SEQ ID NO: 55226 - protein, 25 aa, synthetic construct
  source 1..25: note = Seed: VKLQTVHSIPLTINKEEALQRPVAS
VKLQTVHSIPFTISKWEAIQRPVAS

SEQ ID NO: 55227 - protein, 25 aa, synthetic construct
  source 1..25: note = Seed: VKLQTVHSIPLTINKEEALQRPVAS
VKLQTVHSIPFTISKWEALQRPVAS

SEQ ID NO: 55228 - protein, 25 aa, synthetic construct
  source 1..25: note = Seed: VKLQTVHSIPLTINKEEALQRPVAS
VKLQTVHSIPFTISKWEAMQRPVAS

SEQ ID NO: 55229 - protein, 25 aa, synthetic construct
  source 1..25: note = Seed: VKLQTVHSIPLTINKEEALQRPVAS
VKLQTVHSIPFTISKWEANQRPVAS

SEQ ID NO: 55230 - protein, 25 aa, synthetic construct
  source 1..25: note = Seed: VKLQTVHSIPLTINKEEALQRPVAS
VKLQTVHSIPFTISKWEAPQRPVAS

SEQ ID NO: 55231 - protein, 25 aa, synthetic construct
  source 1..25: note = Seed: VKLQTVHSIPLTINKEEALQRPVAS
VKLQTVHSIPFTISKWEAQQRPVAS

SEQ ID NO: 55232 - protein, 25 aa, synthetic construct
  source 1..25: note = Seed: VKLQTVHSIPLTINKEEALQRPVAS
VKLQTVHSIPFTISKWEASQRPVAS

SEQ ID NO: 55233 - protein, 25 aa, synthetic construct
  source 1..25: note = Seed: VKLQTVHSIPLTINKEEALQRPVAS
VKLQTVHSIPFTISKWEATQRPVAS

SEQ ID NO: 55234 - protein, 25 aa, synthetic construct
  source 1..25: note = Seed: VKLQTVHSIPLTINKEEALQRPVAS
VKLQTVHSIPFTISKWEAVQRPVAS

SEQ ID NO: 55235 - protein, 25 aa, synthetic construct
  source 1..25: note = Seed: VKLQTVHSIPLTINKEEALQRPVAS
VKLQTVHSIPFTISKWEAYQRPVAS

SEQ ID NO: 55236 - protein, 25 aa, synthetic construct
  source 1..25: note = Seed: VKLQTVHSIPLTINKEEALQRPVAS
VKLQTVHSIPFTISKYEAAQRPVAS

SEQ ID NO: 55237 - protein, 25 aa, synthetic construct
  source 1..25: note = Seed: VKLQTVHSIPLTINKEEALQRPVAS
VKLQTVHSIPFTISKYEACQRPVAS

SEQ ID NO: 55238 - protein, 25 aa, synthetic construct
  source 1..25: note = Seed: VKLQTVHSIPLTINKEEALQRPVAS
VKLQTVHSIPFTISKYEADQRPVAS

SEQ ID NO: 55239 - protein, 25 aa, synthetic construct
  source 1..25: note = Seed: VKLQTVHSIPLTINKEEALQRPVAS
VKLQTVHSIPFTISKYEAEQRPVAS

SEQ ID NO: 55240 - protein, 25 aa, synthetic construct
  source 1..25: note = Seed: VKLQTVHSIPLTINKEEALQRPVAS
VKLQTVHSIPFTISKYEAFQRPVAS

SEQ ID NO: 55241 - protein, 25 aa, synthetic construct
  source 1..25: note = Seed: VKLQTVHSIPLTINKEEALQRPVAS
VKLQTVHSIPFTISKYEAHQRPVAS

SEQ ID NO: 55242 - protein, 25 aa, synthetic construct
  source 1..25: note = Seed: VKLQTVHSIPLTINKEEALQRPVAS
VKLQTVHSIPFTISKYEAIQRPVAS

SEQ ID NO: 55243 - protein, 25 aa, synthetic construct
  source 1..25: note = Seed: VKLQTVHSIPLTINKEEALQRPVAS
VKLQTVHSIPFTISKYEALQRPVAS

SEQ ID NO: 55244 - protein, 25 aa, synthetic construct
  source 1..25: note = Seed: VKLQTVHSIPLTINKEEALQRPVAS
VKLQTVHSIPFTISKYEAMQRPVAS

SEQ ID NO: 55245 - protein, 25 aa, synthetic construct
  source 1..25: note = Seed: VKLQTVHSIPLTINKEEALQRPVAS
VKLQTVHSIPFTISKYEANQRPVAS

SEQ ID NO: 55246 - protein, 25 aa, synthetic construct
  source 1..25: note = Seed: VKLQTVHSIPLTINKEEALQRPVAS
VKLQTVHSIPFTISKYEAPQRPVAS

SEQ ID NO: 55247 - protein, 25 aa, synthetic construct
  source 1..25: note = Seed: VKLQTVHSIPLTINKEEALQRPVAS
VKLQTVHSIPFTISKYEAQQRPVAS

SEQ ID NO: 55248 - protein, 25 aa, synthetic construct
  source 1..25: note = Seed: VKLQTVHSIPLTINKEEALQRPVAS
VKLQTVHSIPFTISKYEASQRPVAS

SEQ ID NO: 55249 - protein, 25 aa, synthetic construct
  source 1..25: note = Seed: VKLQTVHSIPLTINKEEALQRPVAS
VKLQTVHSIPFTISKYEATQRPVAS

SEQ ID NO: 55250 - protein, 25 aa, synthetic construct
  source 1..25: note = Seed: VKLQTVHSIPLTINKEEALQRPVAS
VKLQTVHSIPFTISKYEAVQRPVAS

SEQ ID NO: 55251 - protein, 25 aa, synthetic construct
  source 1..25: note = Seed: VKLQTVHSIPLTINKEEALQRPVAS
VKLQTVHSIPFTISKYEAYQRPVAS

SEQ ID NO: 55252 - protein, 25 aa, synthetic construct
  source 1..25: note = Seed: VKLQTVHSIPLTINKEEALQRPVAS
VKLQTVHSIPFTITKAEAFQRPVAS

SEQ ID NO: 55253 - protein, 25 aa, synthetic construct
  source 1..25: note = Seed: VKLQTVHSIPLTINKEEALQRPVAS
VKLQTVHSIPFTITKAEAIQRPVAS

SEQ ID NO: 55254 - protein, 25 aa, synthetic construct
  source 1..25: note = Seed: VKLQTVHSIPLTINKEEALQRPVAS
VKLQTVHSIPFTITKAEALQRPVAS

SEQ ID NO: 55255 - protein, 25 aa, synthetic construct
  source 1..25: note = Seed: VKLQTVHSIPLTINKEEALQRPVAS
VKLQTVHSIPFTITKAEAMQRPVAS

SEQ ID NO: 55256 - protein, 25 aa, synthetic construct
  source 1..25: note = Seed: VKLQTVHSIPLTINKEEALQRPVAS
VKLQTVHSIPFTITKAEAVQRPVAS

SEQ ID NO: 55257 - protein, 25 aa, synthetic construct
  source 1..25: note = Seed: VKLQTVHSIPLTINKEEALQRPVAS
VKLQTVHSIPFTITKFEAAQRPVAS

SEQ ID NO: 55258 - protein, 25 aa, synthetic construct
  source 1..25: note = Seed: VKLQTVHSIPLTINKEEALQRPVAS
VKLQTVHSIPFTITKFEACQRPVAS

SEQ ID NO: 55259 - protein, 25 aa, synthetic construct
  source 1..25: note = Seed: VKLQTVHSIPLTINKEEALQRPVAS
VKLQTVHSIPFTITKFEADQRPVAS

SEQ ID NO: 55260 - protein, 25 aa, synthetic construct
  source 1..25: note = Seed: VKLQTVHSIPLTINKEEALQRPVAS
VKLQTVHSIPFTITKFEAEQRPVAS

SEQ ID NO: 55261 - protein, 25 aa, synthetic construct
  source 1..25: note = Seed: VKLQTVHSIPLTINKEEALQRPVAS
VKLQTVHSIPFTITKFEAFQRPVAS

SEQ ID NO: 55262 - protein, 25 aa, synthetic construct
  source 1..25: note = Seed: VKLQTVHSIPLTINKEEALQRPVAS
VKLQTVHSIPFTITKFEAGQRPVAS

SEQ ID NO: 55263 - protein, 25 aa, synthetic construct
  source 1..25: note = Seed: VKLQTVHSIPLTINKEEALQRPVAS
VKLQTVHSIPFTITKFEAHQRPVAS

SEQ ID NO: 55264 - protein, 25 aa, synthetic construct
  source 1..25: note = Seed: VKLQTVHSIPLTINKEEALQRPVAS
VKLQTVHSIPFTITKFEAIQRPVAS

SEQ ID NO: 55265 - protein, 25 aa, synthetic construct
  source 1..25: note = Seed: VKLQTVHSIPLTINKEEALQRPVAS
VKLQTVHSIPFTITKFEAKQRPVAS

SEQ ID NO: 55266 - protein, 25 aa, synthetic construct
  source 1..25: note = Seed: VKLQTVHSIPLTINKEEALQRPVAS
VKLQTVHSIPFTITKFEALQRPVAS

SEQ ID NO: 55267 - protein, 25 aa, synthetic construct
  source 1..25: note = Seed: VKLQTVHSIPLTINKEEALQRPVAS
VKLQTVHSIPFTITKFEAMQRPVAS

SEQ ID NO: 55268 - protein, 25 aa, synthetic construct
  source 1..25: note = Seed: VKLQTVHSIPLTINKEEALQRPVAS
VKLQTVHSIPFTITKFEANQRPVAS

SEQ ID NO: 55269 - protein, 25 aa, synthetic construct
  source 1..25: note = Seed: VKLQTVHSIPLTINKEEALQRPVAS
VKLQTVHSIPFTITKFEAPQRPVAS

SEQ ID NO: 55270 - protein, 25 aa, synthetic construct
  source 1..25: note = Seed: VKLQTVHSIPLTINKEEALQRPVAS
VKLQTVHSIPFTITKFEAQQRPVAS

SEQ ID NO: 55271 - protein, 25 aa, synthetic construct
  source 1..25: note = Seed: VKLQTVHSIPLTINKEEALQRPVAS
VKLQTVHSIPFTITKFEARQRPVAS

SEQ ID NO: 55272 - protein, 25 aa, synthetic construct
  source 1..25: note = Seed: VKLQTVHSIPLTINKEEALQRPVAS
VKLQTVHSIPFTITKFEASQRPVAS

SEQ ID NO: 55273 - protein, 25 aa, synthetic construct
  source 1..25: note = Seed: VKLQTVHSIPLTINKEEALQRPVAS
VKLQTVHSIPFTITKFEATQRPVAS

SEQ ID NO: 55274 - protein, 25 aa, synthetic construct
  source 1..25: note = Seed: VKLQTVHSIPLTINKEEALQRPVAS
VKLQTVHSIPFTITKFEAVQRPVAS

SEQ ID NO: 55275 - protein, 25 aa, synthetic construct
  source 1..25: note = Seed: VKLQTVHSIPLTINKEEALQRPVAS
VKLQTVHSIPFTITKFEAWQRPVAS

SEQ ID NO: 55276 - protein, 25 aa, synthetic construct
  source 1..25: note = Seed: VKLQTVHSIPLTINKEEALQRPVAS
VKLQTVHSIPFTITKFEAYQRPVAS

SEQ ID NO: 55277 - protein, 25 aa, synthetic construct
  source 1..25: note = Seed: VKLQTVHSIPLTINKEEALQRPVAS
VKLQTVHSIPFTITKIEAAQRPVAS

SEQ ID NO: 55278 - protein, 25 aa, synthetic construct
  source 1..25: note = Seed: VKLQTVHSIPLTINKEEALQRPVAS
VKLQTVHSIPFTITKIEADQRPVAS

SEQ ID NO: 55279 - protein, 25 aa, synthetic construct
  source 1..25: note = Seed: VKLQTVHSIPLTINKEEALQRPVAS
VKLQTVHSIPFTITKIEAEQRPVAS

SEQ ID NO: 55280 - protein, 25 aa, synthetic construct
  source 1..25: note = Seed: VKLQTVHSIPLTINKEEALQRPVAS
VKLQTVHSIPFTITKIEAFQRPVAS

SEQ ID NO: 55281 - protein, 25 aa, synthetic construct
  source 1..25: note = Seed: VKLQTVHSIPLTINKEEALQRPVAS
VKLQTVHSIPFTITKIEAIQRPVAS

SEQ ID NO: 55282 - protein, 25 aa, synthetic construct
  source 1..25: note = Seed: VKLQTVHSIPLTINKEEALQRPVAS
VKLQTVHSIPFTITKIEALQRPVAS

SEQ ID NO: 55283 - protein, 25 aa, synthetic construct
  source 1..25: note = Seed: VKLQTVHSIPLTINKEEALQRPVAS
VKLQTVHSIPFTITKIEAMQRPVAS

SEQ ID NO: 55284 - protein, 25 aa, synthetic construct
  source 1..25: note = Seed: VKLQTVHSIPLTINKEEALQRPVAS
VKLQTVHSIPFTITKIEANQRPVAS

SEQ ID NO: 55285 - protein, 25 aa, synthetic construct
  source 1..25: note = Seed: VKLQTVHSIPLTINKEEALQRPVAS
VKLQTVHSIPFTITKIEASQRPVAS

SEQ ID NO: 55286 - protein, 25 aa, synthetic construct
  source 1..25: note = Seed: VKLQTVHSIPLTINKEEALQRPVAS
VKLQTVHSIPFTITKIEATQRPVAS

SEQ ID NO: 55287 - protein, 25 aa, synthetic construct
  source 1..25: note = Seed: VKLQTVHSIPLTINKEEALQRPVAS
VKLQTVHSIPFTITKIEAVQRPVAS

SEQ ID NO: 55288 - protein, 25 aa, synthetic construct
  source 1..25: note = Seed: VKLQTVHSIPLTINKEEALQRPVAS
VKLQTVHSIPFTITKIEAYQRPVAS

SEQ ID NO: 55289 - protein, 25 aa, synthetic construct
  source 1..25: note = Seed: VKLQTVHSIPLTINKEEALQRPVAS
VKLQTVHSIPFTITKLEAAQRPVAS

SEQ ID NO: 55290 - protein, 25 aa, synthetic construct
  source 1..25: note = Seed: VKLQTVHSIPLTINKEEALQRPVAS
VKLQTVHSIPFTITKLEACQRPVAS

SEQ ID NO: 55291 - protein, 25 aa, synthetic construct
  source 1..25: note = Seed: VKLQTVHSIPLTINKEEALQRPVAS
VKLQTVHSIPFTITKLEADQRPVAS

SEQ ID NO: 55292 - protein, 25 aa, synthetic construct
  source 1..25: note = Seed: VKLQTVHSIPLTINKEEALQRPVAS
VKLQTVHSIPFTITKLEAEQRPVAS

SEQ ID NO: 55293 - protein, 25 aa, synthetic construct
  source 1..25: note = Seed: VKLQTVHSIPLTINKEEALQRPVAS
VKLQTVHSIPFTITKLEAFQRPVAS

SEQ ID NO: 55294 - protein, 25 aa, synthetic construct
  source 1..25: note = Seed: VKLQTVHSIPLTINKEEALQRPVAS
VKLQTVHSIPFTITKLEAGQRPVAS

SEQ ID NO: 55295 - protein, 25 aa, synthetic construct
  source 1..25: note = Seed: VKLQTVHSIPLTINKEEALQRPVAS
VKLQTVHSIPFTITKLEAHQRPVAS

SEQ ID NO: 55296 - protein, 25 aa, synthetic construct
  source 1..25: note = Seed: VKLQTVHSIPLTINKEEALQRPVAS
VKLQTVHSIPFTITKLEAIQRPVAS

SEQ ID NO: 55297 - protein, 25 aa, synthetic construct
  source 1..25: note = Seed: VKLQTVHSIPLTINKEEALQRPVAS
VKLQTVHSIPFTITKLEALQRPVAS

SEQ ID NO: 55298 - protein, 25 aa, synthetic construct
  source 1..25: note = Seed: VKLQTVHSIPLTINKEEALQRPVAS
VKLQTVHSIPFTITKLEAMQRPVAS

SEQ ID NO: 55299 - protein, 25 aa, synthetic construct
  source 1..25: note = Seed: VKLQTVHSIPLTINKEEALQRPVAS
VKLQTVHSIPFTITKLEANQRPVAS

SEQ ID NO: 55300 - protein, 25 aa, synthetic construct
  source 1..25: note = Seed: VKLQTVHSIPLTINKEEALQRPVAS
VKLQTVHSIPFTITKLEAQQRPVAS

SEQ ID NO: 55301 - protein, 25 aa, synthetic construct
  source 1..25: note = Seed: VKLQTVHSIPLTINKEEALQRPVAS
VKLQTVHSIPFTITKLEARQRPVAS

SEQ ID NO: 55302 - protein, 25 aa, synthetic construct
  source 1..25: note = Seed: VKLQTVHSIPLTINKEEALQRPVAS
VKLQTVHSIPFTITKLEASQRPVAS

SEQ ID NO: 55303 - protein, 25 aa, synthetic construct
  source 1..25: note = Seed: VKLQTVHSIPLTINKEEALQRPVAS
VKLQTVHSIPFTITKLEATQRPVAS

SEQ ID NO: 55304 - protein, 25 aa, synthetic construct
  source 1..25: note = Seed: VKLQTVHSIPLTINKEEALQRPVAS
VKLQTVHSIPFTITKLEAVQRPVAS

SEQ ID NO: 55305 - protein, 25 aa, synthetic construct
  source 1..25: note = Seed: VKLQTVHSIPLTINKEEALQRPVAS
VKLQTVHSIPFTITKLEAWQRPVAS

SEQ ID NO: 55306 - protein, 25 aa, synthetic construct
  source 1..25: note = Seed: VKLQTVHSIPLTINKEEALQRPVAS
VKLQTVHSIPFTITKLEAYQRPVAS

SEQ ID NO: 55307 - protein, 25 aa, synthetic construct
  source 1..25: note = Seed: VKLQTVHSIPLTINKEEALQRPVAS
VKLQTVHSIPFTITKMEAAQRPVAS

SEQ ID NO: 55308 - protein, 25 aa, synthetic construct
  source 1..25: note = Seed: VKLQTVHSIPLTINKEEALQRPVAS
VKLQTVHSIPFTITKMEADQRPVAS

SEQ ID NO: 55309 - protein, 25 aa, synthetic construct
  source 1..25: note = Seed: VKLQTVHSIPLTINKEEALQRPVAS
VKLQTVHSIPFTITKMEAEQRPVAS

SEQ ID NO: 55310 - protein, 25 aa, synthetic construct
  source 1..25: note = Seed: VKLQTVHSIPLTINKEEALQRPVAS
VKLQTVHSIPFTITKMEAFQRPVAS

SEQ ID NO: 55311 - protein, 25 aa, synthetic construct
  source 1..25: note = Seed: VKLQTVHSIPLTINKEEALQRPVAS
VKLQTVHSIPFTITKMEAIQRPVAS

SEQ ID NO: 55312 - protein, 25 aa, synthetic construct
  source 1..25: note = Seed: VKLQTVHSIPLTINKEEALQRPVAS
VKLQTVHSIPFTITKMEALQRPVAS

SEQ ID NO: 55313 - protein, 25 aa, synthetic construct
  source 1..25: note = Seed: VKLQTVHSIPLTINKEEALQRPVAS
VKLQTVHSIPFTITKMEAMQRPVAS

SEQ ID NO: 55314 - protein, 25 aa, synthetic construct
  source 1..25: note = Seed: VKLQTVHSIPLTINKEEALQRPVAS
VKLQTVHSIPFTITKMEANQRPVAS

SEQ ID NO: 55315 - protein, 25 aa, synthetic construct
  source 1..25: note = Seed: VKLQTVHSIPLTINKEEALQRPVAS
VKLQTVHSIPFTITKMEASQRPVAS

SEQ ID NO: 55316 - protein, 25 aa, synthetic construct
  source 1..25: note = Seed: VKLQTVHSIPLTINKEEALQRPVAS
VKLQTVHSIPFTITKMEATQRPVAS

SEQ ID NO: 55317 - protein, 25 aa, synthetic construct
  source 1..25: note = Seed: VKLQTVHSIPLTINKEEALQRPVAS
VKLQTVHSIPFTITKMEAVQRPVAS

SEQ ID NO: 55318 - protein, 25 aa, synthetic construct
  source 1..25: note = Seed: VKLQTVHSIPLTINKEEALQRPVAS
VKLQTVHSIPFTITKMEAYQRPVAS

SEQ ID NO: 55319 - protein, 25 aa, synthetic construct
  source 1..25: note = Seed: VKLQTVHSIPLTINKEEALQRPVAS
VKLQTVHSIPFTITKPEAIQRPVAS

SEQ ID NO: 55320 - protein, 25 aa, synthetic construct
  source 1..25: note = Seed: VKLQTVHSIPLTINKEEALQRPVAS
VKLQTVHSIPFTITKPEALQRPVAS

SEQ ID NO: 55321 - protein, 25 aa, synthetic construct
  source 1..25: note = Seed: VKLQTVHSIPLTINKEEALQRPVAS
VKLQTVHSIPFTITKPEAVQRPVAS

SEQ ID NO: 55322 - protein, 25 aa, synthetic construct
  source 1..25: note = Seed: VKLQTVHSIPLTINKEEALQRPVAS
VKLQTVHSIPFTITKSEAIQRPVAS

SEQ ID NO: 55323 - protein, 25 aa, synthetic construct
  source 1..25: note = Seed: VKLQTVHSIPLTINKEEALQRPVAS
VKLQTVHSIPFTITKSEAVQRPVAS

SEQ ID NO: 55324 - protein, 25 aa, synthetic construct
  source 1..25: note = Seed: VKLQTVHSIPLTINKEEALQRPVAS
VKLQTVHSIPFTITKTEAIQRPVAS

SEQ ID NO: 55325 - protein, 25 aa, synthetic construct
  source 1..25: note = Seed: VKLQTVHSIPLTINKEEALQRPVAS
VKLQTVHSIPFTITKTEAVQRPVAS

SEQ ID NO: 55326 - protein, 25 aa, synthetic construct
  source 1..25: note = Seed: VKLQTVHSIPLTINKEEALQRPVAS
VKLQTVHSIPFTITKVEAFQRPVAS

SEQ ID NO: 55327 - protein, 25 aa, synthetic construct
  source 1..25: note = Seed: VKLQTVHSIPLTINKEEALQRPVAS
VKLQTVHSIPFTITKVEAIQRPVAS

SEQ ID NO: 55328 - protein, 25 aa, synthetic construct
  source 1..25: note = Seed: VKLQTVHSIPLTINKEEALQRPVAS
VKLQTVHSIPFTITKVEALQRPVAS

SEQ ID NO: 55329 - protein, 25 aa, synthetic construct
  source 1..25: note = Seed: VKLQTVHSIPLTINKEEALQRPVAS
VKLQTVHSIPFTITKVEAMQRPVAS

SEQ ID NO: 55330 - protein, 25 aa, synthetic construct
  source 1..25: note = Seed: VKLQTVHSIPLTINKEEALQRPVAS
VKLQTVHSIPFTITKVEATQRPVAS

SEQ ID NO: 55331 - protein, 25 aa, synthetic construct
  source 1..25: note = Seed: VKLQTVHSIPLTINKEEALQRPVAS
VKLQTVHSIPFTITKVEAVQRPVAS

SEQ ID NO: 55332 - protein, 25 aa, synthetic construct
  source 1..25: note = Seed: VKLQTVHSIPLTINKEEALQRPVAS
VKLQTVHSIPFTITKWEAAQRPVAS

SEQ ID NO: 55333 - protein, 25 aa, synthetic construct
  source 1..25: note = Seed: VKLQTVHSIPLTINKEEALQRPVAS
VKLQTVHSIPFTITKWEACQRPVAS

SEQ ID NO: 55334 - protein, 25 aa, synthetic construct
  source 1..25: note = Seed: VKLQTVHSIPLTINKEEALQRPVAS
VKLQTVHSIPFTITKWEADQRPVAS

SEQ ID NO: 55335 - protein, 25 aa, synthetic construct
  source 1..25: note = Seed: VKLQTVHSIPLTINKEEALQRPVAS
VKLQTVHSIPFTITKWEAEQRPVAS

SEQ ID NO: 55336 - protein, 25 aa, synthetic construct
  source 1..25: note = Seed: VKLQTVHSIPLTINKEEALQRPVAS
VKLQTVHSIPFTITKWEAFQRPVAS

SEQ ID NO: 55337 - protein, 25 aa, synthetic construct
  source 1..25: note = Seed: VKLQTVHSIPLTINKEEALQRPVAS
VKLQTVHSIPFTITKWEAGQRPVAS

SEQ ID NO: 55338 - protein, 25 aa, synthetic construct
  source 1..25: note = Seed: VKLQTVHSIPLTINKEEALQRPVAS
VKLQTVHSIPFTITKWEAHQRPVAS

SEQ ID NO: 55339 - protein, 25 aa, synthetic construct
  source 1..25: note = Seed: VKLQTVHSIPLTINKEEALQRPVAS
VKLQTVHSIPFTITKWEAIQRPVAS

SEQ ID NO: 55340 - protein, 25 aa, synthetic construct
  source 1..25: note = Seed: VKLQTVHSIPLTINKEEALQRPVAS
VKLQTVHSIPFTITKWEALQRPVAS

SEQ ID NO: 55341 - protein, 25 aa, synthetic construct
  source 1..25: note = Seed: VKLQTVHSIPLTINKEEALQRPVAS
VKLQTVHSIPFTITKWEAMQRPVAS

SEQ ID NO: 55342 - protein, 25 aa, synthetic construct
  source 1..25: note = Seed: VKLQTVHSIPLTINKEEALQRPVAS
VKLQTVHSIPFTITKWEANQRPVAS

SEQ ID NO: 55343 - protein, 25 aa, synthetic construct
  source 1..25: note = Seed: VKLQTVHSIPLTINKEEALQRPVAS
VKLQTVHSIPFTITKWEAPQRPVAS

SEQ ID NO: 55344 - protein, 25 aa, synthetic construct
  source 1..25: note = Seed: VKLQTVHSIPLTINKEEALQRPVAS
VKLQTVHSIPFTITKWEAQQRPVAS

SEQ ID NO: 55345 - protein, 25 aa, synthetic construct
  source 1..25: note = Seed: VKLQTVHSIPLTINKEEALQRPVAS
VKLQTVHSIPFTITKWEASQRPVAS

SEQ ID NO: 55346 - protein, 25 aa, synthetic construct
  source 1..25: note = Seed: VKLQTVHSIPLTINKEEALQRPVAS
VKLQTVHSIPFTITKWEATQRPVAS

SEQ ID NO: 55347 - protein, 25 aa, synthetic construct
  source 1..25: note = Seed: VKLQTVHSIPLTINKEEALQRPVAS
VKLQTVHSIPFTITKWEAVQRPVAS

SEQ ID NO: 55348 - protein, 25 aa, synthetic construct
  source 1..25: note = Seed: VKLQTVHSIPLTINKEEALQRPVAS
VKLQTVHSIPFTITKWEAYQRPVAS

SEQ ID NO: 55349 - protein, 25 aa, synthetic construct
  source 1..25: note = Seed: VKLQTVHSIPLTINKEEALQRPVAS
VKLQTVHSIPFTITKYEAAQRPVAS

SEQ ID NO: 55350 - protein, 25 aa, synthetic construct
  source 1..25: note = Seed: VKLQTVHSIPLTINKEEALQRPVAS
VKLQTVHSIPFTITKYEACQRPVAS

SEQ ID NO: 55351 - protein, 25 aa, synthetic construct
  source 1..25: note = Seed: VKLQTVHSIPLTINKEEALQRPVAS
VKLQTVHSIPFTITKYEADQRPVAS

SEQ ID NO: 55352 - protein, 25 aa, synthetic construct
  source 1..25: note = Seed: VKLQTVHSIPLTINKEEALQRPVAS
VKLQTVHSIPFTITKYEAEQRPVAS

SEQ ID NO: 55353 - protein, 25 aa, synthetic construct
  source 1..25: note = Seed: VKLQTVHSIPLTINKEEALQRPVAS
VKLQTVHSIPFTITKYEAFQRPVAS

SEQ ID NO: 55354 - protein, 25 aa, synthetic construct
  source 1..25: note = Seed: VKLQTVHSIPLTINKEEALQRPVAS
VKLQTVHSIPFTITKYEAGQRPVAS

SEQ ID NO: 55355 - protein, 25 aa, synthetic construct
  source 1..25: note = Seed: VKLQTVHSIPLTINKEEALQRPVAS
VKLQTVHSIPFTITKYEAHQRPVAS

SEQ ID NO: 55356 - protein, 25 aa, synthetic construct
  source 1..25: note = Seed: VKLQTVHSIPLTINKEEALQRPVAS
VKLQTVHSIPFTITKYEAIQRPVAS

SEQ ID NO: 55357 - protein, 25 aa, synthetic construct
  source 1..25: note = Seed: VKLQTVHSIPLTINKEEALQRPVAS
VKLQTVHSIPFTITKYEALQRPVAS

SEQ ID NO: 55358 - protein, 25 aa, synthetic construct
  source 1..25: note = Seed: VKLQTVHSIPLTINKEEALQRPVAS
VKLQTVHSIPFTITKYEAMQRPVAS

SEQ ID NO: 55359 - protein, 25 aa, synthetic construct
  source 1..25: note = Seed: VKLQTVHSIPLTINKEEALQRPVAS
VKLQTVHSIPFTITKYEANQRPVAS

SEQ ID NO: 55360 - protein, 25 aa, synthetic construct
  source 1..25: note = Seed: VKLQTVHSIPLTINKEEALQRPVAS
VKLQTVHSIPFTITKYEAPQRPVAS

SEQ ID NO: 55361 - protein, 25 aa, synthetic construct
  source 1..25: note = Seed: VKLQTVHSIPLTINKEEALQRPVAS
VKLQTVHSIPFTITKYEAQQRPVAS

SEQ ID NO: 55362 - protein, 25 aa, synthetic construct
  source 1..25: note = Seed: VKLQTVHSIPLTINKEEALQRPVAS
VKLQTVHSIPFTITKYEASQRPVAS

SEQ ID NO: 55363 - protein, 25 aa, synthetic construct
  source 1..25: note = Seed: VKLQTVHSIPLTINKEEALQRPVAS
VKLQTVHSIPFTITKYEATQRPVAS

SEQ ID NO: 55364 - protein, 25 aa, synthetic construct
  source 1..25: note = Seed: VKLQTVHSIPLTINKEEALQRPVAS
VKLQTVHSIPFTITKYEAVQRPVAS

SEQ ID NO: 55365 - protein, 25 aa, synthetic construct
  source 1..25: note = Seed: VKLQTVHSIPLTINKEEALQRPVAS
VKLQTVHSIPFTITKYEAWQRPVAS

SEQ ID NO: 55366 - protein, 25 aa, synthetic construct
  source 1..25: note = Seed: VKLQTVHSIPLTINKEEALQRPVAS
VKLQTVHSIPFTITKYEAYQRPVAS

SEQ ID NO: 55367 - protein, 25 aa, synthetic construct
  source 1..25: note = Seed: VKLQTVHSIPLTINKEEALQRPVAS
VKLQTVHSIPFTIVKAEAAQRPVAS

SEQ ID NO: 55368 - protein, 25 aa, synthetic construct
  source 1..25: note = Seed: VKLQTVHSIPLTINKEEALQRPVAS
VKLQTVHSIPFTIVKAEAEQRPVAS

SEQ ID NO: 55369 - protein, 25 aa, synthetic construct
  source 1..25: note = Seed: VKLQTVHSIPLTINKEEALQRPVAS
VKLQTVHSIPFTIVKAEAFQRPVAS

SEQ ID NO: 55370 - protein, 25 aa, synthetic construct
  source 1..25: note = Seed: VKLQTVHSIPLTINKEEALQRPVAS
VKLQTVHSIPFTIVKAEAIQRPVAS

SEQ ID NO: 55371 - protein, 25 aa, synthetic construct
  source 1..25: note = Seed: VKLQTVHSIPLTINKEEALQRPVAS
VKLQTVHSIPFTIVKAEALQRPVAS

SEQ ID NO: 55372 - protein, 25 aa, synthetic construct
  source 1..25: note = Seed: VKLQTVHSIPLTINKEEALQRPVAS
VKLQTVHSIPFTIVKAEAMQRPVAS

SEQ ID NO: 55373 - protein, 25 aa, synthetic construct
  source 1..25: note = Seed: VKLQTVHSIPLTINKEEALQRPVAS
VKLQTVHSIPFTIVKAEAQQRPVAS

SEQ ID NO: 55374 - protein, 25 aa, synthetic construct
  source 1..25: note = Seed: VKLQTVHSIPLTINKEEALQRPVAS
VKLQTVHSIPFTIVKAEARQRPVAS

SEQ ID NO: 55375 - protein, 25 aa, synthetic construct
  source 1..25: note = Seed: VKLQTVHSIPLTINKEEALQRPVAS
VKLQTVHSIPFTIVKAEAVQRPVAS

SEQ ID NO: 55376 - protein, 25 aa, synthetic construct
  source 1..25: note = Seed: VKLQTVHSIPLTINKEEALQRPVAS
VKLQTVHSIPFTIVKAEAYQRPVAS

SEQ ID NO: 55377 - protein, 25 aa, synthetic construct
  source 1..25: note = Seed: VKLQTVHSIPLTINKEEALQRPVAS
VKLQTVHSIPFTIVKFEAAQRPVAS

SEQ ID NO: 55378 - protein, 25 aa, synthetic construct
  source 1..25: note = Seed: VKLQTVHSIPLTINKEEALQRPVAS
VKLQTVHSIPFTIVKFEACQRPVAS

SEQ ID NO: 55379 - protein, 25 aa, synthetic construct
  source 1..25: note = Seed: VKLQTVHSIPLTINKEEALQRPVAS
VKLQTVHSIPFTIVKFEADQRPVAS

SEQ ID NO: 55380 - protein, 25 aa, synthetic construct
  source 1..25: note = Seed: VKLQTVHSIPLTINKEEALQRPVAS
VKLQTVHSIPFTIVKFEAEQRPVAS

SEQ ID NO: 55381 - protein, 25 aa, synthetic construct
  source 1..25: note = Seed: VKLQTVHSIPLTINKEEALQRPVAS
VKLQTVHSIPFTIVKFEAFQRPVAS

SEQ ID NO: 55382 - protein, 25 aa, synthetic construct
  source 1..25: note = Seed: VKLQTVHSIPLTINKEEALQRPVAS
VKLQTVHSIPFTIVKFEAGQRPVAS

SEQ ID NO: 55383 - protein, 25 aa, synthetic construct
  source 1..25: note = Seed: VKLQTVHSIPLTINKEEALQRPVAS
VKLQTVHSIPFTIVKFEAHQRPVAS

SEQ ID NO: 55384 - protein, 25 aa, synthetic construct
  source 1..25: note = Seed: VKLQTVHSIPLTINKEEALQRPVAS
VKLQTVHSIPFTIVKFEAIQRPVAS

SEQ ID NO: 55385 - protein, 25 aa, synthetic construct
  source 1..25: note = Seed: VKLQTVHSIPLTINKEEALQRPVAS
VKLQTVHSIPFTIVKFEAKQRPVAS

SEQ ID NO: 55386 - protein, 25 aa, synthetic construct
  source 1..25: note = Seed: VKLQTVHSIPLTINKEEALQRPVAS
VKLQTVHSIPFTIVKFEALQRPVAS

SEQ ID NO: 55387 - protein, 25 aa, synthetic construct
  source 1..25: note = Seed: VKLQTVHSIPLTINKEEALQRPVAS
VKLQTVHSIPFTIVKFEAMQRPVAS

SEQ ID NO: 55388 - protein, 25 aa, synthetic construct
  source 1..25: note = Seed: VKLQTVHSIPLTINKEEALQRPVAS
VKLQTVHSIPFTIVKFEANQRPVAS

SEQ ID NO: 55389 - protein, 25 aa, synthetic construct
  source 1..25: note = Seed: VKLQTVHSIPLTINKEEALQRPVAS
VKLQTVHSIPFTIVKFEAPQRPVAS

SEQ ID NO: 55390 - protein, 25 aa, synthetic construct
  source 1..25: note = Seed: VKLQTVHSIPLTINKEEALQRPVAS
VKLQTVHSIPFTIVKFEAQQRPVAS

SEQ ID NO: 55391 - protein, 25 aa, synthetic construct
  source 1..25: note = Seed: VKLQTVHSIPLTINKEEALQRPVAS
VKLQTVHSIPFTIVKFEARQRPVAS

SEQ ID NO: 55392 - protein, 25 aa, synthetic construct
  source 1..25: note = Seed: VKLQTVHSIPLTINKEEALQRPVAS
VKLQTVHSIPFTIVKFEASQRPVAS

SEQ ID NO: 55393 - protein, 25 aa, synthetic construct
  source 1..25: note = Seed: VKLQTVHSIPLTINKEEALQRPVAS
VKLQTVHSIPFTIVKFEATQRPVAS

SEQ ID NO: 55394 - protein, 25 aa, synthetic construct
  source 1..25: note = Seed: VKLQTVHSIPLTINKEEALQRPVAS
VKLQTVHSIPFTIVKFEAVQRPVAS

SEQ ID NO: 55395 - protein, 25 aa, synthetic construct
  source 1..25: note = Seed: VKLQTVHSIPLTINKEEALQRPVAS
VKLQTVHSIPFTIVKFEAWQRPVAS

SEQ ID NO: 55396 - protein, 25 aa, synthetic construct
  source 1..25: note = Seed: VKLQTVHSIPLTINKEEALQRPVAS
VKLQTVHSIPFTIVKFEAYQRPVAS

SEQ ID NO: 55397 - protein, 25 aa, synthetic construct
  source 1..25: note = Seed: VKLQTVHSIPLTINKEEALQRPVAS
VKLQTVHSIPFTIVKHEAVQRPVAS

SEQ ID NO: 55398 - protein, 25 aa, synthetic construct
  source 1..25: note = Seed: VKLQTVHSIPLTINKEEALQRPVAS
VKLQTVHSIPFTIVKIEAAQRPVAS

SEQ ID NO: 55399 - protein, 25 aa, synthetic construct
  source 1..25: note = Seed: VKLQTVHSIPLTINKEEALQRPVAS
VKLQTVHSIPFTIVKIEADQRPVAS

SEQ ID NO: 55400 - protein, 25 aa, synthetic construct
  source 1..25: note = Seed: VKLQTVHSIPLTINKEEALQRPVAS
VKLQTVHSIPFTIVKIEAEQRPVAS

SEQ ID NO: 55401 - protein, 25 aa, synthetic construct
  source 1..25: note = Seed: VKLQTVHSIPLTINKEEALQRPVAS
VKLQTVHSIPFTIVKIEAFQRPVAS

SEQ ID NO: 55402 - protein, 25 aa, synthetic construct
  source 1..25: note = Seed: VKLQTVHSIPLTINKEEALQRPVAS
VKLQTVHSIPFTIVKIEAGQRPVAS

SEQ ID NO: 55403 - protein, 25 aa, synthetic construct
  source 1..25: note = Seed: VKLQTVHSIPLTINKEEALQRPVAS
VKLQTVHSIPFTIVKIEAHQRPVAS

SEQ ID NO: 55404 - protein, 25 aa, synthetic construct
  source 1..25: note = Seed: VKLQTVHSIPLTINKEEALQRPVAS
VKLQTVHSIPFTIVKIEAIQRPVAS

SEQ ID NO: 55405 - protein, 25 aa, synthetic construct
  source 1..25: note = Seed: VKLQTVHSIPLTINKEEALQRPVAS
VKLQTVHSIPFTIVKIEALQRPVAS

SEQ ID NO: 55406 - protein, 25 aa, synthetic construct
  source 1..25: note = Seed: VKLQTVHSIPLTINKEEALQRPVAS
VKLQTVHSIPFTIVKIEAMQRPVAS

SEQ ID NO: 55407 - protein, 25 aa, synthetic construct
  source 1..25: note = Seed: VKLQTVHSIPLTINKEEALQRPVAS
VKLQTVHSIPFTIVKIEANQRPVAS

SEQ ID NO: 55408 - protein, 25 aa, synthetic construct
  source 1..25: note = Seed: VKLQTVHSIPLTINKEEALQRPVAS
VKLQTVHSIPFTIVKIEAQQRPVAS

SEQ ID NO: 55409 - protein, 25 aa, synthetic construct
  source 1..25: note = Seed: VKLQTVHSIPLTINKEEALQRPVAS
VKLQTVHSIPFTIVKIEARQRPVAS

SEQ ID NO: 55410 - protein, 25 aa, synthetic construct
  source 1..25: note = Seed: VKLQTVHSIPLTINKEEALQRPVAS
VKLQTVHSIPFTIVKIEASQRPVAS

SEQ ID NO: 55411 - protein, 25 aa, synthetic construct
  source 1..25: note = Seed: VKLQTVHSIPLTINKEEALQRPVAS
VKLQTVHSIPFTIVKIEATQRPVAS

SEQ ID NO: 55412 - protein, 25 aa, synthetic construct
  source 1..25: note = Seed: VKLQTVHSIPLTINKEEALQRPVAS
VKLQTVHSIPFTIVKIEAVQRPVAS

SEQ ID NO: 55413 - protein, 25 aa, synthetic construct
  source 1..25: note = Seed: VKLQTVHSIPLTINKEEALQRPVAS
VKLQTVHSIPFTIVKIEAYQRPVAS

SEQ ID NO: 55414 - protein, 25 aa, synthetic construct
  source 1..25: note = Seed: VKLQTVHSIPLTINKEEALQRPVAS
VKLQTVHSIPFTIVKKEALQRPVAS

SEQ ID NO: 55415 - protein, 25 aa, synthetic construct
  source 1..25: note = Seed: VKLQTVHSIPLTINKEEALQRPVAS
VKLQTVHSIPFTIVKLEAAQRPVAS

SEQ ID NO: 55416 - protein, 25 aa, synthetic construct
  source 1..25: note = Seed: VKLQTVHSIPLTINKEEALQRPVAS
VKLQTVHSIPFTIVKLEADQRPVAS

SEQ ID NO: 55417 - protein, 25 aa, synthetic construct
  source 1..25: note = Seed: VKLQTVHSIPLTINKEEALQRPVAS
VKLQTVHSIPFTIVKLEAEQRPVAS

SEQ ID NO: 55418 - protein, 25 aa, synthetic construct
  source 1..25: note = Seed: VKLQTVHSIPLTINKEEALQRPVAS
VKLQTVHSIPFTIVKLEAFQRPVAS

SEQ ID NO: 55419 - protein, 25 aa, synthetic construct
  source 1..25: note = Seed: VKLQTVHSIPLTINKEEALQRPVAS
VKLQTVHSIPFTIVKLEAGQRPVAS

SEQ ID NO: 55420 - protein, 25 aa, synthetic construct
  source 1..25: note = Seed: VKLQTVHSIPLTINKEEALQRPVAS
VKLQTVHSIPFTIVKLEAHQRPVAS

SEQ ID NO: 55421 - protein, 25 aa, synthetic construct
  source 1..25: note = Seed: VKLQTVHSIPLTINKEEALQRPVAS
VKLQTVHSIPFTIVKLEAIQRPVAS

SEQ ID NO: 55422 - protein, 25 aa, synthetic construct
  source 1..25: note = Seed: VKLQTVHSIPLTINKEEALQRPVAS
VKLQTVHSIPFTIVKLEAKQRPVAS

SEQ ID NO: 55423 - protein, 25 aa, synthetic construct
  source 1..25: note = Seed: VKLQTVHSIPLTINKEEALQRPVAS
VKLQTVHSIPFTIVKLEALQRPVAS

SEQ ID NO: 55424 - protein, 25 aa, synthetic construct
  source 1..25: note = Seed: VKLQTVHSIPLTINKEEALQRPVAS
VKLQTVHSIPFTIVKLEAMQRPVAS

SEQ ID NO: 55425 - protein, 25 aa, synthetic construct
  source 1..25: note = Seed: VKLQTVHSIPLTINKEEALQRPVAS
VKLQTVHSIPFTIVKLEANQRPVAS

SEQ ID NO: 55426 - protein, 25 aa, synthetic construct
  source 1..25: note = Seed: VKLQTVHSIPLTINKEEALQRPVAS
VKLQTVHSIPFTIVKLEAQQRPVAS

SEQ ID NO: 55427 - protein, 25 aa, synthetic construct
  source 1..25: note = Seed: VKLQTVHSIPLTINKEEALQRPVAS
VKLQTVHSIPFTIVKLEARQRPVAS

SEQ ID NO: 55428 - protein, 25 aa, synthetic construct
  source 1..25: note = Seed: VKLQTVHSIPLTINKEEALQRPVAS
VKLQTVHSIPFTIVKLEASQRPVAS

SEQ ID NO: 55429 - protein, 25 aa, synthetic construct
  source 1..25: note = Seed: VKLQTVHSIPLTINKEEALQRPVAS
VKLQTVHSIPFTIVKLEATQRPVAS

SEQ ID NO: 55430 - protein, 25 aa, synthetic construct
  source 1..25: note = Seed: VKLQTVHSIPLTINKEEALQRPVAS
VKLQTVHSIPFTIVKLEAVQRPVAS

SEQ ID NO: 55431 - protein, 25 aa, synthetic construct
  source 1..25: note = Seed: VKLQTVHSIPLTINKEEALQRPVAS
VKLQTVHSIPFTIVKLEAYQRPVAS

SEQ ID NO: 55432 - protein, 25 aa, synthetic construct
  source 1..25: note = Seed: VKLQTVHSIPLTINKEEALQRPVAS
VKLQTVHSIPFTIVKMEAAQRPVAS

SEQ ID NO: 55433 - protein, 25 aa, synthetic construct
  source 1..25: note = Seed: VKLQTVHSIPLTINKEEALQRPVAS
VKLQTVHSIPFTIVKMEADQRPVAS

SEQ ID NO: 55434 - protein, 25 aa, synthetic construct
  source 1..25: note = Seed: VKLQTVHSIPLTINKEEALQRPVAS
VKLQTVHSIPFTIVKMEAEQRPVAS

SEQ ID NO: 55435 - protein, 25 aa, synthetic construct
  source 1..25: note = Seed: VKLQTVHSIPLTINKEEALQRPVAS
VKLQTVHSIPFTIVKMEAFQRPVAS

SEQ ID NO: 55436 - protein, 25 aa, synthetic construct
  source 1..25: note = Seed: VKLQTVHSIPLTINKEEALQRPVAS
VKLQTVHSIPFTIVKMEAHQRPVAS

SEQ ID NO: 55437 - protein, 25 aa, synthetic construct
  source 1..25: note = Seed: VKLQTVHSIPLTINKEEALQRPVAS
VKLQTVHSIPFTIVKMEAIQRPVAS

SEQ ID NO: 55438 - protein, 25 aa, synthetic construct
  source 1..25: note = Seed: VKLQTVHSIPLTINKEEALQRPVAS
VKLQTVHSIPFTIVKMEALQRPVAS

SEQ ID NO: 55439 - protein, 25 aa, synthetic construct
  source 1..25: note = Seed: VKLQTVHSIPLTINKEEALQRPVAS
VKLQTVHSIPFTIVKMEAMQRPVAS

SEQ ID NO: 55440 - protein, 25 aa, synthetic construct
  source 1..25: note = Seed: VKLQTVHSIPLTINKEEALQRPVAS
VKLQTVHSIPFTIVKMEANQRPVAS

SEQ ID NO: 55441 - protein, 25 aa, synthetic construct
  source 1..25: note = Seed: VKLQTVHSIPLTINKEEALQRPVAS
VKLQTVHSIPFTIVKMEAQQRPVAS

SEQ ID NO: 55442 - protein, 25 aa, synthetic construct
  source 1..25: note = Seed: VKLQTVHSIPLTINKEEALQRPVAS
VKLQTVHSIPFTIVKMEARQRPVAS

SEQ ID NO: 55443 - protein, 25 aa, synthetic construct
  source 1..25: note = Seed: VKLQTVHSIPLTINKEEALQRPVAS
VKLQTVHSIPFTIVKMEASQRPVAS

SEQ ID NO: 55444 - protein, 25 aa, synthetic construct
  source 1..25: note = Seed: VKLQTVHSIPLTINKEEALQRPVAS
VKLQTVHSIPFTIVKMEATQRPVAS

SEQ ID NO: 55445 - protein, 25 aa, synthetic construct
  source 1..25: note = Seed: VKLQTVHSIPLTINKEEALQRPVAS
VKLQTVHSIPFTIVKMEAVQRPVAS

SEQ ID NO: 55446 - protein, 25 aa, synthetic construct
  source 1..25: note = Seed: VKLQTVHSIPLTINKEEALQRPVAS
VKLQTVHSIPFTIVKMEAYQRPVAS

SEQ ID NO: 55447 - protein, 25 aa, synthetic construct
  source 1..25: note = Seed: VKLQTVHSIPLTINKEEALQRPVAS
VKLQTVHSIPFTIVKNEAAQRPVAS

SEQ ID NO: 55448 - protein, 25 aa, synthetic construct
  source 1..25: note = Seed: VKLQTVHSIPLTINKEEALQRPVAS
VKLQTVHSIPFTIVKNEADQRPVAS

SEQ ID NO: 55449 - protein, 25 aa, synthetic construct
  source 1..25: note = Seed: VKLQTVHSIPLTINKEEALQRPVAS
VKLQTVHSIPFTIVKNEAEQRPVAS

SEQ ID NO: 55450 - protein, 25 aa, synthetic construct
  source 1..25: note = Seed: VKLQTVHSIPLTINKEEALQRPVAS
VKLQTVHSIPFTIVKNEASQRPVAS

SEQ ID NO: 55451 - protein, 25 aa, synthetic construct
  source 1..25: note = Seed: VKLQTVHSIPLTINKEEALQRPVAS
VKLQTVHSIPFTIVKNEAVQRPVAS

SEQ ID NO: 55452 - protein, 25 aa, synthetic construct
  source 1..25: note = Seed: VKLQTVHSIPLTINKEEALQRPVAS
VKLQTVHSIPFTIVKPEAIQRPVAS

SEQ ID NO: 55453 - protein, 25 aa, synthetic construct
  source 1..25: note = Seed: VKLQTVHSIPLTINKEEALQRPVAS
VKLQTVHSIPFTIVKPEALQRPVAS

SEQ ID NO: 55454 - protein, 25 aa, synthetic construct
  source 1..25: note = Seed: VKLQTVHSIPLTINKEEALQRPVAS
VKLQTVHSIPFTIVKPEAVQRPVAS

SEQ ID NO: 55455 - protein, 25 aa, synthetic construct
  source 1..25: note = Seed: VKLQTVHSIPLTINKEEALQRPVAS
VKLQTVHSIPFTIVKREAFQRPVAS

SEQ ID NO: 55456 - protein, 25 aa, synthetic construct
  source 1..25: note = Seed: VKLQTVHSIPLTINKEEALQRPVAS
VKLQTVHSIPFTIVKREAIQRPVAS

SEQ ID NO: 55457 - protein, 25 aa, synthetic construct
  source 1..25: note = Seed: VKLQTVHSIPLTINKEEALQRPVAS
VKLQTVHSIPFTIVKREALQRPVAS

SEQ ID NO: 55458 - protein, 25 aa, synthetic construct
  source 1..25: note = Seed: VKLQTVHSIPLTINKEEALQRPVAS
VKLQTVHSIPFTIVKREARQRPVAS

SEQ ID NO: 55459 - protein, 25 aa, synthetic construct
  source 1..25: note = Seed: VKLQTVHSIPLTINKEEALQRPVAS
VKLQTVHSIPFTIVKREAYQRPVAS

SEQ ID NO: 55460 - protein, 25 aa, synthetic construct
  source 1..25: note = Seed: VKLQTVHSIPLTINKEEALQRPVAS
VKLQTVHSIPFTIVKSEAAQRPVAS

SEQ ID NO: 55461 - protein, 25 aa, synthetic construct
  source 1..25: note = Seed: VKLQTVHSIPLTINKEEALQRPVAS
VKLQTVHSIPFTIVKSEADQRPVAS

SEQ ID NO: 55462 - protein, 25 aa, synthetic construct
  source 1..25: note = Seed: VKLQTVHSIPLTINKEEALQRPVAS
VKLQTVHSIPFTIVKSEAEQRPVAS

SEQ ID NO: 55463 - protein, 25 aa, synthetic construct
  source 1..25: note = Seed: VKLQTVHSIPLTINKEEALQRPVAS
VKLQTVHSIPFTIVKSEALQRPVAS

SEQ ID NO: 55464 - protein, 25 aa, synthetic construct
  source 1..25: note = Seed: VKLQTVHSIPLTINKEEALQRPVAS
VKLQTVHSIPFTIVKSEASQRPVAS

SEQ ID NO: 55465 - protein, 25 aa, synthetic construct
  source 1..25: note = Seed: VKLQTVHSIPLTINKEEALQRPVAS
VKLQTVHSIPFTIVKSEAVQRPVAS

SEQ ID NO: 55466 - protein, 25 aa, synthetic construct
  source 1..25: note = Seed: VKLQTVHSIPLTINKEEALQRPVAS
VKLQTVHSIPFTIVKTEAAQRPVAS

SEQ ID NO: 55467 - protein, 25 aa, synthetic construct
  source 1..25: note = Seed: VKLQTVHSIPLTINKEEALQRPVAS
VKLQTVHSIPFTIVKTEADQRPVAS

SEQ ID NO: 55468 - protein, 25 aa, synthetic construct
  source 1..25: note = Seed: VKLQTVHSIPLTINKEEALQRPVAS
VKLQTVHSIPFTIVKTEAEQRPVAS

SEQ ID NO: 55469 - protein, 25 aa, synthetic construct
  source 1..25: note = Seed: VKLQTVHSIPLTINKEEALQRPVAS
VKLQTVHSIPFTIVKTEALQRPVAS

SEQ ID NO: 55470 - protein, 25 aa, synthetic construct
  source 1..25: note = Seed: VKLQTVHSIPLTINKEEALQRPVAS
VKLQTVHSIPFTIVKTEASQRPVAS

SEQ ID NO: 55471 - protein, 25 aa, synthetic construct
  source 1..25: note = Seed: VKLQTVHSIPLTINKEEALQRPVAS
VKLQTVHSIPFTIVKTEAVQRPVAS

SEQ ID NO: 55472 - protein, 25 aa, synthetic construct
  source 1..25: note = Seed: VKLQTVHSIPLTINKEEALQRPVAS
VKLQTVHSIPFTIVKTEAYQRPVAS

SEQ ID NO: 55473 - protein, 25 aa, synthetic construct
  source 1..25: note = Seed: VKLQTVHSIPLTINKEEALQRPVAS
VKLQTVHSIPFTIVKVEAAQRPVAS

SEQ ID NO: 55474 - protein, 25 aa, synthetic construct
  source 1..25: note = Seed: VKLQTVHSIPLTINKEEALQRPVAS
VKLQTVHSIPFTIVKVEADQRPVAS

SEQ ID NO: 55475 - protein, 25 aa, synthetic construct
  source 1..25: note = Seed: VKLQTVHSIPLTINKEEALQRPVAS
VKLQTVHSIPFTIVKVEAEQRPVAS

SEQ ID NO: 55476 - protein, 25 aa, synthetic construct
  source 1..25: note = Seed: VKLQTVHSIPLTINKEEALQRPVAS
VKLQTVHSIPFTIVKVEAFQRPVAS

SEQ ID NO: 55477 - protein, 25 aa, synthetic construct
  source 1..25: note = Seed: VKLQTVHSIPLTINKEEALQRPVAS
VKLQTVHSIPFTIVKVEAHQRPVAS

SEQ ID NO: 55478 - protein, 25 aa, synthetic construct
  source 1..25: note = Seed: VKLQTVHSIPLTINKEEALQRPVAS
VKLQTVHSIPFTIVKVEAIQRPVAS

SEQ ID NO: 55479 - protein, 25 aa, synthetic construct
  source 1..25: note = Seed: VKLQTVHSIPLTINKEEALQRPVAS
VKLQTVHSIPFTIVKVEALQRPVAS

SEQ ID NO: 55480 - protein, 25 aa, synthetic construct
  source 1..25: note = Seed: VKLQTVHSIPLTINKEEALQRPVAS
VKLQTVHSIPFTIVKVEAMQRPVAS

SEQ ID NO: 55481 - protein, 25 aa, synthetic construct
  source 1..25: note = Seed: VKLQTVHSIPLTINKEEALQRPVAS
VKLQTVHSIPFTIVKVEANQRPVAS

SEQ ID NO: 55482 - protein, 25 aa, synthetic construct
  source 1..25: note = Seed: VKLQTVHSIPLTINKEEALQRPVAS
VKLQTVHSIPFTIVKVEAQQRPVAS

SEQ ID NO: 55483 - protein, 25 aa, synthetic construct
  source 1..25: note = Seed: VKLQTVHSIPLTINKEEALQRPVAS
VKLQTVHSIPFTIVKVEARQRPVAS

SEQ ID NO: 55484 - protein, 25 aa, synthetic construct
  source 1..25: note = Seed: VKLQTVHSIPLTINKEEALQRPVAS
VKLQTVHSIPFTIVKVEASQRPVAS

SEQ ID NO: 55485 - protein, 25 aa, synthetic construct
  source 1..25: note = Seed: VKLQTVHSIPLTINKEEALQRPVAS
VKLQTVHSIPFTIVKVEATQRPVAS

SEQ ID NO: 55486 - protein, 25 aa, synthetic construct
  source 1..25: note = Seed: VKLQTVHSIPLTINKEEALQRPVAS
VKLQTVHSIPFTIVKVEAVQRPVAS

SEQ ID NO: 55487 - protein, 25 aa, synthetic construct
  source 1..25: note = Seed: VKLQTVHSIPLTINKEEALQRPVAS
VKLQTVHSIPFTIVKVEAYQRPVAS

SEQ ID NO: 55488 - protein, 25 aa, synthetic construct
  source 1..25: note = Seed: VKLQTVHSIPLTINKEEALQRPVAS
VKLQTVHSIPFTIVKWEAAQRPVAS

SEQ ID NO: 55489 - protein, 25 aa, synthetic construct
  source 1..25: note = Seed: VKLQTVHSIPLTINKEEALQRPVAS
VKLQTVHSIPFTIVKWEACQRPVAS

SEQ ID NO: 55490 - protein, 25 aa, synthetic construct
  source 1..25: note = Seed: VKLQTVHSIPLTINKEEALQRPVAS
VKLQTVHSIPFTIVKWEADQRPVAS

SEQ ID NO: 55491 - protein, 25 aa, synthetic construct
  source 1..25: note = Seed: VKLQTVHSIPLTINKEEALQRPVAS
VKLQTVHSIPFTIVKWEAEQRPVAS

SEQ ID NO: 55492 - protein, 25 aa, synthetic construct
  source 1..25: note = Seed: VKLQTVHSIPLTINKEEALQRPVAS
VKLQTVHSIPFTIVKWEAFQRPVAS

SEQ ID NO: 55493 - protein, 25 aa, synthetic construct
  source 1..25: note = Seed: VKLQTVHSIPLTINKEEALQRPVAS
VKLQTVHSIPFTIVKWEAGQRPVAS

SEQ ID NO: 55494 - protein, 25 aa, synthetic construct
  source 1..25: note = Seed: VKLQTVHSIPLTINKEEALQRPVAS
VKLQTVHSIPFTIVKWEAHQRPVAS

SEQ ID NO: 55495 - protein, 25 aa, synthetic construct
  source 1..25: note = Seed: VKLQTVHSIPLTINKEEALQRPVAS
VKLQTVHSIPFTIVKWEAIQRPVAS

SEQ ID NO: 55496 - protein, 25 aa, synthetic construct
  source 1..25: note = Seed: VKLQTVHSIPLTINKEEALQRPVAS
VKLQTVHSIPFTIVKWEALQRPVAS

SEQ ID NO: 55497 - protein, 25 aa, synthetic construct
  source 1..25: note = Seed: VKLQTVHSIPLTINKEEALQRPVAS
VKLQTVHSIPFTIVKWEAMQRPVAS

SEQ ID NO: 55498 - protein, 25 aa, synthetic construct
  source 1..25: note = Seed: VKLQTVHSIPLTINKEEALQRPVAS
VKLQTVHSIPFTIVKWEANQRPVAS

SEQ ID NO: 55499 - protein, 25 aa, synthetic construct
  source 1..25: note = Seed: VKLQTVHSIPLTINKEEALQRPVAS
VKLQTVHSIPFTIVKWEAQQRPVAS

SEQ ID NO: 55500 - protein, 25 aa, synthetic construct
  source 1..25: note = Seed: VKLQTVHSIPLTINKEEALQRPVAS
VKLQTVHSIPFTIVKWEASQRPVAS

SEQ ID NO: 55501 - protein, 25 aa, synthetic construct
  source 1..25: note = Seed: VKLQTVHSIPLTINKEEALQRPVAS
VKLQTVHSIPFTIVKWEATQRPVAS

SEQ ID NO: 55502 - protein, 25 aa, synthetic construct
  source 1..25: note = Seed: VKLQTVHSIPLTINKEEALQRPVAS
VKLQTVHSIPFTIVKWEAVQRPVAS

SEQ ID NO: 55503 - protein, 25 aa, synthetic construct
  source 1..25: note = Seed: VKLQTVHSIPLTINKEEALQRPVAS
VKLQTVHSIPFTIVKWEAYQRPVAS

SEQ ID NO: 55504 - protein, 25 aa, synthetic construct
  source 1..25: note = Seed: VKLQTVHSIPLTINKEEALQRPVAS
VKLQTVHSIPFTIVKYEAAQRPVAS

SEQ ID NO: 55505 - protein, 25 aa, synthetic construct
  source 1..25: note = Seed: VKLQTVHSIPLTINKEEALQRPVAS
VKLQTVHSIPFTIVKYEACQRPVAS

SEQ ID NO: 55506 - protein, 25 aa, synthetic construct
  source 1..25: note = Seed: VKLQTVHSIPLTINKEEALQRPVAS
VKLQTVHSIPFTIVKYEADQRPVAS

SEQ ID NO: 55507 - protein, 25 aa, synthetic construct
  source 1..25: note = Seed: VKLQTVHSIPLTINKEEALQRPVAS
VKLQTVHSIPFTIVKYEAEQRPVAS

SEQ ID NO: 55508 - protein, 25 aa, synthetic construct
  source 1..25: note = Seed: VKLQTVHSIPLTINKEEALQRPVAS
VKLQTVHSIPFTIVKYEAFQRPVAS

SEQ ID NO: 55509 - protein, 25 aa, synthetic construct
  source 1..25: note = Seed: VKLQTVHSIPLTINKEEALQRPVAS
VKLQTVHSIPFTIVKYEAGQRPVAS

SEQ ID NO: 55510 - protein, 25 aa, synthetic construct
  source 1..25: note = Seed: VKLQTVHSIPLTINKEEALQRPVAS
VKLQTVHSIPFTIVKYEAHQRPVAS

SEQ ID NO: 55511 - protein, 25 aa, synthetic construct
  source 1..25: note = Seed: VKLQTVHSIPLTINKEEALQRPVAS
VKLQTVHSIPFTIVKYEAIQRPVAS

SEQ ID NO: 55512 - protein, 25 aa, synthetic construct
  source 1..25: note = Seed: VKLQTVHSIPLTINKEEALQRPVAS
VKLQTVHSIPFTIVKYEALQRPVAS

SEQ ID NO: 55513 - protein, 25 aa, synthetic construct
  source 1..25: note = Seed: VKLQTVHSIPLTINKEEALQRPVAS
VKLQTVHSIPFTIVKYEAMQRPVAS

SEQ ID NO: 55514 - protein, 25 aa, synthetic construct
  source 1..25: note = Seed: VKLQTVHSIPLTINKEEALQRPVAS
VKLQTVHSIPFTIVKYEANQRPVAS

SEQ ID NO: 55515 - protein, 25 aa, synthetic construct
  source 1..25: note = Seed: VKLQTVHSIPLTINKEEALQRPVAS
VKLQTVHSIPFTIVKYEAPQRPVAS

SEQ ID NO: 55516 - protein, 25 aa, synthetic construct
  source 1..25: note = Seed: VKLQTVHSIPLTINKEEALQRPVAS
VKLQTVHSIPFTIVKYEAQQRPVAS

SEQ ID NO: 55517 - protein, 25 aa, synthetic construct
  source 1..25: note = Seed: VKLQTVHSIPLTINKEEALQRPVAS
VKLQTVHSIPFTIVKYEARQRPVAS

SEQ ID NO: 55518 - protein, 25 aa, synthetic construct
  source 1..25: note = Seed: VKLQTVHSIPLTINKEEALQRPVAS
VKLQTVHSIPFTIVKYEASQRPVAS

SEQ ID NO: 55519 - protein, 25 aa, synthetic construct
  source 1..25: note = Seed: VKLQTVHSIPLTINKEEALQRPVAS
VKLQTVHSIPFTIVKYEATQRPVAS

SEQ ID NO: 55520 - protein, 25 aa, synthetic construct
  source 1..25: note = Seed: VKLQTVHSIPLTINKEEALQRPVAS
VKLQTVHSIPFTIVKYEAVQRPVAS

SEQ ID NO: 55521 - protein, 25 aa, synthetic construct
  source 1..25: note = Seed: VKLQTVHSIPLTINKEEALQRPVAS
VKLQTVHSIPFTIVKYEAYQRPVAS

SEQ ID NO: 55522 - protein, 25 aa, synthetic construct
  source 1..25: note = Seed: VKLQTVHSIPLTINKEEALQRPVAS
VKLQTVHSIPFTIWKAEAAQRPVAS

SEQ ID NO: 55523 - protein, 25 aa, synthetic construct
  source 1..25: note = Seed: VKLQTVHSIPLTINKEEALQRPVAS
VKLQTVHSIPFTIWKAEAFQRPVAS

SEQ ID NO: 55524 - protein, 25 aa, synthetic construct
  source 1..25: note = Seed: VKLQTVHSIPLTINKEEALQRPVAS
VKLQTVHSIPFTIWKAEAIQRPVAS

SEQ ID NO: 55525 - protein, 25 aa, synthetic construct
  source 1..25: note = Seed: VKLQTVHSIPLTINKEEALQRPVAS
VKLQTVHSIPFTIWKAEALQRPVAS

SEQ ID NO: 55526 - protein, 25 aa, synthetic construct
  source 1..25: note = Seed: VKLQTVHSIPLTINKEEALQRPVAS
VKLQTVHSIPFTIWKAEAMQRPVAS

SEQ ID NO: 55527 - protein, 25 aa, synthetic construct
  source 1..25: note = Seed: VKLQTVHSIPLTINKEEALQRPVAS
VKLQTVHSIPFTIWKAEAVQRPVAS

SEQ ID NO: 55528 - protein, 25 aa, synthetic construct
  source 1..25: note = Seed: VKLQTVHSIPLTINKEEALQRPVAS
VKLQTVHSIPFTIWKDEAAQRPVAS

SEQ ID NO: 55529 - protein, 25 aa, synthetic construct
  source 1..25: note = Seed: VKLQTVHSIPLTINKEEALQRPVAS
VKLQTVHSIPFTIWKDEAFQRPVAS

SEQ ID NO: 55530 - protein, 25 aa, synthetic construct
  source 1..25: note = Seed: VKLQTVHSIPLTINKEEALQRPVAS
VKLQTVHSIPFTIWKDEAIQRPVAS

SEQ ID NO: 55531 - protein, 25 aa, synthetic construct
  source 1..25: note = Seed: VKLQTVHSIPLTINKEEALQRPVAS
VKLQTVHSIPFTIWKDEALQRPVAS

SEQ ID NO: 55532 - protein, 25 aa, synthetic construct
  source 1..25: note = Seed: VKLQTVHSIPLTINKEEALQRPVAS
VKLQTVHSIPFTIWKDEAMQRPVAS

SEQ ID NO: 55533 - protein, 25 aa, synthetic construct
  source 1..25: note = Seed: VKLQTVHSIPLTINKEEALQRPVAS
VKLQTVHSIPFTIWKDEAVQRPVAS

SEQ ID NO: 55534 - protein, 25 aa, synthetic construct
  source 1..25: note = Seed: VKLQTVHSIPLTINKEEALQRPVAS
VKLQTVHSIPFTIWKFEAAQRPVAS

SEQ ID NO: 55535 - protein, 25 aa, synthetic construct
  source 1..25: note = Seed: VKLQTVHSIPLTINKEEALQRPVAS
VKLQTVHSIPFTIWKFEACQRPVAS

SEQ ID NO: 55536 - protein, 25 aa, synthetic construct
  source 1..25: note = Seed: VKLQTVHSIPLTINKEEALQRPVAS
VKLQTVHSIPFTIWKFEADQRPVAS

SEQ ID NO: 55537 - protein, 25 aa, synthetic construct
  source 1..25: note = Seed: VKLQTVHSIPLTINKEEALQRPVAS
VKLQTVHSIPFTIWKFEAEQRPVAS

SEQ ID NO: 55538 - protein, 25 aa, synthetic construct
  source 1..25: note = Seed: VKLQTVHSIPLTINKEEALQRPVAS
VKLQTVHSIPFTIWKFEAFQRPVAS

SEQ ID NO: 55539 - protein, 25 aa, synthetic construct
  source 1..25: note = Seed: VKLQTVHSIPLTINKEEALQRPVAS
VKLQTVHSIPFTIWKFEAHQRPVAS

SEQ ID NO: 55540 - protein, 25 aa, synthetic construct
  source 1..25: note = Seed: VKLQTVHSIPLTINKEEALQRPVAS
VKLQTVHSIPFTIWKFEAIQRPVAS

SEQ ID NO: 55541 - protein, 25 aa, synthetic construct
  source 1..25: note = Seed: VKLQTVHSIPLTINKEEALQRPVAS
VKLQTVHSIPFTIWKFEAKQRPVAS

SEQ ID NO: 55542 - protein, 25 aa, synthetic construct
  source 1..25: note = Seed: VKLQTVHSIPLTINKEEALQRPVAS
VKLQTVHSIPFTIWKFEALQRPVAS

SEQ ID NO: 55543 - protein, 25 aa, synthetic construct
  source 1..25: note = Seed: VKLQTVHSIPLTINKEEALQRPVAS
VKLQTVHSIPFTIWKFEAMQRPVAS

SEQ ID NO: 55544 - protein, 25 aa, synthetic construct
  source 1..25: note = Seed: VKLQTVHSIPLTINKEEALQRPVAS
VKLQTVHSIPFTIWKFEANQRPVAS

SEQ ID NO: 55545 - protein, 25 aa, synthetic construct
  source 1..25: note = Seed: VKLQTVHSIPLTINKEEALQRPVAS
VKLQTVHSIPFTIWKFEAPQRPVAS

SEQ ID NO: 55546 - protein, 25 aa, synthetic construct
  source 1..25: note = Seed: VKLQTVHSIPLTINKEEALQRPVAS
VKLQTVHSIPFTIWKFEAQQRPVAS

SEQ ID NO: 55547 - protein, 25 aa, synthetic construct
  source 1..25: note = Seed: VKLQTVHSIPLTINKEEALQRPVAS
VKLQTVHSIPFTIWKFEARQRPVAS

SEQ ID NO: 55548 - protein, 25 aa, synthetic construct
  source 1..25: note = Seed: VKLQTVHSIPLTINKEEALQRPVAS
VKLQTVHSIPFTIWKFEASQRPVAS

SEQ ID NO: 55549 - protein, 25 aa, synthetic construct
  source 1..25: note = Seed: VKLQTVHSIPLTINKEEALQRPVAS
VKLQTVHSIPFTIWKFEATQRPVAS

SEQ ID NO: 55550 - protein, 25 aa, synthetic construct
  source 1..25: note = Seed: VKLQTVHSIPLTINKEEALQRPVAS
VKLQTVHSIPFTIWKFEAVQRPVAS

SEQ ID NO: 55551 - protein, 25 aa, synthetic construct
  source 1..25: note = Seed: VKLQTVHSIPLTINKEEALQRPVAS
VKLQTVHSIPFTIWKFEAWQRPVAS

SEQ ID NO: 55552 - protein, 25 aa, synthetic construct
  source 1..25: note = Seed: VKLQTVHSIPLTINKEEALQRPVAS
VKLQTVHSIPFTIWKFEAYQRPVAS

SEQ ID NO: 55553 - protein, 25 aa, synthetic construct
  source 1..25: note = Seed: VKLQTVHSIPLTINKEEALQRPVAS
VKLQTVHSIPFTIWKHEAFQRPVAS

SEQ ID NO: 55554 - protein, 25 aa, synthetic construct
  source 1..25: note = Seed: VKLQTVHSIPLTINKEEALQRPVAS
VKLQTVHSIPFTIWKHEAIQRPVAS

SEQ ID NO: 55555 - protein, 25 aa, synthetic construct
  source 1..25: note = Seed: VKLQTVHSIPLTINKEEALQRPVAS
VKLQTVHSIPFTIWKHEALQRPVAS

SEQ ID NO: 55556 - protein, 25 aa, synthetic construct
  source 1..25: note = Seed: VKLQTVHSIPLTINKEEALQRPVAS
VKLQTVHSIPFTIWKIEAAQRPVAS

SEQ ID NO: 55557 - protein, 25 aa, synthetic construct
  source 1..25: note = Seed: VKLQTVHSIPLTINKEEALQRPVAS
VKLQTVHSIPFTIWKIEAFQRPVAS

SEQ ID NO: 55558 - protein, 25 aa, synthetic construct
  source 1..25: note = Seed: VKLQTVHSIPLTINKEEALQRPVAS
VKLQTVHSIPFTIWKIEAIQRPVAS

SEQ ID NO: 55559 - protein, 25 aa, synthetic construct
  source 1..25: note = Seed: VKLQTVHSIPLTINKEEALQRPVAS
VKLQTVHSIPFTIWKIEALQRPVAS

SEQ ID NO: 55560 - protein, 25 aa, synthetic construct
  source 1..25: note = Seed: VKLQTVHSIPLTINKEEALQRPVAS
VKLQTVHSIPFTIWKIEAMQRPVAS

SEQ ID NO: 55561 - protein, 25 aa, synthetic construct
  source 1..25: note = Seed: VKLQTVHSIPLTINKEEALQRPVAS
VKLQTVHSIPFTIWKIEASQRPVAS

SEQ ID NO: 55562 - protein, 25 aa, synthetic construct
  source 1..25: note = Seed: VKLQTVHSIPLTINKEEALQRPVAS
VKLQTVHSIPFTIWKIEAVQRPVAS

SEQ ID NO: 55563 - protein, 25 aa, synthetic construct
  source 1..25: note = Seed: VKLQTVHSIPLTINKEEALQRPVAS
VKLQTVHSIPFTIWKIEAYQRPVAS

SEQ ID NO: 55564 - protein, 25 aa, synthetic construct
  source 1..25: note = Seed: VKLQTVHSIPLTINKEEALQRPVAS
VKLQTVHSIPFTIWKLEAAQRPVAS

SEQ ID NO: 55565 - protein, 25 aa, synthetic construct
  source 1..25: note = Seed: VKLQTVHSIPLTINKEEALQRPVAS
VKLQTVHSIPFTIWKLEAFQRPVAS

SEQ ID NO: 55566 - protein, 25 aa, synthetic construct
  source 1..25: note = Seed: VKLQTVHSIPLTINKEEALQRPVAS
VKLQTVHSIPFTIWKLEAIQRPVAS

SEQ ID NO: 55567 - protein, 25 aa, synthetic construct
  source 1..25: note = Seed: VKLQTVHSIPLTINKEEALQRPVAS
VKLQTVHSIPFTIWKLEALQRPVAS

SEQ ID NO: 55568 - protein, 25 aa, synthetic construct
  source 1..25: note = Seed: VKLQTVHSIPLTINKEEALQRPVAS
VKLQTVHSIPFTIWKLEAMQRPVAS

SEQ ID NO: 55569 - protein, 25 aa, synthetic construct
  source 1..25: note = Seed: VKLQTVHSIPLTINKEEALQRPVAS
VKLQTVHSIPFTIWKLEATQRPVAS

SEQ ID NO: 55570 - protein, 25 aa, synthetic construct
  source 1..25: note = Seed: VKLQTVHSIPLTINKEEALQRPVAS
VKLQTVHSIPFTIWKLEAVQRPVAS

SEQ ID NO: 55571 - protein, 25 aa, synthetic construct
  source 1..25: note = Seed: VKLQTVHSIPLTINKEEALQRPVAS
VKLQTVHSIPFTIWKLEAWQRPVAS

SEQ ID NO: 55572 - protein, 25 aa, synthetic construct
  source 1..25: note = Seed: VKLQTVHSIPLTINKEEALQRPVAS
VKLQTVHSIPFTIWKLEAYQRPVAS

SEQ ID NO: 55573 - protein, 25 aa, synthetic construct
  source 1..25: note = Seed: VKLQTVHSIPLTINKEEALQRPVAS
VKLQTVHSIPFTIWKMEAAQRPVAS

SEQ ID NO: 55574 - protein, 25 aa, synthetic construct
  source 1..25: note = Seed: VKLQTVHSIPLTINKEEALQRPVAS
VKLQTVHSIPFTIWKMEAFQRPVAS

SEQ ID NO: 55575 - protein, 25 aa, synthetic construct
  source 1..25: note = Seed: VKLQTVHSIPLTINKEEALQRPVAS
VKLQTVHSIPFTIWKMEAIQRPVAS

SEQ ID NO: 55576 - protein, 25 aa, synthetic construct
  source 1..25: note = Seed: VKLQTVHSIPLTINKEEALQRPVAS
VKLQTVHSIPFTIWKMEALQRPVAS

SEQ ID NO: 55577 - protein, 25 aa, synthetic construct
  source 1..25: note = Seed: VKLQTVHSIPLTINKEEALQRPVAS
VKLQTVHSIPFTIWKMEAMQRPVAS

SEQ ID NO: 55578 - protein, 25 aa, synthetic construct
  source 1..25: note = Seed: VKLQTVHSIPLTINKEEALQRPVAS
VKLQTVHSIPFTIWKMEAVQRPVAS

SEQ ID NO: 55579 - protein, 25 aa, synthetic construct
  source 1..25: note = Seed: VKLQTVHSIPLTINKEEALQRPVAS
VKLQTVHSIPFTIWKMEAYQRPVAS

SEQ ID NO: 55580 - protein, 25 aa, synthetic construct
  source 1..25: note = Seed: VKLQTVHSIPLTINKEEALQRPVAS
VKLQTVHSIPFTIWKNEAIQRPVAS

SEQ ID NO: 55581 - protein, 25 aa, synthetic construct
  source 1..25: note = Seed: VKLQTVHSIPLTINKEEALQRPVAS
VKLQTVHSIPFTIWKNEALQRPVAS

SEQ ID NO: 55582 - protein, 25 aa, synthetic construct
  source 1..25: note = Seed: VKLQTVHSIPLTINKEEALQRPVAS
VKLQTVHSIPFTIWKNEAVQRPVAS

SEQ ID NO: 55583 - protein, 25 aa, synthetic construct
  source 1..25: note = Seed: VKLQTVHSIPLTINKEEALQRPVAS
VKLQTVHSIPFTIWKREAFQRPVAS

SEQ ID NO: 55584 - protein, 25 aa, synthetic construct
  source 1..25: note = Seed: VKLQTVHSIPLTINKEEALQRPVAS
VKLQTVHSIPFTIWKREALQRPVAS

SEQ ID NO: 55585 - protein, 25 aa, synthetic construct
  source 1..25: note = Seed: VKLQTVHSIPLTINKEEALQRPVAS
VKLQTVHSIPFTIWKREARQRPVAS

SEQ ID NO: 55586 - protein, 25 aa, synthetic construct
  source 1..25: note = Seed: VKLQTVHSIPLTINKEEALQRPVAS
VKLQTVHSIPFTIWKREAYQRPVAS

SEQ ID NO: 55587 - protein, 25 aa, synthetic construct
  source 1..25: note = Seed: VKLQTVHSIPLTINKEEALQRPVAS
VKLQTVHSIPFTIWKSEAFQRPVAS

SEQ ID NO: 55588 - protein, 25 aa, synthetic construct
  source 1..25: note = Seed: VKLQTVHSIPLTINKEEALQRPVAS
VKLQTVHSIPFTIWKSEAIQRPVAS

SEQ ID NO: 55589 - protein, 25 aa, synthetic construct
  source 1..25: note = Seed: VKLQTVHSIPLTINKEEALQRPVAS
VKLQTVHSIPFTIWKSEALQRPVAS

SEQ ID NO: 55590 - protein, 25 aa, synthetic construct
  source 1..25: note = Seed: VKLQTVHSIPLTINKEEALQRPVAS
VKLQTVHSIPFTIWKSEAVQRPVAS

SEQ ID NO: 55591 - protein, 25 aa, synthetic construct
  source 1..25: note = Seed: VKLQTVHSIPLTINKEEALQRPVAS
VKLQTVHSIPFTIWKTEAFQRPVAS

SEQ ID NO: 55592 - protein, 25 aa, synthetic construct
  source 1..25: note = Seed: VKLQTVHSIPLTINKEEALQRPVAS
VKLQTVHSIPFTIWKVEAAQRPVAS

SEQ ID NO: 55593 - protein, 25 aa, synthetic construct
  source 1..25: note = Seed: VKLQTVHSIPLTINKEEALQRPVAS
VKLQTVHSIPFTIWKVEAFQRPVAS

SEQ ID NO: 55594 - protein, 25 aa, synthetic construct
  source 1..25: note = Seed: VKLQTVHSIPLTINKEEALQRPVAS
VKLQTVHSIPFTIWKVEAIQRPVAS

SEQ ID NO: 55595 - protein, 25 aa, synthetic construct
  source 1..25: note = Seed: VKLQTVHSIPLTINKEEALQRPVAS
VKLQTVHSIPFTIWKVEALQRPVAS

SEQ ID NO: 55596 - protein, 25 aa, synthetic construct
  source 1..25: note = Seed: VKLQTVHSIPLTINKEEALQRPVAS
VKLQTVHSIPFTIWKVEAMQRPVAS

SEQ ID NO: 55597 - protein, 25 aa, synthetic construct
  source 1..25: note = Seed: VKLQTVHSIPLTINKEEALQRPVAS
VKLQTVHSIPFTIWKVEAVQRPVAS

SEQ ID NO: 55598 - protein, 25 aa, synthetic construct
  source 1..25: note = Seed: VKLQTVHSIPLTINKEEALQRPVAS
VKLQTVHSIPFTIWKVEAYQRPVAS

SEQ ID NO: 55599 - protein, 25 aa, synthetic construct
  source 1..25: note = Seed: VKLQTVHSIPLTINKEEALQRPVAS
VKLQTVHSIPFTIWKWEAAQRPVAS

SEQ ID NO: 55600 - protein, 25 aa, synthetic construct
  source 1..25: note = Seed: VKLQTVHSIPLTINKEEALQRPVAS
VKLQTVHSIPFTIWKWEAFQRPVAS

SEQ ID NO: 55601 - protein, 25 aa, synthetic construct
  source 1..25: note = Seed: VKLQTVHSIPLTINKEEALQRPVAS
VKLQTVHSIPFTIWKWEAIQRPVAS

SEQ ID NO: 55602 - protein, 25 aa, synthetic construct
  source 1..25: note = Seed: VKLQTVHSIPLTINKEEALQRPVAS
VKLQTVHSIPFTIWKWEALQRPVAS

SEQ ID NO: 55603 - protein, 25 aa, synthetic construct
  source 1..25: note = Seed: VKLQTVHSIPLTINKEEALQRPVAS
VKLQTVHSIPFTIWKWEAMQRPVAS

SEQ ID NO: 55604 - protein, 25 aa, synthetic construct
  source 1..25: note = Seed: VKLQTVHSIPLTINKEEALQRPVAS
VKLQTVHSIPFTIWKWEAVQRPVAS

SEQ ID NO: 55605 - protein, 25 aa, synthetic construct
  source 1..25: note = Seed: VKLQTVHSIPLTINKEEALQRPVAS
VKLQTVHSIPFTIWKWEAYQRPVAS

SEQ ID NO: 55606 - protein, 25 aa, synthetic construct
  source 1..25: note = Seed: VKLQTVHSIPLTINKEEALQRPVAS
VKLQTVHSIPFTIWKYEAAQRPVAS

SEQ ID NO: 55607 - protein, 25 aa, synthetic construct
  source 1..25: note = Seed: VKLQTVHSIPLTINKEEALQRPVAS
VKLQTVHSIPFTIWKYEAFQRPVAS

SEQ ID NO: 55608 - protein, 25 aa, synthetic construct
  source 1..25: note = Seed: VKLQTVHSIPLTINKEEALQRPVAS
VKLQTVHSIPFTIWKYEAIQRPVAS

SEQ ID NO: 55609 - protein, 25 aa, synthetic construct
  source 1..25: note = Seed: VKLQTVHSIPLTINKEEALQRPVAS
VKLQTVHSIPFTIWKYEALQRPVAS

SEQ ID NO: 55610 - protein, 25 aa, synthetic construct
  source 1..25: note = Seed: VKLQTVHSIPLTINKEEALQRPVAS
VKLQTVHSIPFTIWKYEAMQRPVAS

SEQ ID NO: 55611 - protein, 25 aa, synthetic construct
  source 1..25: note = Seed: VKLQTVHSIPLTINKEEALQRPVAS
VKLQTVHSIPFTIWKYEAVQRPVAS

SEQ ID NO: 55612 - protein, 25 aa, synthetic construct
  source 1..25: note = Seed: VKLQTVHSIPLTINKEEALQRPVAS
VKLQTVHSIPFTIWKYEAWQRPVAS

SEQ ID NO: 55613 - protein, 25 aa, synthetic construct
  source 1..25: note = Seed: VKLQTVHSIPLTINKEEALQRPVAS
VKLQTVHSIPFTIWKYEAYQRPVAS

SEQ ID NO: 55614 - protein, 25 aa, synthetic construct
  source 1..25: note = Seed: VKLQTVHSIPLTINKEEALQRPVAS
VKLQTVHSIPFTIYKAEAAQRPVAS

SEQ ID NO: 55615 - protein, 25 aa, synthetic construct
  source 1..25: note = Seed: VKLQTVHSIPLTINKEEALQRPVAS
VKLQTVHSIPFTIYKAEACQRPVAS

SEQ ID NO: 55616 - protein, 25 aa, synthetic construct
  source 1..25: note = Seed: VKLQTVHSIPLTINKEEALQRPVAS
VKLQTVHSIPFTIYKAEADQRPVAS

SEQ ID NO: 55617 - protein, 25 aa, synthetic construct
  source 1..25: note = Seed: VKLQTVHSIPLTINKEEALQRPVAS
VKLQTVHSIPFTIYKAEAEQRPVAS

SEQ ID NO: 55618 - protein, 25 aa, synthetic construct
  source 1..25: note = Seed: VKLQTVHSIPLTINKEEALQRPVAS
VKLQTVHSIPFTIYKAEAFQRPVAS

SEQ ID NO: 55619 - protein, 25 aa, synthetic construct
  source 1..25: note = Seed: VKLQTVHSIPLTINKEEALQRPVAS
VKLQTVHSIPFTIYKAEAIQRPVAS

SEQ ID NO: 55620 - protein, 25 aa, synthetic construct
  source 1..25: note = Seed: VKLQTVHSIPLTINKEEALQRPVAS
VKLQTVHSIPFTIYKAEALQRPVAS

SEQ ID NO: 55621 - protein, 25 aa, synthetic construct
  source 1..25: note = Seed: VKLQTVHSIPLTINKEEALQRPVAS
VKLQTVHSIPFTIYKAEAMQRPVAS

SEQ ID NO: 55622 - protein, 25 aa, synthetic construct
  source 1..25: note = Seed: VKLQTVHSIPLTINKEEALQRPVAS
VKLQTVHSIPFTIYKAEANQRPVAS

SEQ ID NO: 55623 - protein, 25 aa, synthetic construct
  source 1..25: note = Seed: VKLQTVHSIPLTINKEEALQRPVAS
VKLQTVHSIPFTIYKAEARQRPVAS

SEQ ID NO: 55624 - protein, 25 aa, synthetic construct
  source 1..25: note = Seed: VKLQTVHSIPLTINKEEALQRPVAS
VKLQTVHSIPFTIYKAEASQRPVAS

SEQ ID NO: 55625 - protein, 25 aa, synthetic construct
  source 1..25: note = Seed: VKLQTVHSIPLTINKEEALQRPVAS
VKLQTVHSIPFTIYKAEATQRPVAS

SEQ ID NO: 55626 - protein, 25 aa, synthetic construct
  source 1..25: note = Seed: VKLQTVHSIPLTINKEEALQRPVAS
VKLQTVHSIPFTIYKAEAVQRPVAS

SEQ ID NO: 55627 - protein, 25 aa, synthetic construct
  source 1..25: note = Seed: VKLQTVHSIPLTINKEEALQRPVAS
VKLQTVHSIPFTIYKAEAYQRPVAS

SEQ ID NO: 55628 - protein, 25 aa, synthetic construct
  source 1..25: note = Seed: VKLQTVHSIPLTINKEEALQRPVAS
VKLQTVHSIPFTIYKDEAAQRPVAS

SEQ ID NO: 55629 - protein, 25 aa, synthetic construct
  source 1..25: note = Seed: VKLQTVHSIPLTINKEEALQRPVAS
VKLQTVHSIPFTIYKDEAFQRPVAS

SEQ ID NO: 55630 - protein, 25 aa, synthetic construct
  source 1..25: note = Seed: VKLQTVHSIPLTINKEEALQRPVAS
VKLQTVHSIPFTIYKDEAIQRPVAS

SEQ ID NO: 55631 - protein, 25 aa, synthetic construct
  source 1..25: note = Seed: VKLQTVHSIPLTINKEEALQRPVAS
VKLQTVHSIPFTIYKDEALQRPVAS

SEQ ID NO: 55632 - protein, 25 aa, synthetic construct
  source 1..25: note = Seed: VKLQTVHSIPLTINKEEALQRPVAS
VKLQTVHSIPFTIYKDEAMQRPVAS

SEQ ID NO: 55633 - protein, 25 aa, synthetic construct
  source 1..25: note = Seed: VKLQTVHSIPLTINKEEALQRPVAS
VKLQTVHSIPFTIYKDEASQRPVAS

SEQ ID NO: 55634 - protein, 25 aa, synthetic construct
  source 1..25: note = Seed: VKLQTVHSIPLTINKEEALQRPVAS
VKLQTVHSIPFTIYKDEAVQRPVAS

SEQ ID NO: 55635 - protein, 25 aa, synthetic construct
  source 1..25: note = Seed: VKLQTVHSIPLTINKEEALQRPVAS
VKLQTVHSIPFTIYKEEAFQRPVAS

SEQ ID NO: 55636 - protein, 25 aa, synthetic construct
  source 1..25: note = Seed: VKLQTVHSIPLTINKEEALQRPVAS
VKLQTVHSIPFTIYKEEAIQRPVAS

SEQ ID NO: 55637 - protein, 25 aa, synthetic construct
  source 1..25: note = Seed: VKLQTVHSIPLTINKEEALQRPVAS
VKLQTVHSIPFTIYKEEALQRPVAS

SEQ ID NO: 55638 - protein, 25 aa, synthetic construct
  source 1..25: note = Seed: VKLQTVHSIPLTINKEEALQRPVAS
VKLQTVHSIPFTIYKEEAMQRPVAS

SEQ ID NO: 55639 - protein, 25 aa, synthetic construct
  source 1..25: note = Seed: VKLQTVHSIPLTINKEEALQRPVAS
VKLQTVHSIPFTIYKEEAYQRPVAS

SEQ ID NO: 55640 - protein, 25 aa, synthetic construct
  source 1..25: note = Seed: VKLQTVHSIPLTINKEEALQRPVAS
VKLQTVHSIPFTIYKFEAAQRPVAS

SEQ ID NO: 55641 - protein, 25 aa, synthetic construct
  source 1..25: note = Seed: VKLQTVHSIPLTINKEEALQRPVAS
VKLQTVHSIPFTIYKFEACQRPVAS

SEQ ID NO: 55642 - protein, 25 aa, synthetic construct
  source 1..25: note = Seed: VKLQTVHSIPLTINKEEALQRPVAS
VKLQTVHSIPFTIYKFEADQRPVAS

SEQ ID NO: 55643 - protein, 25 aa, synthetic construct
  source 1..25: note = Seed: VKLQTVHSIPLTINKEEALQRPVAS
VKLQTVHSIPFTIYKFEAEQRPVAS

SEQ ID NO: 55644 - protein, 25 aa, synthetic construct
  source 1..25: note = Seed: VKLQTVHSIPLTINKEEALQRPVAS
VKLQTVHSIPFTIYKFEAFQRPVAS

SEQ ID NO: 55645 - protein, 25 aa, synthetic construct
  source 1..25: note = Seed: VKLQTVHSIPLTINKEEALQRPVAS
VKLQTVHSIPFTIYKFEAGQRPVAS

SEQ ID NO: 55646 - protein, 25 aa, synthetic construct
  source 1..25: note = Seed: VKLQTVHSIPLTINKEEALQRPVAS
VKLQTVHSIPFTIYKFEAHQRPVAS

SEQ ID NO: 55647 - protein, 25 aa, synthetic construct
  source 1..25: note = Seed: VKLQTVHSIPLTINKEEALQRPVAS
VKLQTVHSIPFTIYKFEAIQRPVAS

SEQ ID NO: 55648 - protein, 25 aa, synthetic construct
  source 1..25: note = Seed: VKLQTVHSIPLTINKEEALQRPVAS
VKLQTVHSIPFTIYKFEAKQRPVAS

SEQ ID NO: 55649 - protein, 25 aa, synthetic construct
  source 1..25: note = Seed: VKLQTVHSIPLTINKEEALQRPVAS
VKLQTVHSIPFTIYKFEALQRPVAS

SEQ ID NO: 55650 - protein, 25 aa, synthetic construct
  source 1..25: note = Seed: VKLQTVHSIPLTINKEEALQRPVAS
VKLQTVHSIPFTIYKFEAMQRPVAS

SEQ ID NO: 55651 - protein, 25 aa, synthetic construct
  source 1..25: note = Seed: VKLQTVHSIPLTINKEEALQRPVAS
VKLQTVHSIPFTIYKFEANQRPVAS

SEQ ID NO: 55652 - protein, 25 aa, synthetic construct
  source 1..25: note = Seed: VKLQTVHSIPLTINKEEALQRPVAS
VKLQTVHSIPFTIYKFEAPQRPVAS

SEQ ID NO: 55653 - protein, 25 aa, synthetic construct
  source 1..25: note = Seed: VKLQTVHSIPLTINKEEALQRPVAS
VKLQTVHSIPFTIYKFEAQQRPVAS

SEQ ID NO: 55654 - protein, 25 aa, synthetic construct
  source 1..25: note = Seed: VKLQTVHSIPLTINKEEALQRPVAS
VKLQTVHSIPFTIYKFEARQRPVAS

SEQ ID NO: 55655 - protein, 25 aa, synthetic construct
  source 1..25: note = Seed: VKLQTVHSIPLTINKEEALQRPVAS
VKLQTVHSIPFTIYKFEASQRPVAS

SEQ ID NO: 55656 - protein, 25 aa, synthetic construct
  source 1..25: note = Seed: VKLQTVHSIPLTINKEEALQRPVAS
VKLQTVHSIPFTIYKFEATQRPVAS

SEQ ID NO: 55657 - protein, 25 aa, synthetic construct
  source 1..25: note = Seed: VKLQTVHSIPLTINKEEALQRPVAS
VKLQTVHSIPFTIYKFEAVQRPVAS

SEQ ID NO: 55658 - protein, 25 aa, synthetic construct
  source 1..25: note = Seed: VKLQTVHSIPLTINKEEALQRPVAS
VKLQTVHSIPFTIYKFEAWQRPVAS

SEQ ID NO: 55659 - protein, 25 aa, synthetic construct
  source 1..25: note = Seed: VKLQTVHSIPLTINKEEALQRPVAS
VKLQTVHSIPFTIYKFEAYQRPVAS

SEQ ID NO: 55660 - protein, 25 aa, synthetic construct
  source 1..25: note = Seed: VKLQTVHSIPLTINKEEALQRPVAS
VKLQTVHSIPFTIYKGEALQRPVAS

SEQ ID NO: 55661 - protein, 25 aa, synthetic construct
  source 1..25: note = Seed: VKLQTVHSIPLTINKEEALQRPVAS
VKLQTVHSIPFTIYKHEAFQRPVAS

SEQ ID NO: 55662 - protein, 25 aa, synthetic construct
  source 1..25: note = Seed: VKLQTVHSIPLTINKEEALQRPVAS
VKLQTVHSIPFTIYKHEAIQRPVAS

SEQ ID NO: 55663 - protein, 25 aa, synthetic construct
  source 1..25: note = Seed: VKLQTVHSIPLTINKEEALQRPVAS
VKLQTVHSIPFTIYKHEALQRPVAS

SEQ ID NO: 55664 - protein, 25 aa, synthetic construct
  source 1..25: note = Seed: VKLQTVHSIPLTINKEEALQRPVAS
VKLQTVHSIPFTIYKHEAMQRPVAS

SEQ ID NO: 55665 - protein, 25 aa, synthetic construct
  source 1..25: note = Seed: VKLQTVHSIPLTINKEEALQRPVAS
VKLQTVHSIPFTIYKHEAVQRPVAS

SEQ ID NO: 55666 - protein, 25 aa, synthetic construct
  source 1..25: note = Seed: VKLQTVHSIPLTINKEEALQRPVAS
VKLQTVHSIPFTIYKHEAYQRPVAS

SEQ ID NO: 55667 - protein, 25 aa, synthetic construct
  source 1..25: note = Seed: VKLQTVHSIPLTINKEEALQRPVAS
VKLQTVHSIPFTIYKIEAAQRPVAS

SEQ ID NO: 55668 - protein, 25 aa, synthetic construct
  source 1..25: note = Seed: VKLQTVHSIPLTINKEEALQRPVAS
VKLQTVHSIPFTIYKIEACQRPVAS

SEQ ID NO: 55669 - protein, 25 aa, synthetic construct
  source 1..25: note = Seed: VKLQTVHSIPLTINKEEALQRPVAS
VKLQTVHSIPFTIYKIEADQRPVAS

SEQ ID NO: 55670 - protein, 25 aa, synthetic construct
  source 1..25: note = Seed: VKLQTVHSIPLTINKEEALQRPVAS
VKLQTVHSIPFTIYKIEAEQRPVAS

SEQ ID NO: 55671 - protein, 25 aa, synthetic construct
  source 1..25: note = Seed: VKLQTVHSIPLTINKEEALQRPVAS
VKLQTVHSIPFTIYKIEAFQRPVAS

SEQ ID NO: 55672 - protein, 25 aa, synthetic construct
  source 1..25: note = Seed: VKLQTVHSIPLTINKEEALQRPVAS
VKLQTVHSIPFTIYKIEAGQRPVAS

SEQ ID NO: 55673 - protein, 25 aa, synthetic construct
  source 1..25: note = Seed: VKLQTVHSIPLTINKEEALQRPVAS
VKLQTVHSIPFTIYKIEAHQRPVAS

SEQ ID NO: 55674 - protein, 25 aa, synthetic construct
  source 1..25: note = Seed: VKLQTVHSIPLTINKEEALQRPVAS
VKLQTVHSIPFTIYKIEAIQRPVAS

SEQ ID NO: 55675 - protein, 25 aa, synthetic construct
  source 1..25: note = Seed: VKLQTVHSIPLTINKEEALQRPVAS
VKLQTVHSIPFTIYKIEAKQRPVAS

SEQ ID NO: 55676 - protein, 25 aa, synthetic construct
  source 1..25: note = Seed: VKLQTVHSIPLTINKEEALQRPVAS
VKLQTVHSIPFTIYKIEALQRPVAS

SEQ ID NO: 55677 - protein, 25 aa, synthetic construct
  source 1..25: note = Seed: VKLQTVHSIPLTINKEEALQRPVAS
VKLQTVHSIPFTIYKIEAMQRPVAS

SEQ ID NO: 55678 - protein, 25 aa, synthetic construct
  source 1..25: note = Seed: VKLQTVHSIPLTINKEEALQRPVAS
VKLQTVHSIPFTIYKIEANQRPVAS

SEQ ID NO: 55679 - protein, 25 aa, synthetic construct
  source 1..25: note = Seed: VKLQTVHSIPLTINKEEALQRPVAS
VKLQTVHSIPFTIYKIEAPQRPVAS

SEQ ID NO: 55680 - protein, 25 aa, synthetic construct
  source 1..25: note = Seed: VKLQTVHSIPLTINKEEALQRPVAS
VKLQTVHSIPFTIYKIEAQQRPVAS

SEQ ID NO: 55681 - protein, 25 aa, synthetic construct
  source 1..25: note = Seed: VKLQTVHSIPLTINKEEALQRPVAS
VKLQTVHSIPFTIYKIEARQRPVAS

SEQ ID NO: 55682 - protein, 25 aa, synthetic construct
  source 1..25: note = Seed: VKLQTVHSIPLTINKEEALQRPVAS
VKLQTVHSIPFTIYKIEASQRPVAS

SEQ ID NO: 55683 - protein, 25 aa, synthetic construct
  source 1..25: note = Seed: VKLQTVHSIPLTINKEEALQRPVAS
VKLQTVHSIPFTIYKIEATQRPVAS

SEQ ID NO: 55684 - protein, 25 aa, synthetic construct
  source 1..25: note = Seed: VKLQTVHSIPLTINKEEALQRPVAS
VKLQTVHSIPFTIYKIEAVQRPVAS

SEQ ID NO: 55685 - protein, 25 aa, synthetic construct
  source 1..25: note = Seed: VKLQTVHSIPLTINKEEALQRPVAS
VKLQTVHSIPFTIYKIEAYQRPVAS

SEQ ID NO: 55686 - protein, 25 aa, synthetic construct
  source 1..25: note = Seed: VKLQTVHSIPLTINKEEALQRPVAS
VKLQTVHSIPFTIYKKEAFQRPVAS

SEQ ID NO: 55687 - protein, 25 aa, synthetic construct
  source 1..25: note = Seed: VKLQTVHSIPLTINKEEALQRPVAS
VKLQTVHSIPFTIYKKEALQRPVAS

SEQ ID NO: 55688 - protein, 25 aa, synthetic construct
  source 1..25: note = Seed: VKLQTVHSIPLTINKEEALQRPVAS
VKLQTVHSIPFTIYKLEAAQRPVAS

SEQ ID NO: 55689 - protein, 25 aa, synthetic construct
  source 1..25: note = Seed: VKLQTVHSIPLTINKEEALQRPVAS
VKLQTVHSIPFTIYKLEACQRPVAS

SEQ ID NO: 55690 - protein, 25 aa, synthetic construct
  source 1..25: note = Seed: VKLQTVHSIPLTINKEEALQRPVAS
VKLQTVHSIPFTIYKLEADQRPVAS

SEQ ID NO: 55691 - protein, 25 aa, synthetic construct
  source 1..25: note = Seed: VKLQTVHSIPLTINKEEALQRPVAS
VKLQTVHSIPFTIYKLEAEQRPVAS

SEQ ID NO: 55692 - protein, 25 aa, synthetic construct
  source 1..25: note = Seed: VKLQTVHSIPLTINKEEALQRPVAS
VKLQTVHSIPFTIYKLEAFQRPVAS

SEQ ID NO: 55693 - protein, 25 aa, synthetic construct
  source 1..25: note = Seed: VKLQTVHSIPLTINKEEALQRPVAS
VKLQTVHSIPFTIYKLEAGQRPVAS

SEQ ID NO: 55694 - protein, 25 aa, synthetic construct
  source 1..25: note = Seed: VKLQTVHSIPLTINKEEALQRPVAS
VKLQTVHSIPFTIYKLEAHQRPVAS

SEQ ID NO: 55695 - protein, 25 aa, synthetic construct
  source 1..25: note = Seed: VKLQTVHSIPLTINKEEALQRPVAS
VKLQTVHSIPFTIYKLEAIQRPVAS

SEQ ID NO: 55696 - protein, 25 aa, synthetic construct
  source 1..25: note = Seed: VKLQTVHSIPLTINKEEALQRPVAS
VKLQTVHSIPFTIYKLEAKQRPVAS

SEQ ID NO: 55697 - protein, 25 aa, synthetic construct
  source 1..25: note = Seed: VKLQTVHSIPLTINKEEALQRPVAS
VKLQTVHSIPFTIYKLEALQRPVAS

SEQ ID NO: 55698 - protein, 25 aa, synthetic construct
  source 1..25: note = Seed: VKLQTVHSIPLTINKEEALQRPVAS
VKLQTVHSIPFTIYKLEAMQRPVAS

SEQ ID NO: 55699 - protein, 25 aa, synthetic construct
  source 1..25: note = Seed: VKLQTVHSIPLTINKEEALQRPVAS
VKLQTVHSIPFTIYKLEANQRPVAS

SEQ ID NO: 55700 - protein, 25 aa, synthetic construct
  source 1..25: note = Seed: VKLQTVHSIPLTINKEEALQRPVAS
VKLQTVHSIPFTIYKLEAPQRPVAS

SEQ ID NO: 55701 - protein, 25 aa, synthetic construct
  source 1..25: note = Seed: VKLQTVHSIPLTINKEEALQRPVAS
VKLQTVHSIPFTIYKLEAQQRPVAS

SEQ ID NO: 55702 - protein, 25 aa, synthetic construct
  source 1..25: note = Seed: VKLQTVHSIPLTINKEEALQRPVAS
VKLQTVHSIPFTIYKLEARQRPVAS

SEQ ID NO: 55703 - protein, 25 aa, synthetic construct
  source 1..25: note = Seed: VKLQTVHSIPLTINKEEALQRPVAS
VKLQTVHSIPFTIYKLEASQRPVAS

SEQ ID NO: 55704 - protein, 25 aa, synthetic construct
  source 1..25: note = Seed: VKLQTVHSIPLTINKEEALQRPVAS
VKLQTVHSIPFTIYKLEATQRPVAS

SEQ ID NO: 55705 - protein, 25 aa, synthetic construct
  source 1..25: note = Seed: VKLQTVHSIPLTINKEEALQRPVAS
VKLQTVHSIPFTIYKLEAVQRPVAS

SEQ ID NO: 55706 - protein, 25 aa, synthetic construct
  source 1..25: note = Seed: VKLQTVHSIPLTINKEEALQRPVAS
VKLQTVHSIPFTIYKLEAWQRPVAS

SEQ ID NO: 55707 - protein, 25 aa, synthetic construct
  source 1..25: note = Seed: VKLQTVHSIPLTINKEEALQRPVAS
VKLQTVHSIPFTIYKLEAYQRPVAS

SEQ ID NO: 55708 - protein, 25 aa, synthetic construct
  source 1..25: note = Seed: VKLQTVHSIPLTINKEEALQRPVAS
VKLQTVHSIPFTIYKMEAAQRPVAS

SEQ ID NO: 55709 - protein, 25 aa, synthetic construct
  source 1..25: note = Seed: VKLQTVHSIPLTINKEEALQRPVAS
VKLQTVHSIPFTIYKMEACQRPVAS

SEQ ID NO: 55710 - protein, 25 aa, synthetic construct
  source 1..25: note = Seed: VKLQTVHSIPLTINKEEALQRPVAS
VKLQTVHSIPFTIYKMEADQRPVAS

SEQ ID NO: 55711 - protein, 25 aa, synthetic construct
  source 1..25: note = Seed: VKLQTVHSIPLTINKEEALQRPVAS
VKLQTVHSIPFTIYKMEAEQRPVAS

SEQ ID NO: 55712 - protein, 25 aa, synthetic construct
  source 1..25: note = Seed: VKLQTVHSIPLTINKEEALQRPVAS
VKLQTVHSIPFTIYKMEAFQRPVAS

SEQ ID NO: 55713 - protein, 25 aa, synthetic construct
  source 1..25: note = Seed: VKLQTVHSIPLTINKEEALQRPVAS
VKLQTVHSIPFTIYKMEAGQRPVAS

SEQ ID NO: 55714 - protein, 25 aa, synthetic construct
  source 1..25: note = Seed: VKLQTVHSIPLTINKEEALQRPVAS
VKLQTVHSIPFTIYKMEAHQRPVAS

SEQ ID NO: 55715 - protein, 25 aa, synthetic construct
  source 1..25: note = Seed: VKLQTVHSIPLTINKEEALQRPVAS
VKLQTVHSIPFTIYKMEAIQRPVAS

SEQ ID NO: 55716 - protein, 25 aa, synthetic construct
  source 1..25: note = Seed: VKLQTVHSIPLTINKEEALQRPVAS
VKLQTVHSIPFTIYKMEALQRPVAS

SEQ ID NO: 55717 - protein, 25 aa, synthetic construct
  source 1..25: note = Seed: VKLQTVHSIPLTINKEEALQRPVAS
VKLQTVHSIPFTIYKMEAMQRPVAS

SEQ ID NO: 55718 - protein, 25 aa, synthetic construct
  source 1..25: note = Seed: VKLQTVHSIPLTINKEEALQRPVAS
VKLQTVHSIPFTIYKMEANQRPVAS

SEQ ID NO: 55719 - protein, 25 aa, synthetic construct
  source 1..25: note = Seed: VKLQTVHSIPLTINKEEALQRPVAS
VKLQTVHSIPFTIYKMEAPQRPVAS

SEQ ID NO: 55720 - protein, 25 aa, synthetic construct
  source 1..25: note = Seed: VKLQTVHSIPLTINKEEALQRPVAS
VKLQTVHSIPFTIYKMEAQQRPVAS

SEQ ID NO: 55721 - protein, 25 aa, synthetic construct
  source 1..25: note = Seed: VKLQTVHSIPLTINKEEALQRPVAS
VKLQTVHSIPFTIYKMEARQRPVAS

SEQ ID NO: 55722 - protein, 25 aa, synthetic construct
  source 1..25: note = Seed: VKLQTVHSIPLTINKEEALQRPVAS
VKLQTVHSIPFTIYKMEASQRPVAS

SEQ ID NO: 55723 - protein, 25 aa, synthetic construct
  source 1..25: note = Seed: VKLQTVHSIPLTINKEEALQRPVAS
VKLQTVHSIPFTIYKMEATQRPVAS

SEQ ID NO: 55724 - protein, 25 aa, synthetic construct
  source 1..25: note = Seed: VKLQTVHSIPLTINKEEALQRPVAS
VKLQTVHSIPFTIYKMEAVQRPVAS

SEQ ID NO: 55725 - protein, 25 aa, synthetic construct
  source 1..25: note = Seed: VKLQTVHSIPLTINKEEALQRPVAS
VKLQTVHSIPFTIYKMEAWQRPVAS

SEQ ID NO: 55726 - protein, 25 aa, synthetic construct
  source 1..25: note = Seed: VKLQTVHSIPLTINKEEALQRPVAS
VKLQTVHSIPFTIYKMEAYQRPVAS

SEQ ID NO: 55727 - protein, 25 aa, synthetic construct
  source 1..25: note = Seed: VKLQTVHSIPLTINKEEALQRPVAS
VKLQTVHSIPFTIYKNEAIQRPVAS

SEQ ID NO: 55728 - protein, 25 aa, synthetic construct
  source 1..25: note = Seed: VKLQTVHSIPLTINKEEALQRPVAS
VKLQTVHSIPFTIYKNEALQRPVAS

SEQ ID NO: 55729 - protein, 25 aa, synthetic construct
  source 1..25: note = Seed: VKLQTVHSIPLTINKEEALQRPVAS
VKLQTVHSIPFTIYKNEAMQRPVAS

SEQ ID NO: 55730 - protein, 25 aa, synthetic construct
  source 1..25: note = Seed: VKLQTVHSIPLTINKEEALQRPVAS
VKLQTVHSIPFTIYKNEAVQRPVAS

SEQ ID NO: 55731 - protein, 25 aa, synthetic construct
  source 1..25: note = Seed: VKLQTVHSIPLTINKEEALQRPVAS
VKLQTVHSIPFTIYKPEAFQRPVAS

SEQ ID NO: 55732 - protein, 25 aa, synthetic construct
  source 1..25: note = Seed: VKLQTVHSIPLTINKEEALQRPVAS
VKLQTVHSIPFTIYKPEAIQRPVAS

SEQ ID NO: 55733 - protein, 25 aa, synthetic construct
  source 1..25: note = Seed: VKLQTVHSIPLTINKEEALQRPVAS
VKLQTVHSIPFTIYKPEALQRPVAS

SEQ ID NO: 55734 - protein, 25 aa, synthetic construct
  source 1..25: note = Seed: VKLQTVHSIPLTINKEEALQRPVAS
VKLQTVHSIPFTIYKPEAMQRPVAS

SEQ ID NO: 55735 - protein, 25 aa, synthetic construct
  source 1..25: note = Seed: VKLQTVHSIPLTINKEEALQRPVAS
VKLQTVHSIPFTIYKPEAVQRPVAS

SEQ ID NO: 55736 - protein, 25 aa, synthetic construct
  source 1..25: note = Seed: VKLQTVHSIPLTINKEEALQRPVAS
VKLQTVHSIPFTIYKQEAIQRPVAS

SEQ ID NO: 55737 - protein, 25 aa, synthetic construct
  source 1..25: note = Seed: VKLQTVHSIPLTINKEEALQRPVAS
VKLQTVHSIPFTIYKQEALQRPVAS

SEQ ID NO: 55738 - protein, 25 aa, synthetic construct
  source 1..25: note = Seed: VKLQTVHSIPLTINKEEALQRPVAS
VKLQTVHSIPFTIYKQEAVQRPVAS

SEQ ID NO: 55739 - protein, 25 aa, synthetic construct
  source 1..25: note = Seed: VKLQTVHSIPLTINKEEALQRPVAS
VKLQTVHSIPFTIYKREAFQRPVAS

SEQ ID NO: 55740 - protein, 25 aa, synthetic construct
  source 1..25: note = Seed: VKLQTVHSIPLTINKEEALQRPVAS
VKLQTVHSIPFTIYKREAIQRPVAS

SEQ ID NO: 55741 - protein, 25 aa, synthetic construct
  source 1..25: note = Seed: VKLQTVHSIPLTINKEEALQRPVAS
VKLQTVHSIPFTIYKREALQRPVAS

SEQ ID NO: 55742 - protein, 25 aa, synthetic construct
  source 1..25: note = Seed: VKLQTVHSIPLTINKEEALQRPVAS
VKLQTVHSIPFTIYKREAMQRPVAS

SEQ ID NO: 55743 - protein, 25 aa, synthetic construct
  source 1..25: note = Seed: VKLQTVHSIPLTINKEEALQRPVAS
VKLQTVHSIPFTIYKREARQRPVAS

SEQ ID NO: 55744 - protein, 25 aa, synthetic construct
  source 1..25: note = Seed: VKLQTVHSIPLTINKEEALQRPVAS
VKLQTVHSIPFTIYKREAYQRPVAS

SEQ ID NO: 55745 - protein, 25 aa, synthetic construct
  source 1..25: note = Seed: VKLQTVHSIPLTINKEEALQRPVAS
VKLQTVHSIPFTIYKSEAIQRPVAS

SEQ ID NO: 55746 - protein, 25 aa, synthetic construct
  source 1..25: note = Seed: VKLQTVHSIPLTINKEEALQRPVAS
VKLQTVHSIPFTIYKSEALQRPVAS

SEQ ID NO: 55747 - protein, 25 aa, synthetic construct
  source 1..25: note = Seed: VKLQTVHSIPLTINKEEALQRPVAS
VKLQTVHSIPFTIYKSEAMQRPVAS

SEQ ID NO: 55748 - protein, 25 aa, synthetic construct
  source 1..25: note = Seed: VKLQTVHSIPLTINKEEALQRPVAS
VKLQTVHSIPFTIYKSEAVQRPVAS

SEQ ID NO: 55749 - protein, 25 aa, synthetic construct
  source 1..25: note = Seed: VKLQTVHSIPLTINKEEALQRPVAS
VKLQTVHSIPFTIYKSEAYQRPVAS

SEQ ID NO: 55750 - protein, 25 aa, synthetic construct
  source 1..25: note = Seed: VKLQTVHSIPLTINKEEALQRPVAS
VKLQTVHSIPFTIYKTEAFQRPVAS

SEQ ID NO: 55751 - protein, 25 aa, synthetic construct
  source 1..25: note = Seed: VKLQTVHSIPLTINKEEALQRPVAS
VKLQTVHSIPFTIYKTEAIQRPVAS

SEQ ID NO: 55752 - protein, 25 aa, synthetic construct
  source 1..25: note = Seed: VKLQTVHSIPLTINKEEALQRPVAS
VKLQTVHSIPFTIYKTEALQRPVAS

SEQ ID NO: 55753 - protein, 25 aa, synthetic construct
  source 1..25: note = Seed: VKLQTVHSIPLTINKEEALQRPVAS
VKLQTVHSIPFTIYKTEAMQRPVAS

SEQ ID NO: 55754 - protein, 25 aa, synthetic construct
  source 1..25: note = Seed: VKLQTVHSIPLTINKEEALQRPVAS
VKLQTVHSIPFTIYKTEAVQRPVAS

SEQ ID NO: 55755 - protein, 25 aa, synthetic construct
  source 1..25: note = Seed: VKLQTVHSIPLTINKEEALQRPVAS
VKLQTVHSIPFTIYKTEAYQRPVAS

SEQ ID NO: 55756 - protein, 25 aa, synthetic construct
  source 1..25: note = Seed: VKLQTVHSIPLTINKEEALQRPVAS
VKLQTVHSIPFTIYKVEAAQRPVAS

SEQ ID NO: 55757 - protein, 25 aa, synthetic construct
  source 1..25: note = Seed: VKLQTVHSIPLTINKEEALQRPVAS
VKLQTVHSIPFTIYKVEACQRPVAS

SEQ ID NO: 55758 - protein, 25 aa, synthetic construct
  source 1..25: note = Seed: VKLQTVHSIPLTINKEEALQRPVAS
VKLQTVHSIPFTIYKVEADQRPVAS

SEQ ID NO: 55759 - protein, 25 aa, synthetic construct
  source 1..25: note = Seed: VKLQTVHSIPLTINKEEALQRPVAS
VKLQTVHSIPFTIYKVEAEQRPVAS

SEQ ID NO: 55760 - protein, 25 aa, synthetic construct
  source 1..25: note = Seed: VKLQTVHSIPLTINKEEALQRPVAS
VKLQTVHSIPFTIYKVEAFQRPVAS

SEQ ID NO: 55761 - protein, 25 aa, synthetic construct
  source 1..25: note = Seed: VKLQTVHSIPLTINKEEALQRPVAS
VKLQTVHSIPFTIYKVEAGQRPVAS

SEQ ID NO: 55762 - protein, 25 aa, synthetic construct
  source 1..25: note = Seed: VKLQTVHSIPLTINKEEALQRPVAS
VKLQTVHSIPFTIYKVEAHQRPVAS

SEQ ID NO: 55763 - protein, 25 aa, synthetic construct
  source 1..25: note = Seed: VKLQTVHSIPLTINKEEALQRPVAS
VKLQTVHSIPFTIYKVEAIQRPVAS

SEQ ID NO: 55764 - protein, 25 aa, synthetic construct
  source 1..25: note = Seed: VKLQTVHSIPLTINKEEALQRPVAS
VKLQTVHSIPFTIYKVEALQRPVAS

SEQ ID NO: 55765 - protein, 25 aa, synthetic construct
  source 1..25: note = Seed: VKLQTVHSIPLTINKEEALQRPVAS
VKLQTVHSIPFTIYKVEAMQRPVAS

SEQ ID NO: 55766 - protein, 25 aa, synthetic construct
  source 1..25: note = Seed: VKLQTVHSIPLTINKEEALQRPVAS
VKLQTVHSIPFTIYKVEANQRPVAS

SEQ ID NO: 55767 - protein, 25 aa, synthetic construct
  source 1..25: note = Seed: VKLQTVHSIPLTINKEEALQRPVAS
VKLQTVHSIPFTIYKVEAQQRPVAS

SEQ ID NO: 55768 - protein, 25 aa, synthetic construct
  source 1..25: note = Seed: VKLQTVHSIPLTINKEEALQRPVAS
VKLQTVHSIPFTIYKVEARQRPVAS

SEQ ID NO: 55769 - protein, 25 aa, synthetic construct
  source 1..25: note = Seed: VKLQTVHSIPLTINKEEALQRPVAS
VKLQTVHSIPFTIYKVEASQRPVAS

SEQ ID NO: 55770 - protein, 25 aa, synthetic construct
  source 1..25: note = Seed: VKLQTVHSIPLTINKEEALQRPVAS
VKLQTVHSIPFTIYKVEATQRPVAS

SEQ ID NO: 55771 - protein, 25 aa, synthetic construct
  source 1..25: note = Seed: VKLQTVHSIPLTINKEEALQRPVAS
VKLQTVHSIPFTIYKVEAVQRPVAS

SEQ ID NO: 55772 - protein, 25 aa, synthetic construct
  source 1..25: note = Seed: VKLQTVHSIPLTINKEEALQRPVAS
VKLQTVHSIPFTIYKVEAYQRPVAS

SEQ ID NO: 55773 - protein, 25 aa, synthetic construct
  source 1..25: note = Seed: VKLQTVHSIPLTINKEEALQRPVAS
VKLQTVHSIPFTIYKWEAAQRPVAS

SEQ ID NO: 55774 - protein, 25 aa, synthetic construct
  source 1..25: note = Seed: VKLQTVHSIPLTINKEEALQRPVAS
VKLQTVHSIPFTIYKWEACQRPVAS

SEQ ID NO: 55775 - protein, 25 aa, synthetic construct
  source 1..25: note = Seed: VKLQTVHSIPLTINKEEALQRPVAS
VKLQTVHSIPFTIYKWEADQRPVAS

SEQ ID NO: 55776 - protein, 25 aa, synthetic construct
  source 1..25: note = Seed: VKLQTVHSIPLTINKEEALQRPVAS
VKLQTVHSIPFTIYKWEAEQRPVAS

SEQ ID NO: 55777 - protein, 25 aa, synthetic construct
  source 1..25: note = Seed: VKLQTVHSIPLTINKEEALQRPVAS
VKLQTVHSIPFTIYKWEAFQRPVAS

SEQ ID NO: 55778 - protein, 25 aa, synthetic construct
  source 1..25: note = Seed: VKLQTVHSIPLTINKEEALQRPVAS
VKLQTVHSIPFTIYKWEAGQRPVAS

SEQ ID NO: 55779 - protein, 25 aa, synthetic construct
  source 1..25: note = Seed: VKLQTVHSIPLTINKEEALQRPVAS
VKLQTVHSIPFTIYKWEAHQRPVAS

SEQ ID NO: 55780 - protein, 25 aa, synthetic construct
  source 1..25: note = Seed: VKLQTVHSIPLTINKEEALQRPVAS
VKLQTVHSIPFTIYKWEAIQRPVAS

SEQ ID NO: 55781 - protein, 25 aa, synthetic construct
  source 1..25: note = Seed: VKLQTVHSIPLTINKEEALQRPVAS
VKLQTVHSIPFTIYKWEALQRPVAS

SEQ ID NO: 55782 - protein, 25 aa, synthetic construct
  source 1..25: note = Seed: VKLQTVHSIPLTINKEEALQRPVAS
VKLQTVHSIPFTIYKWEAMQRPVAS

SEQ ID NO: 55783 - protein, 25 aa, synthetic construct
  source 1..25: note = Seed: VKLQTVHSIPLTINKEEALQRPVAS
VKLQTVHSIPFTIYKWEANQRPVAS

SEQ ID NO: 55784 - protein, 25 aa, synthetic construct
  source 1..25: note = Seed: VKLQTVHSIPLTINKEEALQRPVAS
VKLQTVHSIPFTIYKWEAPQRPVAS

SEQ ID NO: 55785 - protein, 25 aa, synthetic construct
  source 1..25: note = Seed: VKLQTVHSIPLTINKEEALQRPVAS
VKLQTVHSIPFTIYKWEAQQRPVAS

SEQ ID NO: 55786 - protein, 25 aa, synthetic construct
  source 1..25: note = Seed: VKLQTVHSIPLTINKEEALQRPVAS
VKLQTVHSIPFTIYKWEARQRPVAS

SEQ ID NO: 55787 - protein, 25 aa, synthetic construct
  source 1..25: note = Seed: VKLQTVHSIPLTINKEEALQRPVAS
VKLQTVHSIPFTIYKWEASQRPVAS

SEQ ID NO: 55788 - protein, 25 aa, synthetic construct
  source 1..25: note = Seed: VKLQTVHSIPLTINKEEALQRPVAS
VKLQTVHSIPFTIYKWEATQRPVAS

SEQ ID NO: 55789 - protein, 25 aa, synthetic construct
  source 1..25: note = Seed: VKLQTVHSIPLTINKEEALQRPVAS
VKLQTVHSIPFTIYKWEAVQRPVAS

SEQ ID NO: 55790 - protein, 25 aa, synthetic construct
  source 1..25: note = Seed: VKLQTVHSIPLTINKEEALQRPVAS
VKLQTVHSIPFTIYKWEAYQRPVAS

SEQ ID NO: 55791 - protein, 25 aa, synthetic construct
  source 1..25: note = Seed: VKLQTVHSIPLTINKEEALQRPVAS
VKLQTVHSIPFTIYKYEAAQRPVAS

SEQ ID NO: 55792 - protein, 25 aa, synthetic construct
  source 1..25: note = Seed: VKLQTVHSIPLTINKEEALQRPVAS
VKLQTVHSIPFTIYKYEACQRPVAS

SEQ ID NO: 55793 - protein, 25 aa, synthetic construct
  source 1..25: note = Seed: VKLQTVHSIPLTINKEEALQRPVAS
VKLQTVHSIPFTIYKYEADQRPVAS

SEQ ID NO: 55794 - protein, 25 aa, synthetic construct
  source 1..25: note = Seed: VKLQTVHSIPLTINKEEALQRPVAS
VKLQTVHSIPFTIYKYEAEQRPVAS

SEQ ID NO: 55795 - protein, 25 aa, synthetic construct
  source 1..25: note = Seed: VKLQTVHSIPLTINKEEALQRPVAS
VKLQTVHSIPFTIYKYEAFQRPVAS

SEQ ID NO: 55796 - protein, 25 aa, synthetic construct
  source 1..25: note = Seed: VKLQTVHSIPLTINKEEALQRPVAS
VKLQTVHSIPFTIYKYEAGQRPVAS

SEQ ID NO: 55797 - protein, 25 aa, synthetic construct
  source 1..25: note = Seed: VKLQTVHSIPLTINKEEALQRPVAS
VKLQTVHSIPFTIYKYEAHQRPVAS

SEQ ID NO: 55798 - protein, 25 aa, synthetic construct
  source 1..25: note = Seed: VKLQTVHSIPLTINKEEALQRPVAS
VKLQTVHSIPFTIYKYEAIQRPVAS

SEQ ID NO: 55799 - protein, 25 aa, synthetic construct
  source 1..25: note = Seed: VKLQTVHSIPLTINKEEALQRPVAS
VKLQTVHSIPFTIYKYEAKQRPVAS

SEQ ID NO: 55800 - protein, 25 aa, synthetic construct
  source 1..25: note = Seed: VKLQTVHSIPLTINKEEALQRPVAS
VKLQTVHSIPFTIYKYEALQRPVAS

SEQ ID NO: 55801 - protein, 25 aa, synthetic construct
  source 1..25: note = Seed: VKLQTVHSIPLTINKEEALQRPVAS
VKLQTVHSIPFTIYKYEAMQRPVAS

SEQ ID NO: 55802 - protein, 25 aa, synthetic construct
  source 1..25: note = Seed: VKLQTVHSIPLTINKEEALQRPVAS
VKLQTVHSIPFTIYKYEANQRPVAS

SEQ ID NO: 55803 - protein, 25 aa, synthetic construct
  source 1..25: note = Seed: VKLQTVHSIPLTINKEEALQRPVAS
VKLQTVHSIPFTIYKYEAPQRPVAS

SEQ ID NO: 55804 - protein, 25 aa, synthetic construct
  source 1..25: note = Seed: VKLQTVHSIPLTINKEEALQRPVAS
VKLQTVHSIPFTIYKYEAQQRPVAS

SEQ ID NO: 55805 - protein, 25 aa, synthetic construct
  source 1..25: note = Seed: VKLQTVHSIPLTINKEEALQRPVAS
VKLQTVHSIPFTIYKYEARQRPVAS

SEQ ID NO: 55806 - protein, 25 aa, synthetic construct
  source 1..25: note = Seed: VKLQTVHSIPLTINKEEALQRPVAS
VKLQTVHSIPFTIYKYEASQRPVAS

SEQ ID NO: 55807 - protein, 25 aa, synthetic construct
  source 1..25: note = Seed: VKLQTVHSIPLTINKEEALQRPVAS
VKLQTVHSIPFTIYKYEATQRPVAS

SEQ ID NO: 55808 - protein, 25 aa, synthetic construct
  source 1..25: note = Seed: VKLQTVHSIPLTINKEEALQRPVAS
VKLQTVHSIPFTIYKYEAVQRPVAS

SEQ ID NO: 55809 - protein, 25 aa, synthetic construct
  source 1..25: note = Seed: VKLQTVHSIPLTINKEEALQRPVAS
VKLQTVHSIPFTIYKYEAYQRPVAS

SEQ ID NO: 55810 - protein, 25 aa, synthetic construct
  source 1..25: note = Seed: VKLQTVHSIPLTINKEEALQRPVAS
VKLQTVHSIPHTIFKFEAIQRPVAS

SEQ ID NO: 55811 - protein, 25 aa, synthetic construct
  source 1..25: note = Seed: VKLQTVHSIPLTINKEEALQRPVAS
VKLQTVHSIPHTIFKFEALQRPVAS

SEQ ID NO: 55812 - protein, 25 aa, synthetic construct
  source 1..25: note = Seed: VKLQTVHSIPLTINKEEALQRPVAS
VKLQTVHSIPHTIFKFEAMQRPVAS

SEQ ID NO: 55813 - protein, 25 aa, synthetic construct
  source 1..25: note = Seed: VKLQTVHSIPLTINKEEALQRPVAS
VKLQTVHSIPHTIFKFEAVQRPVAS

SEQ ID NO: 55814 - protein, 25 aa, synthetic construct
  source 1..25: note = Seed: VKLQTVHSIPLTINKEEALQRPVAS
VKLQTVHSIPHTIIKFEAIQRPVAS

SEQ ID NO: 55815 - protein, 25 aa, synthetic construct
  source 1..25: note = Seed: VKLQTVHSIPLTINKEEALQRPVAS
VKLQTVHSIPHTIIKFEALQRPVAS

SEQ ID NO: 55816 - protein, 25 aa, synthetic construct
  source 1..25: note = Seed: VKLQTVHSIPLTINKEEALQRPVAS
VKLQTVHSIPHTILKFEAIQRPVAS

SEQ ID NO: 55817 - protein, 25 aa, synthetic construct
  source 1..25: note = Seed: VKLQTVHSIPLTINKEEALQRPVAS
VKLQTVHSIPHTILKFEALQRPVAS

SEQ ID NO: 55818 - protein, 25 aa, synthetic construct
  source 1..25: note = Seed: VKLQTVHSIPLTINKEEALQRPVAS
VKLQTVHSIPHTIVKFEAFQRPVAS

SEQ ID NO: 55819 - protein, 25 aa, synthetic construct
  source 1..25: note = Seed: VKLQTVHSIPLTINKEEALQRPVAS
VKLQTVHSIPHTIVKFEALQRPVAS

SEQ ID NO: 55820 - protein, 25 aa, synthetic construct
  source 1..25: note = Seed: VKLQTVHSIPLTINKEEALQRPVAS
VKLQTVHSIPITIAKAEAAQRPVAS

SEQ ID NO: 55821 - protein, 25 aa, synthetic construct
  source 1..25: note = Seed: VKLQTVHSIPLTINKEEALQRPVAS
VKLQTVHSIPITIAKAEAFQRPVAS

SEQ ID NO: 55822 - protein, 25 aa, synthetic construct
  source 1..25: note = Seed: VKLQTVHSIPLTINKEEALQRPVAS
VKLQTVHSIPITIAKAEAIQRPVAS

SEQ ID NO: 55823 - protein, 25 aa, synthetic construct
  source 1..25: note = Seed: VKLQTVHSIPLTINKEEALQRPVAS
VKLQTVHSIPITIAKAEALQRPVAS

SEQ ID NO: 55824 - protein, 25 aa, synthetic construct
  source 1..25: note = Seed: VKLQTVHSIPLTINKEEALQRPVAS
VKLQTVHSIPITIAKAEAMQRPVAS

SEQ ID NO: 55825 - protein, 25 aa, synthetic construct
  source 1..25: note = Seed: VKLQTVHSIPLTINKEEALQRPVAS
VKLQTVHSIPITIAKAEASQRPVAS

SEQ ID NO: 55826 - protein, 25 aa, synthetic construct
  source 1..25: note = Seed: VKLQTVHSIPLTINKEEALQRPVAS
VKLQTVHSIPITIAKAEAVQRPVAS

SEQ ID NO: 55827 - protein, 25 aa, synthetic construct
  source 1..25: note = Seed: VKLQTVHSIPLTINKEEALQRPVAS
VKLQTVHSIPITIAKAEAYQRPVAS

SEQ ID NO: 55828 - protein, 25 aa, synthetic construct
  source 1..25: note = Seed: VKLQTVHSIPLTINKEEALQRPVAS
VKLQTVHSIPITIAKDEAAQRPVAS

SEQ ID NO: 55829 - protein, 25 aa, synthetic construct
  source 1..25: note = Seed: VKLQTVHSIPLTINKEEALQRPVAS
VKLQTVHSIPITIAKDEAFQRPVAS

SEQ ID NO: 55830 - protein, 25 aa, synthetic construct
  source 1..25: note = Seed: VKLQTVHSIPLTINKEEALQRPVAS
VKLQTVHSIPITIAKDEAIQRPVAS

SEQ ID NO: 55831 - protein, 25 aa, synthetic construct
  source 1..25: note = Seed: VKLQTVHSIPLTINKEEALQRPVAS
VKLQTVHSIPITIAKDEALQRPVAS

SEQ ID NO: 55832 - protein, 25 aa, synthetic construct
  source 1..25: note = Seed: VKLQTVHSIPLTINKEEALQRPVAS
VKLQTVHSIPITIAKDEAMQRPVAS

SEQ ID NO: 55833 - protein, 25 aa, synthetic construct
  source 1..25: note = Seed: VKLQTVHSIPLTINKEEALQRPVAS
VKLQTVHSIPITIAKDEAVQRPVAS

SEQ ID NO: 55834 - protein, 25 aa, synthetic construct
  source 1..25: note = Seed: VKLQTVHSIPLTINKEEALQRPVAS
VKLQTVHSIPITIAKFEAAQRPVAS

SEQ ID NO: 55835 - protein, 25 aa, synthetic construct
  source 1..25: note = Seed: VKLQTVHSIPLTINKEEALQRPVAS
VKLQTVHSIPITIAKFEAEQRPVAS

SEQ ID NO: 55836 - protein, 25 aa, synthetic construct
  source 1..25: note = Seed: VKLQTVHSIPLTINKEEALQRPVAS
VKLQTVHSIPITIAKFEAFQRPVAS

SEQ ID NO: 55837 - protein, 25 aa, synthetic construct
  source 1..25: note = Seed: VKLQTVHSIPLTINKEEALQRPVAS
VKLQTVHSIPITIAKFEAIQRPVAS

SEQ ID NO: 55838 - protein, 25 aa, synthetic construct
  source 1..25: note = Seed: VKLQTVHSIPLTINKEEALQRPVAS
VKLQTVHSIPITIAKFEALQRPVAS

SEQ ID NO: 55839 - protein, 25 aa, synthetic construct
  source 1..25: note = Seed: VKLQTVHSIPLTINKEEALQRPVAS
VKLQTVHSIPITIAKFEAMQRPVAS

SEQ ID NO: 55840 - protein, 25 aa, synthetic construct
  source 1..25: note = Seed: VKLQTVHSIPLTINKEEALQRPVAS
VKLQTVHSIPITIAKFEANQRPVAS

SEQ ID NO: 55841 - protein, 25 aa, synthetic construct
  source 1..25: note = Seed: VKLQTVHSIPLTINKEEALQRPVAS
VKLQTVHSIPITIAKFEASQRPVAS

SEQ ID NO: 55842 - protein, 25 aa, synthetic construct
  source 1..25: note = Seed: VKLQTVHSIPLTINKEEALQRPVAS
VKLQTVHSIPITIAKFEATQRPVAS

SEQ ID NO: 55843 - protein, 25 aa, synthetic construct
  source 1..25: note = Seed: VKLQTVHSIPLTINKEEALQRPVAS
VKLQTVHSIPITIAKFEAVQRPVAS

SEQ ID NO: 55844 - protein, 25 aa, synthetic construct
  source 1..25: note = Seed: VKLQTVHSIPLTINKEEALQRPVAS
VKLQTVHSIPITIAKFEAYQRPVAS

SEQ ID NO: 55845 - protein, 25 aa, synthetic construct
  source 1..25: note = Seed: VKLQTVHSIPLTINKEEALQRPVAS
VKLQTVHSIPITIAKGEAIQRPVAS

SEQ ID NO: 55846 - protein, 25 aa, synthetic construct
  source 1..25: note = Seed: VKLQTVHSIPLTINKEEALQRPVAS
VKLQTVHSIPITIAKGEAVQRPVAS

SEQ ID NO: 55847 - protein, 25 aa, synthetic construct
  source 1..25: note = Seed: VKLQTVHSIPLTINKEEALQRPVAS
VKLQTVHSIPITIAKIEAAQRPVAS

SEQ ID NO: 55848 - protein, 25 aa, synthetic construct
  source 1..25: note = Seed: VKLQTVHSIPLTINKEEALQRPVAS
VKLQTVHSIPITIAKIEACQRPVAS

SEQ ID NO: 55849 - protein, 25 aa, synthetic construct
  source 1..25: note = Seed: VKLQTVHSIPLTINKEEALQRPVAS
VKLQTVHSIPITIAKIEAFQRPVAS

SEQ ID NO: 55850 - protein, 25 aa, synthetic construct
  source 1..25: note = Seed: VKLQTVHSIPLTINKEEALQRPVAS
VKLQTVHSIPITIAKIEAIQRPVAS

SEQ ID NO: 55851 - protein, 25 aa, synthetic construct
  source 1..25: note = Seed: VKLQTVHSIPLTINKEEALQRPVAS
VKLQTVHSIPITIAKIEALQRPVAS

SEQ ID NO: 55852 - protein, 25 aa, synthetic construct
  source 1..25: note = Seed: VKLQTVHSIPLTINKEEALQRPVAS
VKLQTVHSIPITIAKIEAMQRPVAS

SEQ ID NO: 55853 - protein, 25 aa, synthetic construct
  source 1..25: note = Seed: VKLQTVHSIPLTINKEEALQRPVAS
VKLQTVHSIPITIAKIEANQRPVAS

SEQ ID NO: 55854 - protein, 25 aa, synthetic construct
  source 1..25: note = Seed: VKLQTVHSIPLTINKEEALQRPVAS
VKLQTVHSIPITIAKIEASQRPVAS

SEQ ID NO: 55855 - protein, 25 aa, synthetic construct
  source 1..25: note = Seed: VKLQTVHSIPLTINKEEALQRPVAS
VKLQTVHSIPITIAKIEATQRPVAS

SEQ ID NO: 55856 - protein, 25 aa, synthetic construct
  source 1..25: note = Seed: VKLQTVHSIPLTINKEEALQRPVAS
VKLQTVHSIPITIAKIEAVQRPVAS

SEQ ID NO: 55857 - protein, 25 aa, synthetic construct
  source 1..25: note = Seed: VKLQTVHSIPLTINKEEALQRPVAS
VKLQTVHSIPITIAKIEAYQRPVAS

SEQ ID NO: 55858 - protein, 25 aa, synthetic construct
  source 1..25: note = Seed: VKLQTVHSIPLTINKEEALQRPVAS
VKLQTVHSIPITIAKLEAAQRPVAS

SEQ ID NO: 55859 - protein, 25 aa, synthetic construct
  source 1..25: note = Seed: VKLQTVHSIPLTINKEEALQRPVAS
VKLQTVHSIPITIAKLEAFQRPVAS

SEQ ID NO: 55860 - protein, 25 aa, synthetic construct
  source 1..25: note = Seed: VKLQTVHSIPLTINKEEALQRPVAS
VKLQTVHSIPITIAKLEAIQRPVAS

SEQ ID NO: 55861 - protein, 25 aa, synthetic construct
  source 1..25: note = Seed: VKLQTVHSIPLTINKEEALQRPVAS
VKLQTVHSIPITIAKLEALQRPVAS

SEQ ID NO: 55862 - protein, 25 aa, synthetic construct
  source 1..25: note = Seed: VKLQTVHSIPLTINKEEALQRPVAS
VKLQTVHSIPITIAKLEAMQRPVAS

SEQ ID NO: 55863 - protein, 25 aa, synthetic construct
  source 1..25: note = Seed: VKLQTVHSIPLTINKEEALQRPVAS
VKLQTVHSIPITIAKLEASQRPVAS

SEQ ID NO: 55864 - protein, 25 aa, synthetic construct
  source 1..25: note = Seed: VKLQTVHSIPLTINKEEALQRPVAS
VKLQTVHSIPITIAKLEAVQRPVAS

SEQ ID NO: 55865 - protein, 25 aa, synthetic construct
  source 1..25: note = Seed: VKLQTVHSIPLTINKEEALQRPVAS
VKLQTVHSIPITIAKLEAYQRPVAS

SEQ ID NO: 55866 - protein, 25 aa, synthetic construct
  source 1..25: note = Seed: VKLQTVHSIPLTINKEEALQRPVAS
VKLQTVHSIPITIAKMEAAQRPVAS

SEQ ID NO: 55867 - protein, 25 aa, synthetic construct
  source 1..25: note = Seed: VKLQTVHSIPLTINKEEALQRPVAS
VKLQTVHSIPITIAKMEAFQRPVAS

SEQ ID NO: 55868 - protein, 25 aa, synthetic construct
  source 1..25: note = Seed: VKLQTVHSIPLTINKEEALQRPVAS
VKLQTVHSIPITIAKMEAIQRPVAS

SEQ ID NO: 55869 - protein, 25 aa, synthetic construct
  source 1..25: note = Seed: VKLQTVHSIPLTINKEEALQRPVAS
VKLQTVHSIPITIAKMEALQRPVAS

SEQ ID NO: 55870 - protein, 25 aa, synthetic construct
  source 1..25: note = Seed: VKLQTVHSIPLTINKEEALQRPVAS
VKLQTVHSIPITIAKMEAMQRPVAS

SEQ ID NO: 55871 - protein, 25 aa, synthetic construct
  source 1..25: note = Seed: VKLQTVHSIPLTINKEEALQRPVAS
VKLQTVHSIPITIAKMEAVQRPVAS

SEQ ID NO: 55872 - protein, 25 aa, synthetic construct
  source 1..25: note = Seed: VKLQTVHSIPLTINKEEALQRPVAS
VKLQTVHSIPITIAKMEAYQRPVAS

SEQ ID NO: 55873 - protein, 25 aa, synthetic construct
  source 1..25: note = Seed: VKLQTVHSIPLTINKEEALQRPVAS
VKLQTVHSIPITIAKNEAAQRPVAS

SEQ ID NO: 55874 - protein, 25 aa, synthetic construct
  source 1..25: note = Seed: VKLQTVHSIPLTINKEEALQRPVAS
VKLQTVHSIPITIAKNEAFQRPVAS

SEQ ID NO: 55875 - protein, 25 aa, synthetic construct
  source 1..25: note = Seed: VKLQTVHSIPLTINKEEALQRPVAS
VKLQTVHSIPITIAKNEAIQRPVAS

SEQ ID NO: 55876 - protein, 25 aa, synthetic construct
  source 1..25: note = Seed: VKLQTVHSIPLTINKEEALQRPVAS
VKLQTVHSIPITIAKNEALQRPVAS

SEQ ID NO: 55877 - protein, 25 aa, synthetic construct
  source 1..25: note = Seed: VKLQTVHSIPLTINKEEALQRPVAS
VKLQTVHSIPITIAKNEAMQRPVAS

SEQ ID NO: 55878 - protein, 25 aa, synthetic construct
  source 1..25: note = Seed: VKLQTVHSIPLTINKEEALQRPVAS
VKLQTVHSIPITIAKNEAVQRPVAS

SEQ ID NO: 55879 - protein, 25 aa, synthetic construct
  source 1..25: note = Seed: VKLQTVHSIPLTINKEEALQRPVAS
VKLQTVHSIPITIAKNEAYQRPVAS

SEQ ID NO: 55880 - protein, 25 aa, synthetic construct
  source 1..25: note = Seed: VKLQTVHSIPLTINKEEALQRPVAS
VKLQTVHSIPITIAKPEAIQRPVAS

SEQ ID NO: 55881 - protein, 25 aa, synthetic construct
  source 1..25: note = Seed: VKLQTVHSIPLTINKEEALQRPVAS
VKLQTVHSIPITIAKREAFQRPVAS

SEQ ID NO: 55882 - protein, 25 aa, synthetic construct
  source 1..25: note = Seed: VKLQTVHSIPLTINKEEALQRPVAS
VKLQTVHSIPITIAKREALQRPVAS

SEQ ID NO: 55883 - protein, 25 aa, synthetic construct
  source 1..25: note = Seed: VKLQTVHSIPLTINKEEALQRPVAS
VKLQTVHSIPITIAKREAYQRPVAS

SEQ ID NO: 55884 - protein, 25 aa, synthetic construct
  source 1..25: note = Seed: VKLQTVHSIPLTINKEEALQRPVAS
VKLQTVHSIPITIAKSEAAQRPVAS

SEQ ID NO: 55885 - protein, 25 aa, synthetic construct
  source 1..25: note = Seed: VKLQTVHSIPLTINKEEALQRPVAS
VKLQTVHSIPITIAKSEAFQRPVAS

SEQ ID NO: 55886 - protein, 25 aa, synthetic construct
  source 1..25: note = Seed: VKLQTVHSIPLTINKEEALQRPVAS
VKLQTVHSIPITIAKSEAIQRPVAS

SEQ ID NO: 55887 - protein, 25 aa, synthetic construct
  source 1..25: note = Seed: VKLQTVHSIPLTINKEEALQRPVAS
VKLQTVHSIPITIAKSEALQRPVAS

SEQ ID NO: 55888 - protein, 25 aa, synthetic construct
  source 1..25: note = Seed: VKLQTVHSIPLTINKEEALQRPVAS
VKLQTVHSIPITIAKSEAMQRPVAS

SEQ ID NO: 55889 - protein, 25 aa, synthetic construct
  source 1..25: note = Seed: VKLQTVHSIPLTINKEEALQRPVAS
VKLQTVHSIPITIAKSEAVQRPVAS

SEQ ID NO: 55890 - protein, 25 aa, synthetic construct
  source 1..25: note = Seed: VKLQTVHSIPLTINKEEALQRPVAS
VKLQTVHSIPITIAKTEAIQRPVAS

SEQ ID NO: 55891 - protein, 25 aa, synthetic construct
  source 1..25: note = Seed: VKLQTVHSIPLTINKEEALQRPVAS
VKLQTVHSIPITIAKTEAVQRPVAS

SEQ ID NO: 55892 - protein, 25 aa, synthetic construct
  source 1..25: note = Seed: VKLQTVHSIPLTINKEEALQRPVAS
VKLQTVHSIPITIAKVEAAQRPVAS

SEQ ID NO: 55893 - protein, 25 aa, synthetic construct
  source 1..25: note = Seed: VKLQTVHSIPLTINKEEALQRPVAS
VKLQTVHSIPITIAKVEAFQRPVAS

SEQ ID NO: 55894 - protein, 25 aa, synthetic construct
  source 1..25: note = Seed: VKLQTVHSIPLTINKEEALQRPVAS
VKLQTVHSIPITIAKVEAIQRPVAS

SEQ ID NO: 55895 - protein, 25 aa, synthetic construct
  source 1..25: note = Seed: VKLQTVHSIPLTINKEEALQRPVAS
VKLQTVHSIPITIAKVEALQRPVAS

SEQ ID NO: 55896 - protein, 25 aa, synthetic construct
  source 1..25: note = Seed: VKLQTVHSIPLTINKEEALQRPVAS
VKLQTVHSIPITIAKVEAMQRPVAS

SEQ ID NO: 55897 - protein, 25 aa, synthetic construct
  source 1..25: note = Seed: VKLQTVHSIPLTINKEEALQRPVAS
VKLQTVHSIPITIAKVEASQRPVAS

SEQ ID NO: 55898 - protein, 25 aa, synthetic construct
  source 1..25: note = Seed: VKLQTVHSIPLTINKEEALQRPVAS
VKLQTVHSIPITIAKVEATQRPVAS

SEQ ID NO: 55899 - protein, 25 aa, synthetic construct
  source 1..25: note = Seed: VKLQTVHSIPLTINKEEALQRPVAS
VKLQTVHSIPITIAKVEAVQRPVAS

SEQ ID NO: 55900 - protein, 25 aa, synthetic construct
  source 1..25: note = Seed: VKLQTVHSIPLTINKEEALQRPVAS
VKLQTVHSIPITIAKVEAYQRPVAS

SEQ ID NO: 55901 - protein, 25 aa, synthetic construct
  source 1..25: note = Seed: VKLQTVHSIPLTINKEEALQRPVAS
VKLQTVHSIPITIAKWEAFQRPVAS

SEQ ID NO: 55902 - protein, 25 aa, synthetic construct
  source 1..25: note = Seed: VKLQTVHSIPLTINKEEALQRPVAS
VKLQTVHSIPITIAKWEAIQRPVAS

SEQ ID NO: 55903 - protein, 25 aa, synthetic construct
  source 1..25: note = Seed: VKLQTVHSIPLTINKEEALQRPVAS
VKLQTVHSIPITIAKWEALQRPVAS

SEQ ID NO: 55904 - protein, 25 aa, synthetic construct
  source 1..25: note = Seed: VKLQTVHSIPLTINKEEALQRPVAS
VKLQTVHSIPITIAKWEAVQRPVAS

SEQ ID NO: 55905 - protein, 25 aa, synthetic construct
  source 1..25: note = Seed: VKLQTVHSIPLTINKEEALQRPVAS
VKLQTVHSIPITIAKYEAFQRPVAS

SEQ ID NO: 55906 - protein, 25 aa, synthetic construct
  source 1..25: note = Seed: VKLQTVHSIPLTINKEEALQRPVAS
VKLQTVHSIPITIAKYEAIQRPVAS

SEQ ID NO: 55907 - protein, 25 aa, synthetic construct
  source 1..25: note = Seed: VKLQTVHSIPLTINKEEALQRPVAS
VKLQTVHSIPITIAKYEALQRPVAS

SEQ ID NO: 55908 - protein, 25 aa, synthetic construct
  source 1..25: note = Seed: VKLQTVHSIPLTINKEEALQRPVAS
VKLQTVHSIPITIAKYEAVQRPVAS

SEQ ID NO: 55909 - protein, 25 aa, synthetic construct
  source 1..25: note = Seed: VKLQTVHSIPLTINKEEALQRPVAS
VKLQTVHSIPITICKFEAFQRPVAS

SEQ ID NO: 55910 - protein, 25 aa, synthetic construct
  source 1..25: note = Seed: VKLQTVHSIPLTINKEEALQRPVAS
VKLQTVHSIPITICKFEAIQRPVAS

SEQ ID NO: 55911 - protein, 25 aa, synthetic construct
  source 1..25: note = Seed: VKLQTVHSIPLTINKEEALQRPVAS
VKLQTVHSIPITICKFEALQRPVAS

SEQ ID NO: 55912 - protein, 25 aa, synthetic construct
  source 1..25: note = Seed: VKLQTVHSIPLTINKEEALQRPVAS
VKLQTVHSIPITICKFEAMQRPVAS

SEQ ID NO: 55913 - protein, 25 aa, synthetic construct
  source 1..25: note = Seed: VKLQTVHSIPLTINKEEALQRPVAS
VKLQTVHSIPITICKFEAVQRPVAS

SEQ ID NO: 55914 - protein, 25 aa, synthetic construct
  source 1..25: note = Seed: VKLQTVHSIPLTINKEEALQRPVAS
VKLQTVHSIPITICKYEAFQRPVAS

SEQ ID NO: 55915 - protein, 25 aa, synthetic construct
  source 1..25: note = Seed: VKLQTVHSIPLTINKEEALQRPVAS
VKLQTVHSIPITIDKAEAIQRPVAS

SEQ ID NO: 55916 - protein, 25 aa, synthetic construct
  source 1..25: note = Seed: VKLQTVHSIPLTINKEEALQRPVAS
VKLQTVHSIPITIDKAEAVQRPVAS

SEQ ID NO: 55917 - protein, 25 aa, synthetic construct
  source 1..25: note = Seed: VKLQTVHSIPLTINKEEALQRPVAS
VKLQTVHSIPITIDKFEAFQRPVAS

SEQ ID NO: 55918 - protein, 25 aa, synthetic construct
  source 1..25: note = Seed: VKLQTVHSIPLTINKEEALQRPVAS
VKLQTVHSIPITIDKFEAIQRPVAS

SEQ ID NO: 55919 - protein, 25 aa, synthetic construct
  source 1..25: note = Seed: VKLQTVHSIPLTINKEEALQRPVAS
VKLQTVHSIPITIDKFEALQRPVAS

SEQ ID NO: 55920 - protein, 25 aa, synthetic construct
  source 1..25: note = Seed: VKLQTVHSIPLTINKEEALQRPVAS
VKLQTVHSIPITIDKFEAVQRPVAS

SEQ ID NO: 55921 - protein, 25 aa, synthetic construct
  source 1..25: note = Seed: VKLQTVHSIPLTINKEEALQRPVAS
VKLQTVHSIPITIDKNEAIQRPVAS

SEQ ID NO: 55922 - protein, 25 aa, synthetic construct
  source 1..25: note = Seed: VKLQTVHSIPLTINKEEALQRPVAS
VKLQTVHSIPITIDKSEAIQRPVAS

SEQ ID NO: 55923 - protein, 25 aa, synthetic construct
  source 1..25: note = Seed: VKLQTVHSIPLTINKEEALQRPVAS
VKLQTVHSIPITIEKFEAAQRPVAS

SEQ ID NO: 55924 - protein, 25 aa, synthetic construct
  source 1..25: note = Seed: VKLQTVHSIPLTINKEEALQRPVAS
VKLQTVHSIPITIEKFEAEQRPVAS

SEQ ID NO: 55925 - protein, 25 aa, synthetic construct
  source 1..25: note = Seed: VKLQTVHSIPLTINKEEALQRPVAS
VKLQTVHSIPITIEKFEAFQRPVAS

SEQ ID NO: 55926 - protein, 25 aa, synthetic construct
  source 1..25: note = Seed: VKLQTVHSIPLTINKEEALQRPVAS
VKLQTVHSIPITIEKFEAIQRPVAS

SEQ ID NO: 55927 - protein, 25 aa, synthetic construct
  source 1..25: note = Seed: VKLQTVHSIPLTINKEEALQRPVAS
VKLQTVHSIPITIEKFEALQRPVAS

SEQ ID NO: 55928 - protein, 25 aa, synthetic construct
  source 1..25: note = Seed: VKLQTVHSIPLTINKEEALQRPVAS
VKLQTVHSIPITIEKFEAMQRPVAS

SEQ ID NO: 55929 - protein, 25 aa, synthetic construct
  source 1..25: note = Seed: VKLQTVHSIPLTINKEEALQRPVAS
VKLQTVHSIPITIEKFEANQRPVAS

SEQ ID NO: 55930 - protein, 25 aa, synthetic construct
  source 1..25: note = Seed: VKLQTVHSIPLTINKEEALQRPVAS
VKLQTVHSIPITIEKFEASQRPVAS

SEQ ID NO: 55931 - protein, 25 aa, synthetic construct
  source 1..25: note = Seed: VKLQTVHSIPLTINKEEALQRPVAS
VKLQTVHSIPITIEKFEATQRPVAS

SEQ ID NO: 55932 - protein, 25 aa, synthetic construct
  source 1..25: note = Seed: VKLQTVHSIPLTINKEEALQRPVAS
VKLQTVHSIPITIEKFEAVQRPVAS

SEQ ID NO: 55933 - protein, 25 aa, synthetic construct
  source 1..25: note = Seed: VKLQTVHSIPLTINKEEALQRPVAS
VKLQTVHSIPITIEKFEAYQRPVAS

SEQ ID NO: 55934 - protein, 25 aa, synthetic construct
  source 1..25: note = Seed: VKLQTVHSIPLTINKEEALQRPVAS
VKLQTVHSIPITIEKLEAFQRPVAS

SEQ ID NO: 55935 - protein, 25 aa, synthetic construct
  source 1..25: note = Seed: VKLQTVHSIPLTINKEEALQRPVAS
VKLQTVHSIPITIEKLEAIQRPVAS

SEQ ID NO: 55936 - protein, 25 aa, synthetic construct
  source 1..25: note = Seed: VKLQTVHSIPLTINKEEALQRPVAS
VKLQTVHSIPITIEKLEALQRPVAS

SEQ ID NO: 55937 - protein, 25 aa, synthetic construct
  source 1..25: note = Seed: VKLQTVHSIPLTINKEEALQRPVAS
VKLQTVHSIPITIEKLEAVQRPVAS

SEQ ID NO: 55938 - protein, 25 aa, synthetic construct
  source 1..25: note = Seed: VKLQTVHSIPLTINKEEALQRPVAS
VKLQTVHSIPITIEKWEAIQRPVAS

SEQ ID NO: 55939 - protein, 25 aa, synthetic construct
  source 1..25: note = Seed: VKLQTVHSIPLTINKEEALQRPVAS
VKLQTVHSIPITIEKWEALQRPVAS

SEQ ID NO: 55940 - protein, 25 aa, synthetic construct
  source 1..25: note = Seed: VKLQTVHSIPLTINKEEALQRPVAS
VKLQTVHSIPITIEKYEAFQRPVAS

SEQ ID NO: 55941 - protein, 25 aa, synthetic construct
  source 1..25: note = Seed: VKLQTVHSIPLTINKEEALQRPVAS
VKLQTVHSIPITIEKYEAIQRPVAS

SEQ ID NO: 55942 - protein, 25 aa, synthetic construct
  source 1..25: note = Seed: VKLQTVHSIPLTINKEEALQRPVAS
VKLQTVHSIPITIEKYEALQRPVAS

SEQ ID NO: 55943 - protein, 25 aa, synthetic construct
  source 1..25: note = Seed: VKLQTVHSIPLTINKEEALQRPVAS
VKLQTVHSIPITIEKYEAVQRPVAS

SEQ ID NO: 55944 - protein, 25 aa, synthetic construct
  source 1..25: note = Seed: VKLQTVHSIPLTINKEEALQRPVAS
VKLQTVHSIPITIFKAEAAQRPVAS

SEQ ID NO: 55945 - protein, 25 aa, synthetic construct
  source 1..25: note = Seed: VKLQTVHSIPLTINKEEALQRPVAS
VKLQTVHSIPITIFKAEACQRPVAS

SEQ ID NO: 55946 - protein, 25 aa, synthetic construct
  source 1..25: note = Seed: VKLQTVHSIPLTINKEEALQRPVAS
VKLQTVHSIPITIFKAEADQRPVAS

SEQ ID NO: 55947 - protein, 25 aa, synthetic construct
  source 1..25: note = Seed: VKLQTVHSIPLTINKEEALQRPVAS
VKLQTVHSIPITIFKAEAEQRPVAS

SEQ ID NO: 55948 - protein, 25 aa, synthetic construct
  source 1..25: note = Seed: VKLQTVHSIPLTINKEEALQRPVAS
VKLQTVHSIPITIFKAEAFQRPVAS

SEQ ID NO: 55949 - protein, 25 aa, synthetic construct
  source 1..25: note = Seed: VKLQTVHSIPLTINKEEALQRPVAS
VKLQTVHSIPITIFKAEAGQRPVAS

SEQ ID NO: 55950 - protein, 25 aa, synthetic construct
  source 1..25: note = Seed: VKLQTVHSIPLTINKEEALQRPVAS
VKLQTVHSIPITIFKAEAIQRPVAS

SEQ ID NO: 55951 - protein, 25 aa, synthetic construct
  source 1..25: note = Seed: VKLQTVHSIPLTINKEEALQRPVAS
VKLQTVHSIPITIFKAEALQRPVAS

SEQ ID NO: 55952 - protein, 25 aa, synthetic construct
  source 1..25: note = Seed: VKLQTVHSIPLTINKEEALQRPVAS
VKLQTVHSIPITIFKAEAMQRPVAS

SEQ ID NO: 55953 - protein, 25 aa, synthetic construct
  source 1..25: note = Seed: VKLQTVHSIPLTINKEEALQRPVAS
VKLQTVHSIPITIFKAEANQRPVAS

SEQ ID NO: 55954 - protein, 25 aa, synthetic construct
  source 1..25: note = Seed: VKLQTVHSIPLTINKEEALQRPVAS
VKLQTVHSIPITIFKAEAQQRPVAS

SEQ ID NO: 55955 - protein, 25 aa, synthetic construct
  source 1..25: note = Seed: VKLQTVHSIPLTINKEEALQRPVAS
VKLQTVHSIPITIFKAEARQRPVAS

SEQ ID NO: 55956 - protein, 25 aa, synthetic construct
  source 1..25: note = Seed: VKLQTVHSIPLTINKEEALQRPVAS
VKLQTVHSIPITIFKAEASQRPVAS

SEQ ID NO: 55957 - protein, 25 aa, synthetic construct
  source 1..25: note = Seed: VKLQTVHSIPLTINKEEALQRPVAS
VKLQTVHSIPITIFKAEATQRPVAS

SEQ ID NO: 55958 - protein, 25 aa, synthetic construct
  source 1..25: note = Seed: VKLQTVHSIPLTINKEEALQRPVAS
VKLQTVHSIPITIFKAEAVQRPVAS

SEQ ID NO: 55959 - protein, 25 aa, synthetic construct
  source 1..25: note = Seed: VKLQTVHSIPLTINKEEALQRPVAS
VKLQTVHSIPITIFKAEAWQRPVAS

SEQ ID NO: 55960 - protein, 25 aa, synthetic construct
  source 1..25: note = Seed: VKLQTVHSIPLTINKEEALQRPVAS
VKLQTVHSIPITIFKAEAYQRPVAS

SEQ ID NO: 55961 - protein, 25 aa, synthetic construct
  source 1..25: note = Seed: VKLQTVHSIPLTINKEEALQRPVAS
VKLQTVHSIPITIFKDEAAQRPVAS

SEQ ID NO: 55962 - protein, 25 aa, synthetic construct
  source 1..25: note = Seed: VKLQTVHSIPLTINKEEALQRPVAS
VKLQTVHSIPITIFKDEACQRPVAS

SEQ ID NO: 55963 - protein, 25 aa, synthetic construct
  source 1..25: note = Seed: VKLQTVHSIPLTINKEEALQRPVAS
VKLQTVHSIPITIFKDEADQRPVAS

SEQ ID NO: 55964 - protein, 25 aa, synthetic construct
  source 1..25: note = Seed: VKLQTVHSIPLTINKEEALQRPVAS
VKLQTVHSIPITIFKDEAEQRPVAS

SEQ ID NO: 55965 - protein, 25 aa, synthetic construct
  source 1..25: note = Seed: VKLQTVHSIPLTINKEEALQRPVAS
VKLQTVHSIPITIFKDEAFQRPVAS

SEQ ID NO: 55966 - protein, 25 aa, synthetic construct
  source 1..25: note = Seed: VKLQTVHSIPLTINKEEALQRPVAS
VKLQTVHSIPITIFKDEAGQRPVAS

SEQ ID NO: 55967 - protein, 25 aa, synthetic construct
  source 1..25: note = Seed: VKLQTVHSIPLTINKEEALQRPVAS
VKLQTVHSIPITIFKDEAIQRPVAS

SEQ ID NO: 55968 - protein, 25 aa, synthetic construct
  source 1..25: note = Seed: VKLQTVHSIPLTINKEEALQRPVAS
VKLQTVHSIPITIFKDEALQRPVAS

SEQ ID NO: 55969 - protein, 25 aa, synthetic construct
  source 1..25: note = Seed: VKLQTVHSIPLTINKEEALQRPVAS
VKLQTVHSIPITIFKDEAMQRPVAS

SEQ ID NO: 55970 - protein, 25 aa, synthetic construct
  source 1..25: note = Seed: VKLQTVHSIPLTINKEEALQRPVAS
VKLQTVHSIPITIFKDEANQRPVAS

SEQ ID NO: 55971 - protein, 25 aa, synthetic construct
  source 1..25: note = Seed: VKLQTVHSIPLTINKEEALQRPVAS
VKLQTVHSIPITIFKDEAPQRPVAS

SEQ ID NO: 55972 - protein, 25 aa, synthetic construct
  source 1..25: note = Seed: VKLQTVHSIPLTINKEEALQRPVAS
VKLQTVHSIPITIFKDEAQQRPVAS

SEQ ID NO: 55973 - protein, 25 aa, synthetic construct
  source 1..25: note = Seed: VKLQTVHSIPLTINKEEALQRPVAS
VKLQTVHSIPITIFKDEASQRPVAS

SEQ ID NO: 55974 - protein, 25 aa, synthetic construct
  source 1..25: note = Seed: VKLQTVHSIPLTINKEEALQRPVAS
VKLQTVHSIPITIFKDEATQRPVAS

SEQ ID NO: 55975 - protein, 25 aa, synthetic construct
  source 1..25: note = Seed: VKLQTVHSIPLTINKEEALQRPVAS
VKLQTVHSIPITIFKDEAVQRPVAS

SEQ ID NO: 55976 - protein, 25 aa, synthetic construct
  source 1..25: note = Seed: VKLQTVHSIPLTINKEEALQRPVAS
VKLQTVHSIPITIFKDEAWQRPVAS

SEQ ID NO: 55977 - protein, 25 aa, synthetic construct
  source 1..25: note = Seed: VKLQTVHSIPLTINKEEALQRPVAS
VKLQTVHSIPITIFKDEAYQRPVAS

SEQ ID NO: 55978 - protein, 25 aa, synthetic construct
  source 1..25: note = Seed: VKLQTVHSIPLTINKEEALQRPVAS
VKLQTVHSIPITIFKEEAAQRPVAS

SEQ ID NO: 55979 - protein, 25 aa, synthetic construct
  source 1..25: note = Seed: VKLQTVHSIPLTINKEEALQRPVAS
VKLQTVHSIPITIFKEEAFQRPVAS

SEQ ID NO: 55980 - protein, 25 aa, synthetic construct
  source 1..25: note = Seed: VKLQTVHSIPLTINKEEALQRPVAS
VKLQTVHSIPITIFKEEAIQRPVAS

SEQ ID NO: 55981 - protein, 25 aa, synthetic construct
  source 1..25: note = Seed: VKLQTVHSIPLTINKEEALQRPVAS
VKLQTVHSIPITIFKEEALQRPVAS

SEQ ID NO: 55982 - protein, 25 aa, synthetic construct
  source 1..25: note = Seed: VKLQTVHSIPLTINKEEALQRPVAS
VKLQTVHSIPITIFKEEAVQRPVAS

SEQ ID NO: 55983 - protein, 25 aa, synthetic construct
  source 1..25: note = Seed: VKLQTVHSIPLTINKEEALQRPVAS
VKLQTVHSIPITIFKFEAAQRPVAS

SEQ ID NO: 55984 - protein, 25 aa, synthetic construct
  source 1..25: note = Seed: VKLQTVHSIPLTINKEEALQRPVAS
VKLQTVHSIPITIFKFEADQRPVAS

SEQ ID NO: 55985 - protein, 25 aa, synthetic construct
  source 1..25: note = Seed: VKLQTVHSIPLTINKEEALQRPVAS
VKLQTVHSIPITIFKFEAEQRPVAS

SEQ ID NO: 55986 - protein, 25 aa, synthetic construct
  source 1..25: note = Seed: VKLQTVHSIPLTINKEEALQRPVAS
VKLQTVHSIPITIFKFEAFQRPVAS

SEQ ID NO: 55987 - protein, 25 aa, synthetic construct
  source 1..25: note = Seed: VKLQTVHSIPLTINKEEALQRPVAS
VKLQTVHSIPITIFKFEAHQRPVAS

SEQ ID NO: 55988 - protein, 25 aa, synthetic construct
  source 1..25: note = Seed: VKLQTVHSIPLTINKEEALQRPVAS
VKLQTVHSIPITIFKFEAIQRPVAS

SEQ ID NO: 55989 - protein, 25 aa, synthetic construct
  source 1..25: note = Seed: VKLQTVHSIPLTINKEEALQRPVAS
VKLQTVHSIPITIFKFEAKQRPVAS

SEQ ID NO: 55990 - protein, 25 aa, synthetic construct
  source 1..25: note = Seed: VKLQTVHSIPLTINKEEALQRPVAS
VKLQTVHSIPITIFKFEALQRPVAS

SEQ ID NO: 55991 - protein, 25 aa, synthetic construct
  source 1..25: note = Seed: VKLQTVHSIPLTINKEEALQRPVAS
VKLQTVHSIPITIFKFEAMQRPVAS

SEQ ID NO: 55992 - protein, 25 aa, synthetic construct
  source 1..25: note = Seed: VKLQTVHSIPLTINKEEALQRPVAS
VKLQTVHSIPITIFKFEANQRPVAS

SEQ ID NO: 55993 - protein, 25 aa, synthetic construct
  source 1..25: note = Seed: VKLQTVHSIPLTINKEEALQRPVAS
VKLQTVHSIPITIFKFEAPQRPVAS

SEQ ID NO: 55994 - protein, 25 aa, synthetic construct
  source 1..25: note = Seed: VKLQTVHSIPLTINKEEALQRPVAS
VKLQTVHSIPITIFKFEAQQRPVAS

SEQ ID NO: 55995 - protein, 25 aa, synthetic construct
  source 1..25: note = Seed: VKLQTVHSIPLTINKEEALQRPVAS
VKLQTVHSIPITIFKFEARQRPVAS

SEQ ID NO: 55996 - protein, 25 aa, synthetic construct
  source 1..25: note = Seed: VKLQTVHSIPLTINKEEALQRPVAS
VKLQTVHSIPITIFKFEASQRPVAS

SEQ ID NO: 55997 - protein, 25 aa, synthetic construct
  source 1..25: note = Seed: VKLQTVHSIPLTINKEEALQRPVAS
VKLQTVHSIPITIFKFEATQRPVAS

SEQ ID NO: 55998 - protein, 25 aa, synthetic construct
  source 1..25: note = Seed: VKLQTVHSIPLTINKEEALQRPVAS
VKLQTVHSIPITIFKFEAVQRPVAS

SEQ ID NO: 55999 - protein, 25 aa, synthetic construct
  source 1..25: note = Seed: VKLQTVHSIPLTINKEEALQRPVAS
VKLQTVHSIPITIFKFEAWQRPVAS

SEQ ID NO: 56000 - protein, 25 aa, synthetic construct
  source 1..25: note = Seed: VKLQTVHSIPLTINKEEALQRPVAS
VKLQTVHSIPITIFKFEAYQRPVAS

SEQ ID NO: 56001 - protein, 25 aa, synthetic construct
  source 1..25: note = Seed: VKLQTVHSIPLTINKEEALQRPVAS
VKLQTVHSIPITIFKGEAAQRPVAS

SEQ ID NO: 56002 - protein, 25 aa, synthetic construct
  source 1..25: note = Seed: VKLQTVHSIPLTINKEEALQRPVAS
VKLQTVHSIPITIFKGEAFQRPVAS

SEQ ID NO: 56003 - protein, 25 aa, synthetic construct
  source 1..25: note = Seed: VKLQTVHSIPLTINKEEALQRPVAS
VKLQTVHSIPITIFKGEAIQRPVAS

SEQ ID NO: 56004 - protein, 25 aa, synthetic construct
  source 1..25: note = Seed: VKLQTVHSIPLTINKEEALQRPVAS
VKLQTVHSIPITIFKGEALQRPVAS

SEQ ID NO: 56005 - protein, 25 aa, synthetic construct
  source 1..25: note = Seed: VKLQTVHSIPLTINKEEALQRPVAS
VKLQTVHSIPITIFKGEAMQRPVAS

SEQ ID NO: 56006 - protein, 25 aa, synthetic construct
  source 1..25: note = Seed: VKLQTVHSIPLTINKEEALQRPVAS
VKLQTVHSIPITIFKGEAVQRPVAS

SEQ ID NO: 56007 - protein, 25 aa, synthetic construct
  source 1..25: note = Seed: VKLQTVHSIPLTINKEEALQRPVAS
VKLQTVHSIPITIFKHEAAQRPVAS

SEQ ID NO: 56008 - protein, 25 aa, synthetic construct
  source 1..25: note = Seed: VKLQTVHSIPLTINKEEALQRPVAS
VKLQTVHSIPITIFKHEAFQRPVAS

SEQ ID NO: 56009 - protein, 25 aa, synthetic construct
  source 1..25: note = Seed: VKLQTVHSIPLTINKEEALQRPVAS
VKLQTVHSIPITIFKHEAIQRPVAS

SEQ ID NO: 56010 - protein, 25 aa, synthetic construct
  source 1..25: note = Seed: VKLQTVHSIPLTINKEEALQRPVAS
VKLQTVHSIPITIFKHEALQRPVAS

SEQ ID NO: 56011 - protein, 25 aa, synthetic construct
  source 1..25: note = Seed: VKLQTVHSIPLTINKEEALQRPVAS
VKLQTVHSIPITIFKHEAMQRPVAS

SEQ ID NO: 56012 - protein, 25 aa, synthetic construct
  source 1..25: note = Seed: VKLQTVHSIPLTINKEEALQRPVAS
VKLQTVHSIPITIFKHEARQRPVAS

SEQ ID NO: 56013 - protein, 25 aa, synthetic construct
  source 1..25: note = Seed: VKLQTVHSIPLTINKEEALQRPVAS
VKLQTVHSIPITIFKHEAVQRPVAS

SEQ ID NO: 56014 - protein, 25 aa, synthetic construct
  source 1..25: note = Seed: VKLQTVHSIPLTINKEEALQRPVAS
VKLQTVHSIPITIFKHEAYQRPVAS

SEQ ID NO: 56015 - protein, 25 aa, synthetic construct
  source 1..25: note = Seed: VKLQTVHSIPLTINKEEALQRPVAS
VKLQTVHSIPITIFKIEAAQRPVAS

SEQ ID NO: 56016 - protein, 25 aa, synthetic construct
  source 1..25: note = Seed: VKLQTVHSIPLTINKEEALQRPVAS
VKLQTVHSIPITIFKIEACQRPVAS

SEQ ID NO: 56017 - protein, 25 aa, synthetic construct
  source 1..25: note = Seed: VKLQTVHSIPLTINKEEALQRPVAS
VKLQTVHSIPITIFKIEADQRPVAS

SEQ ID NO: 56018 - protein, 25 aa, synthetic construct
  source 1..25: note = Seed: VKLQTVHSIPLTINKEEALQRPVAS
VKLQTVHSIPITIFKIEAEQRPVAS

SEQ ID NO: 56019 - protein, 25 aa, synthetic construct
  source 1..25: note = Seed: VKLQTVHSIPLTINKEEALQRPVAS
VKLQTVHSIPITIFKIEAFQRPVAS

SEQ ID NO: 56020 - protein, 25 aa, synthetic construct
  source 1..25: note = Seed: VKLQTVHSIPLTINKEEALQRPVAS
VKLQTVHSIPITIFKIEAGQRPVAS

SEQ ID NO: 56021 - protein, 25 aa, synthetic construct
  source 1..25: note = Seed: VKLQTVHSIPLTINKEEALQRPVAS
VKLQTVHSIPITIFKIEAHQRPVAS

SEQ ID NO: 56022 - protein, 25 aa, synthetic construct
  source 1..25: note = Seed: VKLQTVHSIPLTINKEEALQRPVAS
VKLQTVHSIPITIFKIEAIQRPVAS

SEQ ID NO: 56023 - protein, 25 aa, synthetic construct
  source 1..25: note = Seed: VKLQTVHSIPLTINKEEALQRPVAS
VKLQTVHSIPITIFKIEALQRPVAS

SEQ ID NO: 56024 - protein, 25 aa, synthetic construct
  source 1..25: note = Seed: VKLQTVHSIPLTINKEEALQRPVAS
VKLQTVHSIPITIFKIEAMQRPVAS

SEQ ID NO: 56025 - protein, 25 aa, synthetic construct
  source 1..25: note = Seed: VKLQTVHSIPLTINKEEALQRPVAS
VKLQTVHSIPITIFKIEANQRPVAS

SEQ ID NO: 56026 - protein, 25 aa, synthetic construct
  source 1..25: note = Seed: VKLQTVHSIPLTINKEEALQRPVAS
VKLQTVHSIPITIFKIEAPQRPVAS

SEQ ID NO: 56027 - protein, 25 aa, synthetic construct
  source 1..25: note = Seed: VKLQTVHSIPLTINKEEALQRPVAS
VKLQTVHSIPITIFKIEAQQRPVAS

SEQ ID NO: 56028 - protein, 25 aa, synthetic construct
  source 1..25: note = Seed: VKLQTVHSIPLTINKEEALQRPVAS
VKLQTVHSIPITIFKIEARQRPVAS

SEQ ID NO: 56029 - protein, 25 aa, synthetic construct
  source 1..25: note = Seed: VKLQTVHSIPLTINKEEALQRPVAS
VKLQTVHSIPITIFKIEASQRPVAS

SEQ ID NO: 56030 - protein, 25 aa, synthetic construct
  source 1..25: note = Seed: VKLQTVHSIPLTINKEEALQRPVAS
VKLQTVHSIPITIFKIEATQRPVAS

SEQ ID NO: 56031 - protein, 25 aa, synthetic construct
  source 1..25: note = Seed: VKLQTVHSIPLTINKEEALQRPVAS
VKLQTVHSIPITIFKIEAVQRPVAS

SEQ ID NO: 56032 - protein, 25 aa, synthetic construct
  source 1..25: note = Seed: VKLQTVHSIPLTINKEEALQRPVAS
VKLQTVHSIPITIFKIEAWQRPVAS

SEQ ID NO: 56033 - protein, 25 aa, synthetic construct
  source 1..25: note = Seed: VKLQTVHSIPLTINKEEALQRPVAS
VKLQTVHSIPITIFKIEAYQRPVAS

SEQ ID NO: 56034 - protein, 25 aa, synthetic construct
  source 1..25: note = Seed: VKLQTVHSIPLTINKEEALQRPVAS
VKLQTVHSIPITIFKKEAAQRPVAS

SEQ ID NO: 56035 - protein, 25 aa, synthetic construct
  source 1..25: note = Seed: VKLQTVHSIPLTINKEEALQRPVAS
VKLQTVHSIPITIFKKEAFQRPVAS

SEQ ID NO: 56036 - protein, 25 aa, synthetic construct
  source 1..25: note = Seed: VKLQTVHSIPLTINKEEALQRPVAS
VKLQTVHSIPITIFKKEAHQRPVAS

SEQ ID NO: 56037 - protein, 25 aa, synthetic construct
  source 1..25: note = Seed: VKLQTVHSIPLTINKEEALQRPVAS
VKLQTVHSIPITIFKKEAIQRPVAS

SEQ ID NO: 56038 - protein, 25 aa, synthetic construct
  source 1..25: note = Seed: VKLQTVHSIPLTINKEEALQRPVAS
VKLQTVHSIPITIFKKEALQRPVAS

SEQ ID NO: 56039 - protein, 25 aa, synthetic construct
  source 1..25: note = Seed: VKLQTVHSIPLTINKEEALQRPVAS
VKLQTVHSIPITIFKKEAMQRPVAS

SEQ ID NO: 56040 - protein, 25 aa, synthetic construct
  source 1..25: note = Seed: VKLQTVHSIPLTINKEEALQRPVAS
VKLQTVHSIPITIFKKEARQRPVAS

SEQ ID NO: 56041 - protein, 25 aa, synthetic construct
  source 1..25: note = Seed: VKLQTVHSIPLTINKEEALQRPVAS
VKLQTVHSIPITIFKKEAVQRPVAS

SEQ ID NO: 56042 - protein, 25 aa, synthetic construct
  source 1..25: note = Seed: VKLQTVHSIPLTINKEEALQRPVAS
VKLQTVHSIPITIFKKEAYQRPVAS

SEQ ID NO: 56043 - protein, 25 aa, synthetic construct
  source 1..25: note = Seed: VKLQTVHSIPLTINKEEALQRPVAS
VKLQTVHSIPITIFKLEAAQRPVAS

SEQ ID NO: 56044 - protein, 25 aa, synthetic construct
  source 1..25: note = Seed: VKLQTVHSIPLTINKEEALQRPVAS
VKLQTVHSIPITIFKLEADQRPVAS

SEQ ID NO: 56045 - protein, 25 aa, synthetic construct
  source 1..25: note = Seed: VKLQTVHSIPLTINKEEALQRPVAS
VKLQTVHSIPITIFKLEAEQRPVAS

SEQ ID NO: 56046 - protein, 25 aa, synthetic construct
  source 1..25: note = Seed: VKLQTVHSIPLTINKEEALQRPVAS
VKLQTVHSIPITIFKLEAFQRPVAS

SEQ ID NO: 56047 - protein, 25 aa, synthetic construct
  source 1..25: note = Seed: VKLQTVHSIPLTINKEEALQRPVAS
VKLQTVHSIPITIFKLEAGQRPVAS

SEQ ID NO: 56048 - protein, 25 aa, synthetic construct
  source 1..25: note = Seed: VKLQTVHSIPLTINKEEALQRPVAS
VKLQTVHSIPITIFKLEAHQRPVAS

SEQ ID NO: 56049 - protein, 25 aa, synthetic construct
  source 1..25: note = Seed: VKLQTVHSIPLTINKEEALQRPVAS
VKLQTVHSIPITIFKLEAIQRPVAS

SEQ ID NO: 56050 - protein, 25 aa, synthetic construct
  source 1..25: note = Seed: VKLQTVHSIPLTINKEEALQRPVAS
VKLQTVHSIPITIFKLEALQRPVAS

SEQ ID NO: 56051 - protein, 25 aa, synthetic construct
  source 1..25: note = Seed: VKLQTVHSIPLTINKEEALQRPVAS
VKLQTVHSIPITIFKLEAMQRPVAS

SEQ ID NO: 56052 - protein, 25 aa, synthetic construct
  source 1..25: note = Seed: VKLQTVHSIPLTINKEEALQRPVAS
VKLQTVHSIPITIFKLEANQRPVAS

SEQ ID NO: 56053 - protein, 25 aa, synthetic construct
  source 1..25: note = Seed: VKLQTVHSIPLTINKEEALQRPVAS
VKLQTVHSIPITIFKLEAPQRPVAS

SEQ ID NO: 56054 - protein, 25 aa, synthetic construct
  source 1..25: note = Seed: VKLQTVHSIPLTINKEEALQRPVAS
VKLQTVHSIPITIFKLEAQQRPVAS

SEQ ID NO: 56055 - protein, 25 aa, synthetic construct
  source 1..25: note = Seed: VKLQTVHSIPLTINKEEALQRPVAS
VKLQTVHSIPITIFKLEARQRPVAS

SEQ ID NO: 56056 - protein, 25 aa, synthetic construct
  source 1..25: note = Seed: VKLQTVHSIPLTINKEEALQRPVAS
VKLQTVHSIPITIFKLEASQRPVAS

SEQ ID NO: 56057 - protein, 25 aa, synthetic construct
  source 1..25: note = Seed: VKLQTVHSIPLTINKEEALQRPVAS
VKLQTVHSIPITIFKLEATQRPVAS

SEQ ID NO: 56058 - protein, 25 aa, synthetic construct
  source 1..25: note = Seed: VKLQTVHSIPLTINKEEALQRPVAS
VKLQTVHSIPITIFKLEAVQRPVAS

SEQ ID NO: 56059 - protein, 25 aa, synthetic construct
  source 1..25: note = Seed: VKLQTVHSIPLTINKEEALQRPVAS
VKLQTVHSIPITIFKLEAWQRPVAS

SEQ ID NO: 56060 - protein, 25 aa, synthetic construct
  source 1..25: note = Seed: VKLQTVHSIPLTINKEEALQRPVAS
VKLQTVHSIPITIFKLEAYQRPVAS

SEQ ID NO: 56061 - protein, 25 aa, synthetic construct
  source 1..25: note = Seed: VKLQTVHSIPLTINKEEALQRPVAS
VKLQTVHSIPITIFKMEAAQRPVAS

SEQ ID NO: 56062 - protein, 25 aa, synthetic construct
  source 1..25: note = Seed: VKLQTVHSIPLTINKEEALQRPVAS
VKLQTVHSIPITIFKMEADQRPVAS

SEQ ID NO: 56063 - protein, 25 aa, synthetic construct
  source 1..25: note = Seed: VKLQTVHSIPLTINKEEALQRPVAS
VKLQTVHSIPITIFKMEAEQRPVAS

SEQ ID NO: 56064 - protein, 25 aa, synthetic construct
  source 1..25: note = Seed: VKLQTVHSIPLTINKEEALQRPVAS
VKLQTVHSIPITIFKMEAFQRPVAS

SEQ ID NO: 56065 - protein, 25 aa, synthetic construct
  source 1..25: note = Seed: VKLQTVHSIPLTINKEEALQRPVAS
VKLQTVHSIPITIFKMEAGQRPVAS

SEQ ID NO: 56066 - protein, 25 aa, synthetic construct
  source 1..25: note = Seed: VKLQTVHSIPLTINKEEALQRPVAS
VKLQTVHSIPITIFKMEAIQRPVAS

SEQ ID NO: 56067 - protein, 25 aa, synthetic construct
  source 1..25: note = Seed: VKLQTVHSIPLTINKEEALQRPVAS
VKLQTVHSIPITIFKMEALQRPVAS

SEQ ID NO: 56068 - protein, 25 aa, synthetic construct
  source 1..25: note = Seed: VKLQTVHSIPLTINKEEALQRPVAS
VKLQTVHSIPITIFKMEAMQRPVAS

SEQ ID NO: 56069 - protein, 25 aa, synthetic construct
  source 1..25: note = Seed: VKLQTVHSIPLTINKEEALQRPVAS
VKLQTVHSIPITIFKMEANQRPVAS

SEQ ID NO: 56070 - protein, 25 aa, synthetic construct
  source 1..25: note = Seed: VKLQTVHSIPLTINKEEALQRPVAS
VKLQTVHSIPITIFKMEAPQRPVAS

SEQ ID NO: 56071 - protein, 25 aa, synthetic construct
  source 1..25: note = Seed: VKLQTVHSIPLTINKEEALQRPVAS
VKLQTVHSIPITIFKMEAQQRPVAS

SEQ ID NO: 56072 - protein, 25 aa, synthetic construct
  source 1..25: note = Seed: VKLQTVHSIPLTINKEEALQRPVAS
VKLQTVHSIPITIFKMEARQRPVAS

SEQ ID NO: 56073 - protein, 25 aa, synthetic construct
  source 1..25: note = Seed: VKLQTVHSIPLTINKEEALQRPVAS
VKLQTVHSIPITIFKMEASQRPVAS

SEQ ID NO: 56074 - protein, 25 aa, synthetic construct
  source 1..25: note = Seed: VKLQTVHSIPLTINKEEALQRPVAS
VKLQTVHSIPITIFKMEATQRPVAS

SEQ ID NO: 56075 - protein, 25 aa, synthetic construct
  source 1..25: note = Seed: VKLQTVHSIPLTINKEEALQRPVAS
VKLQTVHSIPITIFKMEAVQRPVAS

SEQ ID NO: 56076 - protein, 25 aa, synthetic construct
  source 1..25: note = Seed: VKLQTVHSIPLTINKEEALQRPVAS
VKLQTVHSIPITIFKMEAWQRPVAS

SEQ ID NO: 56077 - protein, 25 aa, synthetic construct
  source 1..25: note = Seed: VKLQTVHSIPLTINKEEALQRPVAS
VKLQTVHSIPITIFKMEAYQRPVAS

SEQ ID NO: 56078 - protein, 25 aa, synthetic construct
  source 1..25: note = Seed: VKLQTVHSIPLTINKEEALQRPVAS
VKLQTVHSIPITIFKNEAAQRPVAS

SEQ ID NO: 56079 - protein, 25 aa, synthetic construct
  source 1..25: note = Seed: VKLQTVHSIPLTINKEEALQRPVAS
VKLQTVHSIPITIFKNEAFQRPVAS

SEQ ID NO: 56080 - protein, 25 aa, synthetic construct
  source 1..25: note = Seed: VKLQTVHSIPLTINKEEALQRPVAS
VKLQTVHSIPITIFKNEAGQRPVAS

SEQ ID NO: 56081 - protein, 25 aa, synthetic construct
  source 1..25: note = Seed: VKLQTVHSIPLTINKEEALQRPVAS
VKLQTVHSIPITIFKNEAIQRPVAS

SEQ ID NO: 56082 - protein, 25 aa, synthetic construct
  source 1..25: note = Seed: VKLQTVHSIPLTINKEEALQRPVAS
VKLQTVHSIPITIFKNEALQRPVAS

SEQ ID NO: 56083 - protein, 25 aa, synthetic construct
  source 1..25: note = Seed: VKLQTVHSIPLTINKEEALQRPVAS
VKLQTVHSIPITIFKNEAMQRPVAS

SEQ ID NO: 56084 - protein, 25 aa, synthetic construct
  source 1..25: note = Seed: VKLQTVHSIPLTINKEEALQRPVAS
VKLQTVHSIPITIFKNEASQRPVAS

SEQ ID NO: 56085 - protein, 25 aa, synthetic construct
  source 1..25: note = Seed: VKLQTVHSIPLTINKEEALQRPVAS
VKLQTVHSIPITIFKNEATQRPVAS

SEQ ID NO: 56086 - protein, 25 aa, synthetic construct
  source 1..25: note = Seed: VKLQTVHSIPLTINKEEALQRPVAS
VKLQTVHSIPITIFKNEAVQRPVAS

SEQ ID NO: 56087 - protein, 25 aa, synthetic construct
  source 1..25: note = Seed: VKLQTVHSIPLTINKEEALQRPVAS
VKLQTVHSIPITIFKNEAYQRPVAS

SEQ ID NO: 56088 - protein, 25 aa, synthetic construct
  source 1..25: note = Seed: VKLQTVHSIPLTINKEEALQRPVAS
VKLQTVHSIPITIFKPEAAQRPVAS

SEQ ID NO: 56089 - protein, 25 aa, synthetic construct
  source 1..25: note = Seed: VKLQTVHSIPLTINKEEALQRPVAS
VKLQTVHSIPITIFKPEAFQRPVAS

SEQ ID NO: 56090 - protein, 25 aa, synthetic construct
  source 1..25: note = Seed: VKLQTVHSIPLTINKEEALQRPVAS
VKLQTVHSIPITIFKPEAIQRPVAS

SEQ ID NO: 56091 - protein, 25 aa, synthetic construct
  source 1..25: note = Seed: VKLQTVHSIPLTINKEEALQRPVAS
VKLQTVHSIPITIFKPEALQRPVAS

SEQ ID NO: 56092 - protein, 25 aa, synthetic construct
  source 1..25: note = Seed: VKLQTVHSIPLTINKEEALQRPVAS
VKLQTVHSIPITIFKPEAMQRPVAS

SEQ ID NO: 56093 - protein, 25 aa, synthetic construct
  source 1..25: note = Seed: VKLQTVHSIPLTINKEEALQRPVAS
VKLQTVHSIPITIFKPEASQRPVAS

SEQ ID NO: 56094 - protein, 25 aa, synthetic construct
  source 1..25: note = Seed: VKLQTVHSIPLTINKEEALQRPVAS
VKLQTVHSIPITIFKPEAVQRPVAS

SEQ ID NO: 56095 - protein, 25 aa, synthetic construct
  source 1..25: note = Seed: VKLQTVHSIPLTINKEEALQRPVAS
VKLQTVHSIPITIFKQEAFQRPVAS

SEQ ID NO: 56096 - protein, 25 aa, synthetic construct
  source 1..25: note = Seed: VKLQTVHSIPLTINKEEALQRPVAS
VKLQTVHSIPITIFKREAAQRPVAS

SEQ ID NO: 56097 - protein, 25 aa, synthetic construct
  source 1..25: note = Seed: VKLQTVHSIPLTINKEEALQRPVAS
VKLQTVHSIPITIFKREAFQRPVAS

SEQ ID NO: 56098 - protein, 25 aa, synthetic construct
  source 1..25: note = Seed: VKLQTVHSIPLTINKEEALQRPVAS
VKLQTVHSIPITIFKREAHQRPVAS

SEQ ID NO: 56099 - protein, 25 aa, synthetic construct
  source 1..25: note = Seed: VKLQTVHSIPLTINKEEALQRPVAS
VKLQTVHSIPITIFKREAIQRPVAS

SEQ ID NO: 56100 - protein, 25 aa, synthetic construct
  source 1..25: note = Seed: VKLQTVHSIPLTINKEEALQRPVAS
VKLQTVHSIPITIFKREAKQRPVAS

SEQ ID NO: 56101 - protein, 25 aa, synthetic construct
  source 1..25: note = Seed: VKLQTVHSIPLTINKEEALQRPVAS
VKLQTVHSIPITIFKREALQRPVAS

SEQ ID NO: 56102 - protein, 25 aa, synthetic construct
  source 1..25: note = Seed: VKLQTVHSIPLTINKEEALQRPVAS
VKLQTVHSIPITIFKREAMQRPVAS

SEQ ID NO: 56103 - protein, 25 aa, synthetic construct
  source 1..25: note = Seed: VKLQTVHSIPLTINKEEALQRPVAS
VKLQTVHSIPITIFKREARQRPVAS

SEQ ID NO: 56104 - protein, 25 aa, synthetic construct
  source 1..25: note = Seed: VKLQTVHSIPLTINKEEALQRPVAS
VKLQTVHSIPITIFKREASQRPVAS

SEQ ID NO: 56105 - protein, 25 aa, synthetic construct
  source 1..25: note = Seed: VKLQTVHSIPLTINKEEALQRPVAS
VKLQTVHSIPITIFKREAVQRPVAS

SEQ ID NO: 56106 - protein, 25 aa, synthetic construct
  source 1..25: note = Seed: VKLQTVHSIPLTINKEEALQRPVAS
VKLQTVHSIPITIFKREAYQRPVAS

SEQ ID NO: 56107 - protein, 25 aa, synthetic construct
  source 1..25: note = Seed: VKLQTVHSIPLTINKEEALQRPVAS
VKLQTVHSIPITIFKSEAAQRPVAS

SEQ ID NO: 56108 - protein, 25 aa, synthetic construct
  source 1..25: note = Seed: VKLQTVHSIPLTINKEEALQRPVAS
VKLQTVHSIPITIFKSEAFQRPVAS

SEQ ID NO: 56109 - protein, 25 aa, synthetic construct
  source 1..25: note = Seed: VKLQTVHSIPLTINKEEALQRPVAS
VKLQTVHSIPITIFKSEAMQRPVAS

SEQ ID NO: 56110 - protein, 25 aa, synthetic construct
  source 1..25: note = Seed: VKLQTVHSIPLTINKEEALQRPVAS
VKLQTVHSIPITIFKSEARQRPVAS

SEQ ID NO: 56111 - protein, 25 aa, synthetic construct
  source 1..25: note = Seed: VKLQTVHSIPLTINKEEALQRPVAS
VKLQTVHSIPITIFKSEASQRPVAS

SEQ ID NO: 56112 - protein, 25 aa, synthetic construct
  source 1..25: note = Seed: VKLQTVHSIPLTINKEEALQRPVAS
VKLQTVHSIPITIFKSEATQRPVAS

SEQ ID NO: 56113 - protein, 25 aa, synthetic construct
  source 1..25: note = Seed: VKLQTVHSIPLTINKEEALQRPVAS
VKLQTVHSIPITIFKSEAVQRPVAS

SEQ ID NO: 56114 - protein, 25 aa, synthetic construct
  source 1..25: note = Seed: VKLQTVHSIPLTINKEEALQRPVAS
VKLQTVHSIPITIFKSEAYQRPVAS

SEQ ID NO: 56115 - protein, 25 aa, synthetic construct
  source 1..25: note = Seed: VKLQTVHSIPLTINKEEALQRPVAS
VKLQTVHSIPITIFKTEAAQRPVAS

SEQ ID NO: 56116 - protein, 25 aa, synthetic construct
  source 1..25: note = Seed: VKLQTVHSIPLTINKEEALQRPVAS
VKLQTVHSIPITIFKTEAFQRPVAS

SEQ ID NO: 56117 - protein, 25 aa, synthetic construct
  source 1..25: note = Seed: VKLQTVHSIPLTINKEEALQRPVAS
VKLQTVHSIPITIFKTEAGQRPVAS

SEQ ID NO: 56118 - protein, 25 aa, synthetic construct
  source 1..25: note = Seed: VKLQTVHSIPLTINKEEALQRPVAS
VKLQTVHSIPITIFKTEAIQRPVAS

SEQ ID NO: 56119 - protein, 25 aa, synthetic construct
  source 1..25: note = Seed: VKLQTVHSIPLTINKEEALQRPVAS
VKLQTVHSIPITIFKTEALQRPVAS

SEQ ID NO: 56120 - protein, 25 aa, synthetic construct
  source 1..25: note = Seed: VKLQTVHSIPLTINKEEALQRPVAS
VKLQTVHSIPITIFKTEAMQRPVAS

SEQ ID NO: 56121 - protein, 25 aa, synthetic construct
  source 1..25: note = Seed: VKLQTVHSIPLTINKEEALQRPVAS
VKLQTVHSIPITIFKTEASQRPVAS

SEQ ID NO: 56122 - protein, 25 aa, synthetic construct
  source 1..25: note = Seed: VKLQTVHSIPLTINKEEALQRPVAS
VKLQTVHSIPITIFKTEATQRPVAS

SEQ ID NO: 56123 - protein, 25 aa, synthetic construct
  source 1..25: note = Seed: VKLQTVHSIPLTINKEEALQRPVAS
VKLQTVHSIPITIFKTEAVQRPVAS

SEQ ID NO: 56124 - protein, 25 aa, synthetic construct
  source 1..25: note = Seed: VKLQTVHSIPLTINKEEALQRPVAS
VKLQTVHSIPITIFKTEAYQRPVAS

SEQ ID NO: 56125 - protein, 25 aa, synthetic construct
  source 1..25: note = Seed: VKLQTVHSIPLTINKEEALQRPVAS
VKLQTVHSIPITIFKVEAAQRPVAS

SEQ ID NO: 56126 - protein, 25 aa, synthetic construct
  source 1..25: note = Seed: VKLQTVHSIPLTINKEEALQRPVAS
VKLQTVHSIPITIFKVEACQRPVAS

SEQ ID NO: 56127 - protein, 25 aa, synthetic construct
  source 1..25: note = Seed: VKLQTVHSIPLTINKEEALQRPVAS
VKLQTVHSIPITIFKVEADQRPVAS

SEQ ID NO: 56128 - protein, 25 aa, synthetic construct
  source 1..25: note = Seed: VKLQTVHSIPLTINKEEALQRPVAS
VKLQTVHSIPITIFKVEAEQRPVAS

SEQ ID NO: 56129 - protein, 25 aa, synthetic construct
  source 1..25: note = Seed: VKLQTVHSIPLTINKEEALQRPVAS
VKLQTVHSIPITIFKVEAFQRPVAS

SEQ ID NO: 56130 - protein, 25 aa, synthetic construct
  source 1..25: note = Seed: VKLQTVHSIPLTINKEEALQRPVAS
VKLQTVHSIPITIFKVEAGQRPVAS

SEQ ID NO: 56131 - protein, 25 aa, synthetic construct
  source 1..25: note = Seed: VKLQTVHSIPLTINKEEALQRPVAS
VKLQTVHSIPITIFKVEAHQRPVAS

SEQ ID NO: 56132 - protein, 25 aa, synthetic construct
  source 1..25: note = Seed: VKLQTVHSIPLTINKEEALQRPVAS
VKLQTVHSIPITIFKVEAIQRPVAS

SEQ ID NO: 56133 - protein, 25 aa, synthetic construct
  source 1..25: note = Seed: VKLQTVHSIPLTINKEEALQRPVAS
VKLQTVHSIPITIFKVEALQRPVAS

SEQ ID NO: 56134 - protein, 25 aa, synthetic construct
  source 1..25: note = Seed: VKLQTVHSIPLTINKEEALQRPVAS
VKLQTVHSIPITIFKVEAMQRPVAS

SEQ ID NO: 56135 - protein, 25 aa, synthetic construct
  source 1..25: note = Seed: VKLQTVHSIPLTINKEEALQRPVAS
VKLQTVHSIPITIFKVEANQRPVAS

SEQ ID NO: 56136 - protein, 25 aa, synthetic construct
  source 1..25: note = Seed: VKLQTVHSIPLTINKEEALQRPVAS
VKLQTVHSIPITIFKVEAPQRPVAS

SEQ ID NO: 56137 - protein, 25 aa, synthetic construct
  source 1..25: note = Seed: VKLQTVHSIPLTINKEEALQRPVAS
VKLQTVHSIPITIFKVEAQQRPVAS

SEQ ID NO: 56138 - protein, 25 aa, synthetic construct
  source 1..25: note = Seed: VKLQTVHSIPLTINKEEALQRPVAS
VKLQTVHSIPITIFKVEARQRPVAS

SEQ ID NO: 56139 - protein, 25 aa, synthetic construct
  source 1..25: note = Seed: VKLQTVHSIPLTINKEEALQRPVAS
VKLQTVHSIPITIFKVEASQRPVAS

SEQ ID NO: 56140 - protein, 25 aa, synthetic construct
  source 1..25: note = Seed: VKLQTVHSIPLTINKEEALQRPVAS
VKLQTVHSIPITIFKVEATQRPVAS

SEQ ID NO: 56141 - protein, 25 aa, synthetic construct
  source 1..25: note = Seed: VKLQTVHSIPLTINKEEALQRPVAS
VKLQTVHSIPITIFKVEAVQRPVAS

SEQ ID NO: 56142 - protein, 25 aa, synthetic construct
  source 1..25: note = Seed: VKLQTVHSIPLTINKEEALQRPVAS
VKLQTVHSIPITIFKVEAYQRPVAS

SEQ ID NO: 56143 - protein, 25 aa, synthetic construct
  source 1..25: note = Seed: VKLQTVHSIPLTINKEEALQRPVAS
VKLQTVHSIPITIFKWEAAQRPVAS

SEQ ID NO: 56144 - protein, 25 aa, synthetic construct
  source 1..25: note = Seed: VKLQTVHSIPLTINKEEALQRPVAS
VKLQTVHSIPITIFKWEAFQRPVAS

SEQ ID NO: 56145 - protein, 25 aa, synthetic construct
  source 1..25: note = Seed: VKLQTVHSIPLTINKEEALQRPVAS
VKLQTVHSIPITIFKWEAIQRPVAS

SEQ ID NO: 56146 - protein, 25 aa, synthetic construct
  source 1..25: note = Seed: VKLQTVHSIPLTINKEEALQRPVAS
VKLQTVHSIPITIFKWEALQRPVAS

SEQ ID NO: 56147 - protein, 25 aa, synthetic construct
  source 1..25: note = Seed: VKLQTVHSIPLTINKEEALQRPVAS
VKLQTVHSIPITIFKWEAMQRPVAS

SEQ ID NO: 56148 - protein, 25 aa, synthetic construct
  source 1..25: note = Seed: VKLQTVHSIPLTINKEEALQRPVAS
VKLQTVHSIPITIFKWEAVQRPVAS

SEQ ID NO: 56149 - protein, 25 aa, synthetic construct
  source 1..25: note = Seed: VKLQTVHSIPLTINKEEALQRPVAS
VKLQTVHSIPITIFKWEAWQRPVAS

SEQ ID NO: 56150 - protein, 25 aa, synthetic construct
  source 1..25: note = Seed: VKLQTVHSIPLTINKEEALQRPVAS
VKLQTVHSIPITIFKWEAYQRPVAS

SEQ ID NO: 56151 - protein, 25 aa, synthetic construct
  source 1..25: note = Seed: VKLQTVHSIPLTINKEEALQRPVAS
VKLQTVHSIPITIFKYEAAQRPVAS

SEQ ID NO: 56152 - protein, 25 aa, synthetic construct
  source 1..25: note = Seed: VKLQTVHSIPLTINKEEALQRPVAS
VKLQTVHSIPITIFKYEAFQRPVAS

SEQ ID NO: 56153 - protein, 25 aa, synthetic construct
  source 1..25: note = Seed: VKLQTVHSIPLTINKEEALQRPVAS
VKLQTVHSIPITIFKYEAIQRPVAS

SEQ ID NO: 56154 - protein, 25 aa, synthetic construct
  source 1..25: note = Seed: VKLQTVHSIPLTINKEEALQRPVAS
VKLQTVHSIPITIFKYEALQRPVAS

SEQ ID NO: 56155 - protein, 25 aa, synthetic construct
  source 1..25: note = Seed: VKLQTVHSIPLTINKEEALQRPVAS
VKLQTVHSIPITIFKYEAMQRPVAS

SEQ ID NO: 56156 - protein, 25 aa, synthetic construct
  source 1..25: note = Seed: VKLQTVHSIPLTINKEEALQRPVAS
VKLQTVHSIPITIFKYEASQRPVAS

SEQ ID NO: 56157 - protein, 25 aa, synthetic construct
  source 1..25: note = Seed: VKLQTVHSIPLTINKEEALQRPVAS
VKLQTVHSIPITIFKYEATQRPVAS

SEQ ID NO: 56158 - protein, 25 aa, synthetic construct
  source 1..25: note = Seed: VKLQTVHSIPLTINKEEALQRPVAS
VKLQTVHSIPITIFKYEAVQRPVAS

SEQ ID NO: 56159 - protein, 25 aa, synthetic construct
  source 1..25: note = Seed: VKLQTVHSIPLTINKEEALQRPVAS
VKLQTVHSIPITIFKYEAWQRPVAS

SEQ ID NO: 56160 - protein, 25 aa, synthetic construct
  source 1..25: note = Seed: VKLQTVHSIPLTINKEEALQRPVAS
VKLQTVHSIPITIFKYEAYQRPVAS

SEQ ID NO: 56161 - protein, 25 aa, synthetic construct
  source 1..25: note = Seed: VKLQTVHSIPLTINKEEALQRPVAS
VKLQTVHSIPITIGKFEAIQRPVAS

SEQ ID NO: 56162 - protein, 25 aa, synthetic construct
  source 1..25: note = Seed: VKLQTVHSIPLTINKEEALQRPVAS
VKLQTVHSIPITIGKFEALQRPVAS

SEQ ID NO: 56163 - protein, 25 aa, synthetic construct
  source 1..25: note = Seed: VKLQTVHSIPLTINKEEALQRPVAS
VKLQTVHSIPITIGKFEAVQRPVAS

SEQ ID NO: 56164 - protein, 25 aa, synthetic construct
  source 1..25: note = Seed: VKLQTVHSIPLTINKEEALQRPVAS
VKLQTVHSIPITIHKAEAFQRPVAS

SEQ ID NO: 56165 - protein, 25 aa, synthetic construct
  source 1..25: note = Seed: VKLQTVHSIPLTINKEEALQRPVAS
VKLQTVHSIPITIHKAEAIQRPVAS

SEQ ID NO: 56166 - protein, 25 aa, synthetic construct
  source 1..25: note = Seed: VKLQTVHSIPLTINKEEALQRPVAS
VKLQTVHSIPITIHKAEALQRPVAS

SEQ ID NO: 56167 - protein, 25 aa, synthetic construct
  source 1..25: note = Seed: VKLQTVHSIPLTINKEEALQRPVAS
VKLQTVHSIPITIHKAEAVQRPVAS

SEQ ID NO: 56168 - protein, 25 aa, synthetic construct
  source 1..25: note = Seed: VKLQTVHSIPLTINKEEALQRPVAS
VKLQTVHSIPITIHKAEAYQRPVAS

SEQ ID NO: 56169 - protein, 25 aa, synthetic construct
  source 1..25: note = Seed: VKLQTVHSIPLTINKEEALQRPVAS
VKLQTVHSIPITIHKFEAAQRPVAS

SEQ ID NO: 56170 - protein, 25 aa, synthetic construct
  source 1..25: note = Seed: VKLQTVHSIPLTINKEEALQRPVAS
VKLQTVHSIPITIHKFEACQRPVAS

SEQ ID NO: 56171 - protein, 25 aa, synthetic construct
  source 1..25: note = Seed: VKLQTVHSIPLTINKEEALQRPVAS
VKLQTVHSIPITIHKFEAEQRPVAS

SEQ ID NO: 56172 - protein, 25 aa, synthetic construct
  source 1..25: note = Seed: VKLQTVHSIPLTINKEEALQRPVAS
VKLQTVHSIPITIHKFEAFQRPVAS

SEQ ID NO: 56173 - protein, 25 aa, synthetic construct
  source 1..25: note = Seed: VKLQTVHSIPLTINKEEALQRPVAS
VKLQTVHSIPITIHKFEAIQRPVAS

SEQ ID NO: 56174 - protein, 25 aa, synthetic construct
  source 1..25: note = Seed: VKLQTVHSIPLTINKEEALQRPVAS
VKLQTVHSIPITIHKFEALQRPVAS

SEQ ID NO: 56175 - protein, 25 aa, synthetic construct
  source 1..25: note = Seed: VKLQTVHSIPLTINKEEALQRPVAS
VKLQTVHSIPITIHKFEAMQRPVAS

SEQ ID NO: 56176 - protein, 25 aa, synthetic construct
  source 1..25: note = Seed: VKLQTVHSIPLTINKEEALQRPVAS
VKLQTVHSIPITIHKFEANQRPVAS

SEQ ID NO: 56177 - protein, 25 aa, synthetic construct
  source 1..25: note = Seed: VKLQTVHSIPLTINKEEALQRPVAS
VKLQTVHSIPITIHKFEASQRPVAS

SEQ ID NO: 56178 - protein, 25 aa, synthetic construct
  source 1..25: note = Seed: VKLQTVHSIPLTINKEEALQRPVAS
VKLQTVHSIPITIHKFEATQRPVAS

SEQ ID NO: 56179 - protein, 25 aa, synthetic construct
  source 1..25: note = Seed: VKLQTVHSIPLTINKEEALQRPVAS
VKLQTVHSIPITIHKFEAVQRPVAS

SEQ ID NO: 56180 - protein, 25 aa, synthetic construct
  source 1..25: note = Seed: VKLQTVHSIPLTINKEEALQRPVAS
VKLQTVHSIPITIHKFEAWQRPVAS

SEQ ID NO: 56181 - protein, 25 aa, synthetic construct
  source 1..25: note = Seed: VKLQTVHSIPLTINKEEALQRPVAS
VKLQTVHSIPITIHKFEAYQRPVAS

SEQ ID NO: 56182 - protein, 25 aa, synthetic construct
  source 1..25: note = Seed: VKLQTVHSIPLTINKEEALQRPVAS
VKLQTVHSIPITIHKGEAIQRPVAS

SEQ ID NO: 56183 - protein, 25 aa, synthetic construct
  source 1..25: note = Seed: VKLQTVHSIPLTINKEEALQRPVAS
VKLQTVHSIPITIHKHEAFQRPVAS

SEQ ID NO: 56184 - protein, 25 aa, synthetic construct
  source 1..25: note = Seed: VKLQTVHSIPLTINKEEALQRPVAS
VKLQTVHSIPITIHKHEALQRPVAS

SEQ ID NO: 56185 - protein, 25 aa, synthetic construct
  source 1..25: note = Seed: VKLQTVHSIPLTINKEEALQRPVAS
VKLQTVHSIPITIHKIEAFQRPVAS

SEQ ID NO: 56186 - protein, 25 aa, synthetic construct
  source 1..25: note = Seed: VKLQTVHSIPLTINKEEALQRPVAS
VKLQTVHSIPITIHKIEAIQRPVAS

SEQ ID NO: 56187 - protein, 25 aa, synthetic construct
  source 1..25: note = Seed: VKLQTVHSIPLTINKEEALQRPVAS
VKLQTVHSIPITIHKIEALQRPVAS

SEQ ID NO: 56188 - protein, 25 aa, synthetic construct
  source 1..25: note = Seed: VKLQTVHSIPLTINKEEALQRPVAS
VKLQTVHSIPITIHKIEAMQRPVAS

SEQ ID NO: 56189 - protein, 25 aa, synthetic construct
  source 1..25: note = Seed: VKLQTVHSIPLTINKEEALQRPVAS
VKLQTVHSIPITIHKIEARQRPVAS

SEQ ID NO: 56190 - protein, 25 aa, synthetic construct
  source 1..25: note = Seed: VKLQTVHSIPLTINKEEALQRPVAS
VKLQTVHSIPITIHKIEAVQRPVAS

SEQ ID NO: 56191 - protein, 25 aa, synthetic construct
  source 1..25: note = Seed: VKLQTVHSIPLTINKEEALQRPVAS
VKLQTVHSIPITIHKIEAYQRPVAS

SEQ ID NO: 56192 - protein, 25 aa, synthetic construct
  source 1..25: note = Seed: VKLQTVHSIPLTINKEEALQRPVAS
VKLQTVHSIPITIHKKEAFQRPVAS

SEQ ID NO: 56193 - protein, 25 aa, synthetic construct
  source 1..25: note = Seed: VKLQTVHSIPLTINKEEALQRPVAS
VKLQTVHSIPITIHKKEAYQRPVAS

SEQ ID NO: 56194 - protein, 25 aa, synthetic construct
  source 1..25: note = Seed: VKLQTVHSIPLTINKEEALQRPVAS
VKLQTVHSIPITIHKLEAFQRPVAS

SEQ ID NO: 56195 - protein, 25 aa, synthetic construct
  source 1..25: note = Seed: VKLQTVHSIPLTINKEEALQRPVAS
VKLQTVHSIPITIHKLEAIQRPVAS

SEQ ID NO: 56196 - protein, 25 aa, synthetic construct
  source 1..25: note = Seed: VKLQTVHSIPLTINKEEALQRPVAS
VKLQTVHSIPITIHKLEALQRPVAS

SEQ ID NO: 56197 - protein, 25 aa, synthetic construct
  source 1..25: note = Seed: VKLQTVHSIPLTINKEEALQRPVAS
VKLQTVHSIPITIHKLEAMQRPVAS

SEQ ID NO: 56198 - protein, 25 aa, synthetic construct
  source 1..25: note = Seed: VKLQTVHSIPLTINKEEALQRPVAS
VKLQTVHSIPITIHKLEAVQRPVAS

SEQ ID NO: 56199 - protein, 25 aa, synthetic construct
  source 1..25: note = Seed: VKLQTVHSIPLTINKEEALQRPVAS
VKLQTVHSIPITIHKMEAFQRPVAS

SEQ ID NO: 56200 - protein, 25 aa, synthetic construct
  source 1..25: note = Seed: VKLQTVHSIPLTINKEEALQRPVAS
VKLQTVHSIPITIHKMEAIQRPVAS

SEQ ID NO: 56201 - protein, 25 aa, synthetic construct
  source 1..25: note = Seed: VKLQTVHSIPLTINKEEALQRPVAS
VKLQTVHSIPITIHKMEAMQRPVAS

SEQ ID NO: 56202 - protein, 25 aa, synthetic construct
  source 1..25: note = Seed: VKLQTVHSIPLTINKEEALQRPVAS
VKLQTVHSIPITIHKNEAAQRPVAS

SEQ ID NO: 56203 - protein, 25 aa, synthetic construct
  source 1..25: note = Seed: VKLQTVHSIPLTINKEEALQRPVAS
VKLQTVHSIPITIHKNEAFQRPVAS

SEQ ID NO: 56204 - protein, 25 aa, synthetic construct
  source 1..25: note = Seed: VKLQTVHSIPLTINKEEALQRPVAS
VKLQTVHSIPITIHKNEAIQRPVAS

SEQ ID NO: 56205 - protein, 25 aa, synthetic construct
  source 1..25: note = Seed: VKLQTVHSIPLTINKEEALQRPVAS
VKLQTVHSIPITIHKNEALQRPVAS

SEQ ID NO: 56206 - protein, 25 aa, synthetic construct
  source 1..25: note = Seed: VKLQTVHSIPLTINKEEALQRPVAS
VKLQTVHSIPITIHKNEAMQRPVAS

SEQ ID NO: 56207 - protein, 25 aa, synthetic construct
  source 1..25: note = Seed: VKLQTVHSIPLTINKEEALQRPVAS
VKLQTVHSIPITIHKNEAVQRPVAS

SEQ ID NO: 56208 - protein, 25 aa, synthetic construct
  source 1..25: note = Seed: VKLQTVHSIPLTINKEEALQRPVAS
VKLQTVHSIPITIHKNEAYQRPVAS

SEQ ID NO: 56209 - protein, 25 aa, synthetic construct
  source 1..25: note = Seed: VKLQTVHSIPLTINKEEALQRPVAS
VKLQTVHSIPITIHKREAFQRPVAS

SEQ ID NO: 56210 - protein, 25 aa, synthetic construct
  source 1..25: note = Seed: VKLQTVHSIPLTINKEEALQRPVAS
VKLQTVHSIPITIHKREAIQRPVAS

SEQ ID NO: 56211 - protein, 25 aa, synthetic construct
  source 1..25: note = Seed: VKLQTVHSIPLTINKEEALQRPVAS
VKLQTVHSIPITIHKREALQRPVAS

SEQ ID NO: 56212 - protein, 25 aa, synthetic construct
  source 1..25: note = Seed: VKLQTVHSIPLTINKEEALQRPVAS
VKLQTVHSIPITIHKREAMQRPVAS

SEQ ID NO: 56213 - protein, 25 aa, synthetic construct
  source 1..25: note = Seed: VKLQTVHSIPLTINKEEALQRPVAS
VKLQTVHSIPITIHKREAVQRPVAS

SEQ ID NO: 56214 - protein, 25 aa, synthetic construct
  source 1..25: note = Seed: VKLQTVHSIPLTINKEEALQRPVAS
VKLQTVHSIPITIHKREAWQRPVAS

SEQ ID NO: 56215 - protein, 25 aa, synthetic construct
  source 1..25: note = Seed: VKLQTVHSIPLTINKEEALQRPVAS
VKLQTVHSIPITIHKREAYQRPVAS

SEQ ID NO: 56216 - protein, 25 aa, synthetic construct
  source 1..25: note = Seed: VKLQTVHSIPLTINKEEALQRPVAS
VKLQTVHSIPITIHKSEAFQRPVAS

SEQ ID NO: 56217 - protein, 25 aa, synthetic construct
  source 1..25: note = Seed: VKLQTVHSIPLTINKEEALQRPVAS
VKLQTVHSIPITIHKSEAIQRPVAS

SEQ ID NO: 56218 - protein, 25 aa, synthetic construct
  source 1..25: note = Seed: VKLQTVHSIPLTINKEEALQRPVAS
VKLQTVHSIPITIHKSEALQRPVAS

SEQ ID NO: 56219 - protein, 25 aa, synthetic construct
  source 1..25: note = Seed: VKLQTVHSIPLTINKEEALQRPVAS
VKLQTVHSIPITIHKSEAVQRPVAS

SEQ ID NO: 56220 - protein, 25 aa, synthetic construct
  source 1..25: note = Seed: VKLQTVHSIPLTINKEEALQRPVAS
VKLQTVHSIPITIHKTEAIQRPVAS

SEQ ID NO: 56221 - protein, 25 aa, synthetic construct
  source 1..25: note = Seed: VKLQTVHSIPLTINKEEALQRPVAS
VKLQTVHSIPITIHKVEAFQRPVAS

SEQ ID NO: 56222 - protein, 25 aa, synthetic construct
  source 1..25: note = Seed: VKLQTVHSIPLTINKEEALQRPVAS
VKLQTVHSIPITIHKVEALQRPVAS

SEQ ID NO: 56223 - protein, 25 aa, synthetic construct
  source 1..25: note = Seed: VKLQTVHSIPLTINKEEALQRPVAS
VKLQTVHSIPITIHKVEARQRPVAS

SEQ ID NO: 56224 - protein, 25 aa, synthetic construct
  source 1..25: note = Seed: VKLQTVHSIPLTINKEEALQRPVAS
VKLQTVHSIPITIHKWEAFQRPVAS

SEQ ID NO: 56225 - protein, 25 aa, synthetic construct
  source 1..25: note = Seed: VKLQTVHSIPLTINKEEALQRPVAS
VKLQTVHSIPITIHKWEAIQRPVAS

SEQ ID NO: 56226 - protein, 25 aa, synthetic construct
  source 1..25: note = Seed: VKLQTVHSIPLTINKEEALQRPVAS
VKLQTVHSIPITIHKWEALQRPVAS

SEQ ID NO: 56227 - protein, 25 aa, synthetic construct
  source 1..25: note = Seed: VKLQTVHSIPLTINKEEALQRPVAS
VKLQTVHSIPITIHKWEAVQRPVAS

SEQ ID NO: 56228 - protein, 25 aa, synthetic construct
  source 1..25: note = Seed: VKLQTVHSIPLTINKEEALQRPVAS
VKLQTVHSIPITIHKYEAFQRPVAS

SEQ ID NO: 56229 - protein, 25 aa, synthetic construct
  source 1..25: note = Seed: VKLQTVHSIPLTINKEEALQRPVAS
VKLQTVHSIPITIHKYEAIQRPVAS

SEQ ID NO: 56230 - protein, 25 aa, synthetic construct
  source 1..25: note = Seed: VKLQTVHSIPLTINKEEALQRPVAS
VKLQTVHSIPITIHKYEALQRPVAS

SEQ ID NO: 56231 - protein, 25 aa, synthetic construct
  source 1..25: note = Seed: VKLQTVHSIPLTINKEEALQRPVAS
VKLQTVHSIPITIIKAEAAQRPVAS

SEQ ID NO: 56232 - protein, 25 aa, synthetic construct
  source 1..25: note = Seed: VKLQTVHSIPLTINKEEALQRPVAS
VKLQTVHSIPITIIKAEACQRPVAS

SEQ ID NO: 56233 - protein, 25 aa, synthetic construct
  source 1..25: note = Seed: VKLQTVHSIPLTINKEEALQRPVAS
VKLQTVHSIPITIIKAEADQRPVAS

SEQ ID NO: 56234 - protein, 25 aa, synthetic construct
  source 1..25: note = Seed: VKLQTVHSIPLTINKEEALQRPVAS
VKLQTVHSIPITIIKAEAFQRPVAS

SEQ ID NO: 56235 - protein, 25 aa, synthetic construct
  source 1..25: note = Seed: VKLQTVHSIPLTINKEEALQRPVAS
VKLQTVHSIPITIIKAEAIQRPVAS

SEQ ID NO: 56236 - protein, 25 aa, synthetic construct
  source 1..25: note = Seed: VKLQTVHSIPLTINKEEALQRPVAS
VKLQTVHSIPITIIKAEALQRPVAS

SEQ ID NO: 56237 - protein, 25 aa, synthetic construct
  source 1..25: note = Seed: VKLQTVHSIPLTINKEEALQRPVAS
VKLQTVHSIPITIIKAEAMQRPVAS

SEQ ID NO: 56238 - protein, 25 aa, synthetic construct
  source 1..25: note = Seed: VKLQTVHSIPLTINKEEALQRPVAS
VKLQTVHSIPITIIKAEANQRPVAS

SEQ ID NO: 56239 - protein, 25 aa, synthetic construct
  source 1..25: note = Seed: VKLQTVHSIPLTINKEEALQRPVAS
VKLQTVHSIPITIIKAEARQRPVAS

SEQ ID NO: 56240 - protein, 25 aa, synthetic construct
  source 1..25: note = Seed: VKLQTVHSIPLTINKEEALQRPVAS
VKLQTVHSIPITIIKAEASQRPVAS

SEQ ID NO: 56241 - protein, 25 aa, synthetic construct
  source 1..25: note = Seed: VKLQTVHSIPLTINKEEALQRPVAS
VKLQTVHSIPITIIKAEATQRPVAS

SEQ ID NO: 56242 - protein, 25 aa, synthetic construct
  source 1..25: note = Seed: VKLQTVHSIPLTINKEEALQRPVAS
VKLQTVHSIPITIIKAEAVQRPVAS

SEQ ID NO: 56243 - protein, 25 aa, synthetic construct
  source 1..25: note = Seed: VKLQTVHSIPLTINKEEALQRPVAS
VKLQTVHSIPITIIKDEAAQRPVAS

SEQ ID NO: 56244 - protein, 25 aa, synthetic construct
  source 1..25: note = Seed: VKLQTVHSIPLTINKEEALQRPVAS
VKLQTVHSIPITIIKDEAFQRPVAS

SEQ ID NO: 56245 - protein, 25 aa, synthetic construct
  source 1..25: note = Seed: VKLQTVHSIPLTINKEEALQRPVAS
VKLQTVHSIPITIIKDEAIQRPVAS

SEQ ID NO: 56246 - protein, 25 aa, synthetic construct
  source 1..25: note = Seed: VKLQTVHSIPLTINKEEALQRPVAS
VKLQTVHSIPITIIKDEALQRPVAS

SEQ ID NO: 56247 - protein, 25 aa, synthetic construct
  source 1..25: note = Seed: VKLQTVHSIPLTINKEEALQRPVAS
VKLQTVHSIPITIIKDEAMQRPVAS

SEQ ID NO: 56248 - protein, 25 aa, synthetic construct
  source 1..25: note = Seed: VKLQTVHSIPLTINKEEALQRPVAS
VKLQTVHSIPITIIKDEASQRPVAS

SEQ ID NO: 56249 - protein, 25 aa, synthetic construct
  source 1..25: note = Seed: VKLQTVHSIPLTINKEEALQRPVAS
VKLQTVHSIPITIIKDEATQRPVAS

SEQ ID NO: 56250 - protein, 25 aa, synthetic construct
  source 1..25: note = Seed: VKLQTVHSIPLTINKEEALQRPVAS
VKLQTVHSIPITIIKDEAVQRPVAS

SEQ ID NO: 56251 - protein, 25 aa, synthetic construct
  source 1..25: note = Seed: VKLQTVHSIPLTINKEEALQRPVAS
VKLQTVHSIPITIIKDEAYQRPVAS

SEQ ID NO: 56252 - protein, 25 aa, synthetic construct
  source 1..25: note = Seed: VKLQTVHSIPLTINKEEALQRPVAS
VKLQTVHSIPITIIKFEAAQRPVAS

SEQ ID NO: 56253 - protein, 25 aa, synthetic construct
  source 1..25: note = Seed: VKLQTVHSIPLTINKEEALQRPVAS
VKLQTVHSIPITIIKFEACQRPVAS

SEQ ID NO: 56254 - protein, 25 aa, synthetic construct
  source 1..25: note = Seed: VKLQTVHSIPLTINKEEALQRPVAS
VKLQTVHSIPITIIKFEADQRPVAS

SEQ ID NO: 56255 - protein, 25 aa, synthetic construct
  source 1..25: note = Seed: VKLQTVHSIPLTINKEEALQRPVAS
VKLQTVHSIPITIIKFEAEQRPVAS

SEQ ID NO: 56256 - protein, 25 aa, synthetic construct
  source 1..25: note = Seed: VKLQTVHSIPLTINKEEALQRPVAS
VKLQTVHSIPITIIKFEAFQRPVAS

SEQ ID NO: 56257 - protein, 25 aa, synthetic construct
  source 1..25: note = Seed: VKLQTVHSIPLTINKEEALQRPVAS
VKLQTVHSIPITIIKFEAGQRPVAS

SEQ ID NO: 56258 - protein, 25 aa, synthetic construct
  source 1..25: note = Seed: VKLQTVHSIPLTINKEEALQRPVAS
VKLQTVHSIPITIIKFEAHQRPVAS

SEQ ID NO: 56259 - protein, 25 aa, synthetic construct
  source 1..25: note = Seed: VKLQTVHSIPLTINKEEALQRPVAS
VKLQTVHSIPITIIKFEAIQRPVAS

SEQ ID NO: 56260 - protein, 25 aa, synthetic construct
  source 1..25: note = Seed: VKLQTVHSIPLTINKEEALQRPVAS
VKLQTVHSIPITIIKFEAKQRPVAS

SEQ ID NO: 56261 - protein, 25 aa, synthetic construct
  source 1..25: note = Seed: VKLQTVHSIPLTINKEEALQRPVAS
VKLQTVHSIPITIIKFEALQRPVAS

SEQ ID NO: 56262 - protein, 25 aa, synthetic construct
  source 1..25: note = Seed: VKLQTVHSIPLTINKEEALQRPVAS
VKLQTVHSIPITIIKFEAMQRPVAS

SEQ ID NO: 56263 - protein, 25 aa, synthetic construct
  source 1..25: note = Seed: VKLQTVHSIPLTINKEEALQRPVAS
VKLQTVHSIPITIIKFEANQRPVAS

SEQ ID NO: 56264 - protein, 25 aa, synthetic construct
  source 1..25: note = Seed: VKLQTVHSIPLTINKEEALQRPVAS
VKLQTVHSIPITIIKFEAPQRPVAS

SEQ ID NO: 56265 - protein, 25 aa, synthetic construct
  source 1..25: note = Seed: VKLQTVHSIPLTINKEEALQRPVAS
VKLQTVHSIPITIIKFEAQQRPVAS

SEQ ID NO: 56266 - protein, 25 aa, synthetic construct
  source 1..25: note = Seed: VKLQTVHSIPLTINKEEALQRPVAS
VKLQTVHSIPITIIKFEARQRPVAS

SEQ ID NO: 56267 - protein, 25 aa, synthetic construct
  source 1..25: note = Seed: VKLQTVHSIPLTINKEEALQRPVAS
VKLQTVHSIPITIIKFEASQRPVAS

SEQ ID NO: 56268 - protein, 25 aa, synthetic construct
  source 1..25: note = Seed: VKLQTVHSIPLTINKEEALQRPVAS
VKLQTVHSIPITIIKFEATQRPVAS

SEQ ID NO: 56269 - protein, 25 aa, synthetic construct
  source 1..25: note = Seed: VKLQTVHSIPLTINKEEALQRPVAS
VKLQTVHSIPITIIKFEAVQRPVAS

SEQ ID NO: 56270 - protein, 25 aa, synthetic construct
  source 1..25: note = Seed: VKLQTVHSIPLTINKEEALQRPVAS
VKLQTVHSIPITIIKFEAWQRPVAS

SEQ ID NO: 56271 - protein, 25 aa, synthetic construct
  source 1..25: note = Seed: VKLQTVHSIPLTINKEEALQRPVAS
VKLQTVHSIPITIIKFEAYQRPVAS

SEQ ID NO: 56272 - protein, 25 aa, synthetic construct
  source 1..25: note = Seed: VKLQTVHSIPLTINKEEALQRPVAS
VKLQTVHSIPITIIKGEAAQRPVAS

SEQ ID NO: 56273 - protein, 25 aa, synthetic construct
  source 1..25: note = Seed: VKLQTVHSIPLTINKEEALQRPVAS
VKLQTVHSIPITIIKGEAIQRPVAS

SEQ ID NO: 56274 - protein, 25 aa, synthetic construct
  source 1..25: note = Seed: VKLQTVHSIPLTINKEEALQRPVAS
VKLQTVHSIPITIIKGEAVQRPVAS

SEQ ID NO: 56275 - protein, 25 aa, synthetic construct
  source 1..25: note = Seed: VKLQTVHSIPLTINKEEALQRPVAS
VKLQTVHSIPITIIKHEAAQRPVAS

SEQ ID NO: 56276 - protein, 25 aa, synthetic construct
  source 1..25: note = Seed: VKLQTVHSIPLTINKEEALQRPVAS
VKLQTVHSIPITIIKHEAFQRPVAS

SEQ ID NO: 56277 - protein, 25 aa, synthetic construct
  source 1..25: note = Seed: VKLQTVHSIPLTINKEEALQRPVAS
VKLQTVHSIPITIIKHEAIQRPVAS

SEQ ID NO: 56278 - protein, 25 aa, synthetic construct
  source 1..25: note = Seed: VKLQTVHSIPLTINKEEALQRPVAS
VKLQTVHSIPITIIKHEALQRPVAS

SEQ ID NO: 56279 - protein, 25 aa, synthetic construct
  source 1..25: note = Seed: VKLQTVHSIPLTINKEEALQRPVAS
VKLQTVHSIPITIIKHEAMQRPVAS

SEQ ID NO: 56280 - protein, 25 aa, synthetic construct
  source 1..25: note = Seed: VKLQTVHSIPLTINKEEALQRPVAS
VKLQTVHSIPITIIKHEARQRPVAS

SEQ ID NO: 56281 - protein, 25 aa, synthetic construct
  source 1..25: note = Seed: VKLQTVHSIPLTINKEEALQRPVAS
VKLQTVHSIPITIIKHEAVQRPVAS

SEQ ID NO: 56282 - protein, 25 aa, synthetic construct
  source 1..25: note = Seed: VKLQTVHSIPLTINKEEALQRPVAS
VKLQTVHSIPITIIKHEAYQRPVAS

SEQ ID NO: 56283 - protein, 25 aa, synthetic construct
  source 1..25: note = Seed: VKLQTVHSIPLTINKEEALQRPVAS
VKLQTVHSIPITIIKIEAAQRPVAS

SEQ ID NO: 56284 - protein, 25 aa, synthetic construct
  source 1..25: note = Seed: VKLQTVHSIPLTINKEEALQRPVAS
VKLQTVHSIPITIIKIEADQRPVAS

SEQ ID NO: 56285 - protein, 25 aa, synthetic construct
  source 1..25: note = Seed: VKLQTVHSIPLTINKEEALQRPVAS
VKLQTVHSIPITIIKIEAEQRPVAS

SEQ ID NO: 56286 - protein, 25 aa, synthetic construct
  source 1..25: note = Seed: VKLQTVHSIPLTINKEEALQRPVAS
VKLQTVHSIPITIIKIEAFQRPVAS

SEQ ID NO: 56287 - protein, 25 aa, synthetic construct
  source 1..25: note = Seed: VKLQTVHSIPLTINKEEALQRPVAS
VKLQTVHSIPITIIKIEAGQRPVAS

SEQ ID NO: 56288 - protein, 25 aa, synthetic construct
  source 1..25: note = Seed: VKLQTVHSIPLTINKEEALQRPVAS
VKLQTVHSIPITIIKIEAIQRPVAS

SEQ ID NO: 56289 - protein, 25 aa, synthetic construct
  source 1..25: note = Seed: VKLQTVHSIPLTINKEEALQRPVAS
VKLQTVHSIPITIIKIEALQRPVAS

SEQ ID NO: 56290 - protein, 25 aa, synthetic construct
  source 1..25: note = Seed: VKLQTVHSIPLTINKEEALQRPVAS
VKLQTVHSIPITIIKIEAMQRPVAS

SEQ ID NO: 56291 - protein, 25 aa, synthetic construct
  source 1..25: note = Seed: VKLQTVHSIPLTINKEEALQRPVAS
VKLQTVHSIPITIIKIEANQRPVAS

SEQ ID NO: 56292 - protein, 25 aa, synthetic construct
  source 1..25: note = Seed: VKLQTVHSIPLTINKEEALQRPVAS
VKLQTVHSIPITIIKIEAQQRPVAS

SEQ ID NO: 56293 - protein, 25 aa, synthetic construct
  source 1..25: note = Seed: VKLQTVHSIPLTINKEEALQRPVAS
VKLQTVHSIPITIIKIEARQRPVAS

SEQ ID NO: 56294 - protein, 25 aa, synthetic construct
  source 1..25: note = Seed: VKLQTVHSIPLTINKEEALQRPVAS
VKLQTVHSIPITIIKIEASQRPVAS

SEQ ID NO: 56295 - protein, 25 aa, synthetic construct
  source 1..25: note = Seed: VKLQTVHSIPLTINKEEALQRPVAS
VKLQTVHSIPITIIKIEATQRPVAS

SEQ ID NO: 56296 - protein, 25 aa, synthetic construct
  source 1..25: note = Seed: VKLQTVHSIPLTINKEEALQRPVAS
VKLQTVHSIPITIIKIEAVQRPVAS

SEQ ID NO: 56297 - protein, 25 aa, synthetic construct
  source 1..25: note = Seed: VKLQTVHSIPLTINKEEALQRPVAS
VKLQTVHSIPITIIKIEAYQRPVAS

SEQ ID NO: 56298 - protein, 25 aa, synthetic construct
  source 1..25: note = Seed: VKLQTVHSIPLTINKEEALQRPVAS
VKLQTVHSIPITIIKKEAAQRPVAS

SEQ ID NO: 56299 - protein, 25 aa, synthetic construct
  source 1..25: note = Seed: VKLQTVHSIPLTINKEEALQRPVAS
VKLQTVHSIPITIIKKEAFQRPVAS

SEQ ID NO: 56300 - protein, 25 aa, synthetic construct
  source 1..25: note = Seed: VKLQTVHSIPLTINKEEALQRPVAS
VKLQTVHSIPITIIKKEAIQRPVAS

SEQ ID NO: 56301 - protein, 25 aa, synthetic construct
  source 1..25: note = Seed: VKLQTVHSIPLTINKEEALQRPVAS
VKLQTVHSIPITIIKKEALQRPVAS

SEQ ID NO: 56302 - protein, 25 aa, synthetic construct
  source 1..25: note = Seed: VKLQTVHSIPLTINKEEALQRPVAS
VKLQTVHSIPITIIKKEAMQRPVAS

SEQ ID NO: 56303 - protein, 25 aa, synthetic construct
  source 1..25: note = Seed: VKLQTVHSIPLTINKEEALQRPVAS
VKLQTVHSIPITIIKKEARQRPVAS

SEQ ID NO: 56304 - protein, 25 aa, synthetic construct
  source 1..25: note = Seed: VKLQTVHSIPLTINKEEALQRPVAS
VKLQTVHSIPITIIKKEAVQRPVAS

SEQ ID NO: 56305 - protein, 25 aa, synthetic construct
  source 1..25: note = Seed: VKLQTVHSIPLTINKEEALQRPVAS
VKLQTVHSIPITIIKKEAYQRPVAS

SEQ ID NO: 56306 - protein, 25 aa, synthetic construct
  source 1..25: note = Seed: VKLQTVHSIPLTINKEEALQRPVAS
VKLQTVHSIPITIIKLEAAQRPVAS

SEQ ID NO: 56307 - protein, 25 aa, synthetic construct
  source 1..25: note = Seed: VKLQTVHSIPLTINKEEALQRPVAS
VKLQTVHSIPITIIKLEADQRPVAS

SEQ ID NO: 56308 - protein, 25 aa, synthetic construct
  source 1..25: note = Seed: VKLQTVHSIPLTINKEEALQRPVAS
VKLQTVHSIPITIIKLEAFQRPVAS

SEQ ID NO: 56309 - protein, 25 aa, synthetic construct
  source 1..25: note = Seed: VKLQTVHSIPLTINKEEALQRPVAS
VKLQTVHSIPITIIKLEAGQRPVAS

SEQ ID NO: 56310 - protein, 25 aa, synthetic construct
  source 1..25: note = Seed: VKLQTVHSIPLTINKEEALQRPVAS
VKLQTVHSIPITIIKLEAIQRPVAS

SEQ ID NO: 56311 - protein, 25 aa, synthetic construct
  source 1..25: note = Seed: VKLQTVHSIPLTINKEEALQRPVAS
VKLQTVHSIPITIIKLEALQRPVAS

SEQ ID NO: 56312 - protein, 25 aa, synthetic construct
  source 1..25: note = Seed: VKLQTVHSIPLTINKEEALQRPVAS
VKLQTVHSIPITIIKLEAMQRPVAS

SEQ ID NO: 56313 - protein, 25 aa, synthetic construct
  source 1..25: note = Seed: VKLQTVHSIPLTINKEEALQRPVAS
VKLQTVHSIPITIIKLEANQRPVAS

SEQ ID NO: 56314 - protein, 25 aa, synthetic construct
  source 1..25: note = Seed: VKLQTVHSIPLTINKEEALQRPVAS
VKLQTVHSIPITIIKLEAQQRPVAS

SEQ ID NO: 56315 - protein, 25 aa, synthetic construct
  source 1..25: note = Seed: VKLQTVHSIPLTINKEEALQRPVAS
VKLQTVHSIPITIIKLEARQRPVAS

SEQ ID NO: 56316 - protein, 25 aa, synthetic construct
  source 1..25: note = Seed: VKLQTVHSIPLTINKEEALQRPVAS
VKLQTVHSIPITIIKLEASQRPVAS

SEQ ID NO: 56317 - protein, 25 aa, synthetic construct
  source 1..25: note = Seed: VKLQTVHSIPLTINKEEALQRPVAS
VKLQTVHSIPITIIKLEATQRPVAS

SEQ ID NO: 56318 - protein, 25 aa, synthetic construct
  source 1..25: note = Seed: VKLQTVHSIPLTINKEEALQRPVAS
VKLQTVHSIPITIIKLEAVQRPVAS

SEQ ID NO: 56319 - protein, 25 aa, synthetic construct
  source 1..25: note = Seed: VKLQTVHSIPLTINKEEALQRPVAS
VKLQTVHSIPITIIKLEAYQRPVAS

SEQ ID NO: 56320 - protein, 25 aa, synthetic construct
  source 1..25: note = Seed: VKLQTVHSIPLTINKEEALQRPVAS
VKLQTVHSIPITIIKMEAAQRPVAS

SEQ ID NO: 56321 - protein, 25 aa, synthetic construct
  source 1..25: note = Seed: VKLQTVHSIPLTINKEEALQRPVAS
VKLQTVHSIPITIIKMEADQRPVAS

SEQ ID NO: 56322 - protein, 25 aa, synthetic construct
  source 1..25: note = Seed: VKLQTVHSIPLTINKEEALQRPVAS
VKLQTVHSIPITIIKMEAFQRPVAS

SEQ ID NO: 56323 - protein, 25 aa, synthetic construct
  source 1..25: note = Seed: VKLQTVHSIPLTINKEEALQRPVAS
VKLQTVHSIPITIIKMEAGQRPVAS

SEQ ID NO: 56324 - protein, 25 aa, synthetic construct
  source 1..25: note = Seed: VKLQTVHSIPLTINKEEALQRPVAS
VKLQTVHSIPITIIKMEAIQRPVAS

SEQ ID NO: 56325 - protein, 25 aa, synthetic construct
  source 1..25: note = Seed: VKLQTVHSIPLTINKEEALQRPVAS
VKLQTVHSIPITIIKMEALQRPVAS

SEQ ID NO: 56326 - protein, 25 aa, synthetic construct
  source 1..25: note = Seed: VKLQTVHSIPLTINKEEALQRPVAS
VKLQTVHSIPITIIKMEAMQRPVAS

SEQ ID NO: 56327 - protein, 25 aa, synthetic construct
  source 1..25: note = Seed: VKLQTVHSIPLTINKEEALQRPVAS
VKLQTVHSIPITIIKMEANQRPVAS

SEQ ID NO: 56328 - protein, 25 aa, synthetic construct
  source 1..25: note = Seed: VKLQTVHSIPLTINKEEALQRPVAS
VKLQTVHSIPITIIKMEARQRPVAS

SEQ ID NO: 56329 - protein, 25 aa, synthetic construct
  source 1..25: note = Seed: VKLQTVHSIPLTINKEEALQRPVAS
VKLQTVHSIPITIIKMEASQRPVAS

SEQ ID NO: 56330 - protein, 25 aa, synthetic construct
  source 1..25: note = Seed: VKLQTVHSIPLTINKEEALQRPVAS
VKLQTVHSIPITIIKMEATQRPVAS

SEQ ID NO: 56331 - protein, 25 aa, synthetic construct
  source 1..25: note = Seed: VKLQTVHSIPLTINKEEALQRPVAS
VKLQTVHSIPITIIKMEAVQRPVAS

SEQ ID NO: 56332 - protein, 25 aa, synthetic construct
  source 1..25: note = Seed: VKLQTVHSIPLTINKEEALQRPVAS
VKLQTVHSIPITIIKMEAYQRPVAS

SEQ ID NO: 56333 - protein, 25 aa, synthetic construct
  source 1..25: note = Seed: VKLQTVHSIPLTINKEEALQRPVAS
VKLQTVHSIPITIIKNEAAQRPVAS

SEQ ID NO: 56334 - protein, 25 aa, synthetic construct
  source 1..25: note = Seed: VKLQTVHSIPLTINKEEALQRPVAS
VKLQTVHSIPITIIKNEAFQRPVAS

SEQ ID NO: 56335 - protein, 25 aa, synthetic construct
  source 1..25: note = Seed: VKLQTVHSIPLTINKEEALQRPVAS
VKLQTVHSIPITIIKNEAIQRPVAS

SEQ ID NO: 56336 - protein, 25 aa, synthetic construct
  source 1..25: note = Seed: VKLQTVHSIPLTINKEEALQRPVAS
VKLQTVHSIPITIIKNEALQRPVAS

SEQ ID NO: 56337 - protein, 25 aa, synthetic construct
  source 1..25: note = Seed: VKLQTVHSIPLTINKEEALQRPVAS
VKLQTVHSIPITIIKNEAMQRPVAS

SEQ ID NO: 56338 - protein, 25 aa, synthetic construct
  source 1..25: note = Seed: VKLQTVHSIPLTINKEEALQRPVAS
VKLQTVHSIPITIIKNEAVQRPVAS

SEQ ID NO: 56339 - protein, 25 aa, synthetic construct
  source 1..25: note = Seed: VKLQTVHSIPLTINKEEALQRPVAS
VKLQTVHSIPITIIKNEAYQRPVAS

SEQ ID NO: 56340 - protein, 25 aa, synthetic construct
  source 1..25: note = Seed: VKLQTVHSIPLTINKEEALQRPVAS
VKLQTVHSIPITIIKPEAAQRPVAS

SEQ ID NO: 56341 - protein, 25 aa, synthetic construct
  source 1..25: note = Seed: VKLQTVHSIPLTINKEEALQRPVAS
VKLQTVHSIPITIIKPEAIQRPVAS

SEQ ID NO: 56342 - protein, 25 aa, synthetic construct
  source 1..25: note = Seed: VKLQTVHSIPLTINKEEALQRPVAS
VKLQTVHSIPITIIKPEALQRPVAS

SEQ ID NO: 56343 - protein, 25 aa, synthetic construct
  source 1..25: note = Seed: VKLQTVHSIPLTINKEEALQRPVAS
VKLQTVHSIPITIIKPEAVQRPVAS

SEQ ID NO: 56344 - protein, 25 aa, synthetic construct
  source 1..25: note = Seed: VKLQTVHSIPLTINKEEALQRPVAS
VKLQTVHSIPITIIKREAAQRPVAS

SEQ ID NO: 56345 - protein, 25 aa, synthetic construct
  source 1..25: note = Seed: VKLQTVHSIPLTINKEEALQRPVAS
VKLQTVHSIPITIIKREAFQRPVAS

SEQ ID NO: 56346 - protein, 25 aa, synthetic construct
  source 1..25: note = Seed: VKLQTVHSIPLTINKEEALQRPVAS
VKLQTVHSIPITIIKREAHQRPVAS

SEQ ID NO: 56347 - protein, 25 aa, synthetic construct
  source 1..25: note = Seed: VKLQTVHSIPLTINKEEALQRPVAS
VKLQTVHSIPITIIKREAIQRPVAS

SEQ ID NO: 56348 - protein, 25 aa, synthetic construct
  source 1..25: note = Seed: VKLQTVHSIPLTINKEEALQRPVAS
VKLQTVHSIPITIIKREAKQRPVAS

SEQ ID NO: 56349 - protein, 25 aa, synthetic construct
  source 1..25: note = Seed: VKLQTVHSIPLTINKEEALQRPVAS
VKLQTVHSIPITIIKREALQRPVAS

SEQ ID NO: 56350 - protein, 25 aa, synthetic construct
  source 1..25: note = Seed: VKLQTVHSIPLTINKEEALQRPVAS
VKLQTVHSIPITIIKREAMQRPVAS

SEQ ID NO: 56351 - protein, 25 aa, synthetic construct
  source 1..25: note = Seed: VKLQTVHSIPLTINKEEALQRPVAS
VKLQTVHSIPITIIKREARQRPVAS

SEQ ID NO: 56352 - protein, 25 aa, synthetic construct
  source 1..25: note = Seed: VKLQTVHSIPLTINKEEALQRPVAS
VKLQTVHSIPITIIKREASQRPVAS

SEQ ID NO: 56353 - protein, 25 aa, synthetic construct
  source 1..25: note = Seed: VKLQTVHSIPLTINKEEALQRPVAS
VKLQTVHSIPITIIKREAVQRPVAS

SEQ ID NO: 56354 - protein, 25 aa, synthetic construct
  source 1..25: note = Seed: VKLQTVHSIPLTINKEEALQRPVAS
VKLQTVHSIPITIIKREAYQRPVAS

SEQ ID NO: 56355 - protein, 25 aa, synthetic construct
  source 1..25: note = Seed: VKLQTVHSIPLTINKEEALQRPVAS
VKLQTVHSIPITIIKSEAAQRPVAS

SEQ ID NO: 56356 - protein, 25 aa, synthetic construct
  source 1..25: note = Seed: VKLQTVHSIPLTINKEEALQRPVAS
VKLQTVHSIPITIIKSEAFQRPVAS

SEQ ID NO: 56357 - protein, 25 aa, synthetic construct
  source 1..25: note = Seed: VKLQTVHSIPLTINKEEALQRPVAS
VKLQTVHSIPITIIKSEAIQRPVAS

SEQ ID NO: 56358 - protein, 25 aa, synthetic construct
  source 1..25: note = Seed: VKLQTVHSIPLTINKEEALQRPVAS
VKLQTVHSIPITIIKSEALQRPVAS

SEQ ID NO: 56359 - protein, 25 aa, synthetic construct
  source 1..25: note = Seed: VKLQTVHSIPLTINKEEALQRPVAS
VKLQTVHSIPITIIKSEAMQRPVAS

SEQ ID NO: 56360 - protein, 25 aa, synthetic construct
  source 1..25: note = Seed: VKLQTVHSIPLTINKEEALQRPVAS
VKLQTVHSIPITIIKSEARQRPVAS

SEQ ID NO: 56361 - protein, 25 aa, synthetic construct
  source 1..25: note = Seed: VKLQTVHSIPLTINKEEALQRPVAS
VKLQTVHSIPITIIKSEAVQRPVAS

SEQ ID NO: 56362 - protein, 25 aa, synthetic construct
  source 1..25: note = Seed: VKLQTVHSIPLTINKEEALQRPVAS
VKLQTVHSIPITIIKSEAYQRPVAS

SEQ ID NO: 56363 - protein, 25 aa, synthetic construct
  source 1..25: note = Seed: VKLQTVHSIPLTINKEEALQRPVAS
VKLQTVHSIPITIIKTEAAQRPVAS

SEQ ID NO: 56364 - protein, 25 aa, synthetic construct
  source 1..25: note = Seed: VKLQTVHSIPLTINKEEALQRPVAS
VKLQTVHSIPITIIKTEAFQRPVAS

SEQ ID NO: 56365 - protein, 25 aa, synthetic construct
  source 1..25: note = Seed: VKLQTVHSIPLTINKEEALQRPVAS
VKLQTVHSIPITIIKTEAIQRPVAS

SEQ ID NO: 56366 - protein, 25 aa, synthetic construct
  source 1..25: note = Seed: VKLQTVHSIPLTINKEEALQRPVAS
VKLQTVHSIPITIIKTEALQRPVAS

SEQ ID NO: 56367 - protein, 25 aa, synthetic construct
  source 1..25: note = Seed: VKLQTVHSIPLTINKEEALQRPVAS
VKLQTVHSIPITIIKTEAMQRPVAS

SEQ ID NO: 56368 - protein, 25 aa, synthetic construct
  source 1..25: note = Seed: VKLQTVHSIPLTINKEEALQRPVAS
VKLQTVHSIPITIIKTEAVQRPVAS

SEQ ID NO: 56369 - protein, 25 aa, synthetic construct
  source 1..25: note = Seed: VKLQTVHSIPLTINKEEALQRPVAS
VKLQTVHSIPITIIKTEAYQRPVAS

SEQ ID NO: 56370 - protein, 25 aa, synthetic construct
  source 1..25: note = Seed: VKLQTVHSIPLTINKEEALQRPVAS
VKLQTVHSIPITIIKVEAAQRPVAS

SEQ ID NO: 56371 - protein, 25 aa, synthetic construct
  source 1..25: note = Seed: VKLQTVHSIPLTINKEEALQRPVAS
VKLQTVHSIPITIIKVEADQRPVAS

SEQ ID NO: 56372 - protein, 25 aa, synthetic construct
  source 1..25: note = Seed: VKLQTVHSIPLTINKEEALQRPVAS
VKLQTVHSIPITIIKVEAFQRPVAS

SEQ ID NO: 56373 - protein, 25 aa, synthetic construct
  source 1..25: note = Seed: VKLQTVHSIPLTINKEEALQRPVAS
VKLQTVHSIPITIIKVEAGQRPVAS

SEQ ID NO: 56374 - protein, 25 aa, synthetic construct
  source 1..25: note = Seed: VKLQTVHSIPLTINKEEALQRPVAS
VKLQTVHSIPITIIKVEAIQRPVAS

SEQ ID NO: 56375 - protein, 25 aa, synthetic construct
  source 1..25: note = Seed: VKLQTVHSIPLTINKEEALQRPVAS
VKLQTVHSIPITIIKVEALQRPVAS

SEQ ID NO: 56376 - protein, 25 aa, synthetic construct
  source 1..25: note = Seed: VKLQTVHSIPLTINKEEALQRPVAS
VKLQTVHSIPITIIKVEAMQRPVAS

SEQ ID NO: 56377 - protein, 25 aa, synthetic construct
  source 1..25: note = Seed: VKLQTVHSIPLTINKEEALQRPVAS
VKLQTVHSIPITIIKVEANQRPVAS

SEQ ID NO: 56378 - protein, 25 aa, synthetic construct
  source 1..25: note = Seed: VKLQTVHSIPLTINKEEALQRPVAS
VKLQTVHSIPITIIKVEAQQRPVAS

SEQ ID NO: 56379 - protein, 25 aa, synthetic construct
  source 1..25: note = Seed: VKLQTVHSIPLTINKEEALQRPVAS
VKLQTVHSIPITIIKVEARQRPVAS

SEQ ID NO: 56380 - protein, 25 aa, synthetic construct
  source 1..25: note = Seed: VKLQTVHSIPLTINKEEALQRPVAS
VKLQTVHSIPITIIKVEASQRPVAS

SEQ ID NO: 56381 - protein, 25 aa, synthetic construct
  source 1..25: note = Seed: VKLQTVHSIPLTINKEEALQRPVAS
VKLQTVHSIPITIIKVEATQRPVAS

SEQ ID NO: 56382 - protein, 25 aa, synthetic construct
  source 1..25: note = Seed: VKLQTVHSIPLTINKEEALQRPVAS
VKLQTVHSIPITIIKVEAVQRPVAS

SEQ ID NO: 56383 - protein, 25 aa, synthetic construct
  source 1..25: note = Seed: VKLQTVHSIPLTINKEEALQRPVAS
VKLQTVHSIPITIIKVEAYQRPVAS

SEQ ID NO: 56384 - protein, 25 aa, synthetic construct
  source 1..25: note = Seed: VKLQTVHSIPLTINKEEALQRPVAS
VKLQTVHSIPITIIKWEAAQRPVAS

SEQ ID NO: 56385 - protein, 25 aa, synthetic construct
  source 1..25: note = Seed: VKLQTVHSIPLTINKEEALQRPVAS
VKLQTVHSIPITIIKWEAFQRPVAS

SEQ ID NO: 56386 - protein, 25 aa, synthetic construct
  source 1..25: note = Seed: VKLQTVHSIPLTINKEEALQRPVAS
VKLQTVHSIPITIIKWEAIQRPVAS

SEQ ID NO: 56387 - protein, 25 aa, synthetic construct
  source 1..25: note = Seed: VKLQTVHSIPLTINKEEALQRPVAS
VKLQTVHSIPITIIKWEALQRPVAS

SEQ ID NO: 56388 - protein, 25 aa, synthetic construct
  source 1..25: note = Seed: VKLQTVHSIPLTINKEEALQRPVAS
VKLQTVHSIPITIIKWEAMQRPVAS

SEQ ID NO: 56389 - protein, 25 aa, synthetic construct
  source 1..25: note = Seed: VKLQTVHSIPLTINKEEALQRPVAS
VKLQTVHSIPITIIKWEAVQRPVAS

SEQ ID NO: 56390 - protein, 25 aa, synthetic construct
  source 1..25: note = Seed: VKLQTVHSIPLTINKEEALQRPVAS
VKLQTVHSIPITIIKWEAYQRPVAS

SEQ ID NO: 56391 - protein, 25 aa, synthetic construct
  source 1..25: note = Seed: VKLQTVHSIPLTINKEEALQRPVAS
VKLQTVHSIPITIIKYEAAQRPVAS

SEQ ID NO: 56392 - protein, 25 aa, synthetic construct
  source 1..25: note = Seed: VKLQTVHSIPLTINKEEALQRPVAS
VKLQTVHSIPITIIKYEAFQRPVAS

SEQ ID NO: 56393 - protein, 25 aa, synthetic construct
  source 1..25: note = Seed: VKLQTVHSIPLTINKEEALQRPVAS
VKLQTVHSIPITIIKYEAIQRPVAS

SEQ ID NO: 56394 - protein, 25 aa, synthetic construct
  source 1..25: note = Seed: VKLQTVHSIPLTINKEEALQRPVAS
VKLQTVHSIPITIIKYEALQRPVAS

SEQ ID NO: 56395 - protein, 25 aa, synthetic construct
  source 1..25: note = Seed: VKLQTVHSIPLTINKEEALQRPVAS
VKLQTVHSIPITIIKYEAMQRPVAS

SEQ ID NO: 56396 - protein, 25 aa, synthetic construct
  source 1..25: note = Seed: VKLQTVHSIPLTINKEEALQRPVAS
VKLQTVHSIPITIIKYEATQRPVAS

SEQ ID NO: 56397 - protein, 25 aa, synthetic construct
  source 1..25: note = Seed: VKLQTVHSIPLTINKEEALQRPVAS
VKLQTVHSIPITIIKYEAVQRPVAS

SEQ ID NO: 56398 - protein, 25 aa, synthetic construct
  source 1..25: note = Seed: VKLQTVHSIPLTINKEEALQRPVAS
VKLQTVHSIPITIIKYEAWQRPVAS

SEQ ID NO: 56399 - protein, 25 aa, synthetic construct
  source 1..25: note = Seed: VKLQTVHSIPLTINKEEALQRPVAS
VKLQTVHSIPITIIKYEAYQRPVAS

SEQ ID NO: 56400 - protein, 25 aa, synthetic construct
  source 1..25: note = Seed: VKLQTVHSIPLTINKEEALQRPVAS
VKLQTVHSIPITIKKFEAFQRPVAS

SEQ ID NO: 56401 - protein, 25 aa, synthetic construct
  source 1..25: note = Seed: VKLQTVHSIPLTINKEEALQRPVAS
VKLQTVHSIPITIKKFEAIQRPVAS

SEQ ID NO: 56402 - protein, 25 aa, synthetic construct
  source 1..25: note = Seed: VKLQTVHSIPLTINKEEALQRPVAS
VKLQTVHSIPITIKKFEALQRPVAS

SEQ ID NO: 56403 - protein, 25 aa, synthetic construct
  source 1..25: note = Seed: VKLQTVHSIPLTINKEEALQRPVAS
VKLQTVHSIPITIKKFEAMQRPVAS

SEQ ID NO: 56404 - protein, 25 aa, synthetic construct
  source 1..25: note = Seed: VKLQTVHSIPLTINKEEALQRPVAS
VKLQTVHSIPITIKKFEAVQRPVAS

SEQ ID NO: 56405 - protein, 25 aa, synthetic construct
  source 1..25: note = Seed: VKLQTVHSIPLTINKEEALQRPVAS
VKLQTVHSIPITIKKHEAFQRPVAS

SEQ ID NO: 56406 - protein, 25 aa, synthetic construct
  source 1..25: note = Seed: VKLQTVHSIPLTINKEEALQRPVAS
VKLQTVHSIPITIKKHEALQRPVAS

SEQ ID NO: 56407 - protein, 25 aa, synthetic construct
  source 1..25: note = Seed: VKLQTVHSIPLTINKEEALQRPVAS
VKLQTVHSIPITIKKIEAMQRPVAS

SEQ ID NO: 56408 - protein, 25 aa, synthetic construct
  source 1..25: note = Seed: VKLQTVHSIPLTINKEEALQRPVAS
VKLQTVHSIPITIKKIEARQRPVAS

SEQ ID NO: 56409 - protein, 25 aa, synthetic construct
  source 1..25: note = Seed: VKLQTVHSIPLTINKEEALQRPVAS
VKLQTVHSIPITIKKIEAVQRPVAS

SEQ ID NO: 56410 - protein, 25 aa, synthetic construct
  source 1..25: note = Seed: VKLQTVHSIPLTINKEEALQRPVAS
VKLQTVHSIPITIKKIEAYQRPVAS

SEQ ID NO: 56411 - protein, 25 aa, synthetic construct
  source 1..25: note = Seed: VKLQTVHSIPLTINKEEALQRPVAS
VKLQTVHSIPITIKKLEAMQRPVAS

SEQ ID NO: 56412 - protein, 25 aa, synthetic construct
  source 1..25: note = Seed: VKLQTVHSIPLTINKEEALQRPVAS
VKLQTVHSIPITIKKLEAYQRPVAS

SEQ ID NO: 56413 - protein, 25 aa, synthetic construct
  source 1..25: note = Seed: VKLQTVHSIPLTINKEEALQRPVAS
VKLQTVHSIPITIKKMEAYQRPVAS

SEQ ID NO: 56414 - protein, 25 aa, synthetic construct
  source 1..25: note = Seed: VKLQTVHSIPLTINKEEALQRPVAS
VKLQTVHSIPITIKKNEAIQRPVAS

SEQ ID NO: 56415 - protein, 25 aa, synthetic construct
  source 1..25: note = Seed: VKLQTVHSIPLTINKEEALQRPVAS
VKLQTVHSIPITIKKNEALQRPVAS

SEQ ID NO: 56416 - protein, 25 aa, synthetic construct
  source 1..25: note = Seed: VKLQTVHSIPLTINKEEALQRPVAS
VKLQTVHSIPITIKKNEAVQRPVAS

SEQ ID NO: 56417 - protein, 25 aa, synthetic construct
  source 1..25: note = Seed: VKLQTVHSIPLTINKEEALQRPVAS
VKLQTVHSIPITIKKREAFQRPVAS

SEQ ID NO: 56418 - protein, 25 aa, synthetic construct
  source 1..25: note = Seed: VKLQTVHSIPLTINKEEALQRPVAS
VKLQTVHSIPITIKKREAIQRPVAS

SEQ ID NO: 56419 - protein, 25 aa, synthetic construct
  source 1..25: note = Seed: VKLQTVHSIPLTINKEEALQRPVAS
VKLQTVHSIPITIKKREALQRPVAS

SEQ ID NO: 56420 - protein, 25 aa, synthetic construct
  source 1..25: note = Seed: VKLQTVHSIPLTINKEEALQRPVAS
VKLQTVHSIPITIKKREAVQRPVAS

SEQ ID NO: 56421 - protein, 25 aa, synthetic construct
  source 1..25: note = Seed: VKLQTVHSIPLTINKEEALQRPVAS
VKLQTVHSIPITIKKREAYQRPVAS

SEQ ID NO: 56422 - protein, 25 aa, synthetic construct
  source 1..25: note = Seed: VKLQTVHSIPLTINKEEALQRPVAS
VKLQTVHSIPITIKKSEAFQRPVAS

SEQ ID NO: 56423 - protein, 25 aa, synthetic construct
  source 1..25: note = Seed: VKLQTVHSIPLTINKEEALQRPVAS
VKLQTVHSIPITIKKSEALQRPVAS

SEQ ID NO: 56424 - protein, 25 aa, synthetic construct
  source 1..25: note = Seed: VKLQTVHSIPLTINKEEALQRPVAS
VKLQTVHSIPITIKKVEAFQRPVAS

SEQ ID NO: 56425 - protein, 25 aa, synthetic construct
  source 1..25: note = Seed: VKLQTVHSIPLTINKEEALQRPVAS
VKLQTVHSIPITIKKVEAIQRPVAS

SEQ ID NO: 56426 - protein, 25 aa, synthetic construct
  source 1..25: note = Seed: VKLQTVHSIPLTINKEEALQRPVAS
VKLQTVHSIPITIKKVEALQRPVAS

SEQ ID NO: 56427 - protein, 25 aa, synthetic construct
  source 1..25: note = Seed: VKLQTVHSIPLTINKEEALQRPVAS
VKLQTVHSIPITILKAEAAQRPVAS

SEQ ID NO: 56428 - protein, 25 aa, synthetic construct
  source 1..25: note = Seed: VKLQTVHSIPLTINKEEALQRPVAS
VKLQTVHSIPITILKAEAFQRPVAS

SEQ ID NO: 56429 - protein, 25 aa, synthetic construct
  source 1..25: note = Seed: VKLQTVHSIPLTINKEEALQRPVAS
VKLQTVHSIPITILKAEAIQRPVAS

SEQ ID NO: 56430 - protein, 25 aa, synthetic construct
  source 1..25: note = Seed: VKLQTVHSIPLTINKEEALQRPVAS
VKLQTVHSIPITILKAEALQRPVAS

SEQ ID NO: 56431 - protein, 25 aa, synthetic construct
  source 1..25: note = Seed: VKLQTVHSIPLTINKEEALQRPVAS
VKLQTVHSIPITILKAEAMQRPVAS

SEQ ID NO: 56432 - protein, 25 aa, synthetic construct
  source 1..25: note = Seed: VKLQTVHSIPLTINKEEALQRPVAS
VKLQTVHSIPITILKAEASQRPVAS

SEQ ID NO: 56433 - protein, 25 aa, synthetic construct
  source 1..25: note = Seed: VKLQTVHSIPLTINKEEALQRPVAS
VKLQTVHSIPITILKAEATQRPVAS

SEQ ID NO: 56434 - protein, 25 aa, synthetic construct
  source 1..25: note = Seed: VKLQTVHSIPLTINKEEALQRPVAS
VKLQTVHSIPITILKAEAVQRPVAS

SEQ ID NO: 56435 - protein, 25 aa, synthetic construct
  source 1..25: note = Seed: VKLQTVHSIPLTINKEEALQRPVAS
VKLQTVHSIPITILKAEAYQRPVAS

SEQ ID NO: 56436 - protein, 25 aa, synthetic construct
  source 1..25: note = Seed: VKLQTVHSIPLTINKEEALQRPVAS
VKLQTVHSIPITILKDEAAQRPVAS

SEQ ID NO: 56437 - protein, 25 aa, synthetic construct
  source 1..25: note = Seed: VKLQTVHSIPLTINKEEALQRPVAS
VKLQTVHSIPITILKDEAFQRPVAS

SEQ ID NO: 56438 - protein, 25 aa, synthetic construct
  source 1..25: note = Seed: VKLQTVHSIPLTINKEEALQRPVAS
VKLQTVHSIPITILKDEAIQRPVAS

SEQ ID NO: 56439 - protein, 25 aa, synthetic construct
  source 1..25: note = Seed: VKLQTVHSIPLTINKEEALQRPVAS
VKLQTVHSIPITILKDEALQRPVAS

SEQ ID NO: 56440 - protein, 25 aa, synthetic construct
  source 1..25: note = Seed: VKLQTVHSIPLTINKEEALQRPVAS
VKLQTVHSIPITILKDEAMQRPVAS

SEQ ID NO: 56441 - protein, 25 aa, synthetic construct
  source 1..25: note = Seed: VKLQTVHSIPLTINKEEALQRPVAS
VKLQTVHSIPITILKDEAVQRPVAS

SEQ ID NO: 56442 - protein, 25 aa, synthetic construct
  source 1..25: note = Seed: VKLQTVHSIPLTINKEEALQRPVAS
VKLQTVHSIPITILKDEAYQRPVAS

SEQ ID NO: 56443 - protein, 25 aa, synthetic construct
  source 1..25: note = Seed: VKLQTVHSIPLTINKEEALQRPVAS
VKLQTVHSIPITILKFEAAQRPVAS

SEQ ID NO: 56444 - protein, 25 aa, synthetic construct
  source 1..25: note = Seed: VKLQTVHSIPLTINKEEALQRPVAS
VKLQTVHSIPITILKFEADQRPVAS

SEQ ID NO: 56445 - protein, 25 aa, synthetic construct
  source 1..25: note = Seed: VKLQTVHSIPLTINKEEALQRPVAS
VKLQTVHSIPITILKFEAEQRPVAS

SEQ ID NO: 56446 - protein, 25 aa, synthetic construct
  source 1..25: note = Seed: VKLQTVHSIPLTINKEEALQRPVAS
VKLQTVHSIPITILKFEAFQRPVAS

SEQ ID NO: 56447 - protein, 25 aa, synthetic construct
  source 1..25: note = Seed: VKLQTVHSIPLTINKEEALQRPVAS
VKLQTVHSIPITILKFEAHQRPVAS

SEQ ID NO: 56448 - protein, 25 aa, synthetic construct
  source 1..25: note = Seed: VKLQTVHSIPLTINKEEALQRPVAS
VKLQTVHSIPITILKFEAIQRPVAS

SEQ ID NO: 56449 - protein, 25 aa, synthetic construct
  source 1..25: note = Seed: VKLQTVHSIPLTINKEEALQRPVAS
VKLQTVHSIPITILKFEAKQRPVAS

SEQ ID NO: 56450 - protein, 25 aa, synthetic construct
  source 1..25: note = Seed: VKLQTVHSIPLTINKEEALQRPVAS
VKLQTVHSIPITILKFEALQRPVAS

SEQ ID NO: 56451 - protein, 25 aa, synthetic construct
  source 1..25: note = Seed: VKLQTVHSIPLTINKEEALQRPVAS
VKLQTVHSIPITILKFEAMQRPVAS

SEQ ID NO: 56452 - protein, 25 aa, synthetic construct
  source 1..25: note = Seed: VKLQTVHSIPLTINKEEALQRPVAS
VKLQTVHSIPITILKFEANQRPVAS

SEQ ID NO: 56453 - protein, 25 aa, synthetic construct
  source 1..25: note = Seed: VKLQTVHSIPLTINKEEALQRPVAS
VKLQTVHSIPITILKFEAPQRPVAS

SEQ ID NO: 56454 - protein, 25 aa, synthetic construct
  source 1..25: note = Seed: VKLQTVHSIPLTINKEEALQRPVAS
VKLQTVHSIPITILKFEAQQRPVAS

SEQ ID NO: 56455 - protein, 25 aa, synthetic construct
  source 1..25: note = Seed: VKLQTVHSIPLTINKEEALQRPVAS
VKLQTVHSIPITILKFEARQRPVAS

SEQ ID NO: 56456 - protein, 25 aa, synthetic construct
  source 1..25: note = Seed: VKLQTVHSIPLTINKEEALQRPVAS
VKLQTVHSIPITILKFEASQRPVAS

SEQ ID NO: 56457 - protein, 25 aa, synthetic construct
  source 1..25: note = Seed: VKLQTVHSIPLTINKEEALQRPVAS
VKLQTVHSIPITILKFEATQRPVAS

SEQ ID NO: 56458 - protein, 25 aa, synthetic construct
  source 1..25: note = Seed: VKLQTVHSIPLTINKEEALQRPVAS
VKLQTVHSIPITILKFEAVQRPVAS

SEQ ID NO: 56459 - protein, 25 aa, synthetic construct
  source 1..25: note = Seed: VKLQTVHSIPLTINKEEALQRPVAS
VKLQTVHSIPITILKFEAWQRPVAS

SEQ ID NO: 56460 - protein, 25 aa, synthetic construct
  source 1..25: note = Seed: VKLQTVHSIPLTINKEEALQRPVAS
VKLQTVHSIPITILKFEAYQRPVAS

SEQ ID NO: 56461 - protein, 25 aa, synthetic construct
  source 1..25: note = Seed: VKLQTVHSIPLTINKEEALQRPVAS
VKLQTVHSIPITILKGEAAQRPVAS

SEQ ID NO: 56462 - protein, 25 aa, synthetic construct
  source 1..25: note = Seed: VKLQTVHSIPLTINKEEALQRPVAS
VKLQTVHSIPITILKGEAIQRPVAS

SEQ ID NO: 56463 - protein, 25 aa, synthetic construct
  source 1..25: note = Seed: VKLQTVHSIPLTINKEEALQRPVAS
VKLQTVHSIPITILKGEAVQRPVAS

SEQ ID NO: 56464 - protein, 25 aa, synthetic construct
  source 1..25: note = Seed: VKLQTVHSIPLTINKEEALQRPVAS
VKLQTVHSIPITILKHEAFQRPVAS

SEQ ID NO: 56465 - protein, 25 aa, synthetic construct
  source 1..25: note = Seed: VKLQTVHSIPLTINKEEALQRPVAS
VKLQTVHSIPITILKHEAIQRPVAS

SEQ ID NO: 56466 - protein, 25 aa, synthetic construct
  source 1..25: note = Seed: VKLQTVHSIPLTINKEEALQRPVAS
VKLQTVHSIPITILKHEALQRPVAS

SEQ ID NO: 56467 - protein, 25 aa, synthetic construct
  source 1..25: note = Seed: VKLQTVHSIPLTINKEEALQRPVAS
VKLQTVHSIPITILKHEAMQRPVAS

SEQ ID NO: 56468 - protein, 25 aa, synthetic construct
  source 1..25: note = Seed: VKLQTVHSIPLTINKEEALQRPVAS
VKLQTVHSIPITILKHEARQRPVAS

SEQ ID NO: 56469 - protein, 25 aa, synthetic construct
  source 1..25: note = Seed: VKLQTVHSIPLTINKEEALQRPVAS
VKLQTVHSIPITILKHEAVQRPVAS

SEQ ID NO: 56470 - protein, 25 aa, synthetic construct
  source 1..25: note = Seed: VKLQTVHSIPLTINKEEALQRPVAS
VKLQTVHSIPITILKHEAYQRPVAS

SEQ ID NO: 56471 - protein, 25 aa, synthetic construct
  source 1..25: note = Seed: VKLQTVHSIPLTINKEEALQRPVAS
VKLQTVHSIPITILKIEAAQRPVAS

SEQ ID NO: 56472 - protein, 25 aa, synthetic construct
  source 1..25: note = Seed: VKLQTVHSIPLTINKEEALQRPVAS
VKLQTVHSIPITILKIEADQRPVAS

SEQ ID NO: 56473 - protein, 25 aa, synthetic construct
  source 1..25: note = Seed: VKLQTVHSIPLTINKEEALQRPVAS
VKLQTVHSIPITILKIEAFQRPVAS

SEQ ID NO: 56474 - protein, 25 aa, synthetic construct
  source 1..25: note = Seed: VKLQTVHSIPLTINKEEALQRPVAS
VKLQTVHSIPITILKIEAGQRPVAS

SEQ ID NO: 56475 - protein, 25 aa, synthetic construct
  source 1..25: note = Seed: VKLQTVHSIPLTINKEEALQRPVAS
VKLQTVHSIPITILKIEAIQRPVAS

SEQ ID NO: 56476 - protein, 25 aa, synthetic construct
  source 1..25: note = Seed: VKLQTVHSIPLTINKEEALQRPVAS
VKLQTVHSIPITILKIEALQRPVAS

SEQ ID NO: 56477 - protein, 25 aa, synthetic construct
  source 1..25: note = Seed: VKLQTVHSIPLTINKEEALQRPVAS
VKLQTVHSIPITILKIEAMQRPVAS

SEQ ID NO: 56478 - protein, 25 aa, synthetic construct
  source 1..25: note = Seed: VKLQTVHSIPLTINKEEALQRPVAS
VKLQTVHSIPITILKIEANQRPVAS

SEQ ID NO: 56479 - protein, 25 aa, synthetic construct
  source 1..25: note = Seed: VKLQTVHSIPLTINKEEALQRPVAS
VKLQTVHSIPITILKIEAQQRPVAS

SEQ ID NO: 56480 - protein, 25 aa, synthetic construct
  source 1..25: note = Seed: VKLQTVHSIPLTINKEEALQRPVAS
VKLQTVHSIPITILKIEARQRPVAS

SEQ ID NO: 56481 - protein, 25 aa, synthetic construct
  source 1..25: note = Seed: VKLQTVHSIPLTINKEEALQRPVAS
VKLQTVHSIPITILKIEASQRPVAS

SEQ ID NO: 56482 - protein, 25 aa, synthetic construct
  source 1..25: note = Seed: VKLQTVHSIPLTINKEEALQRPVAS
VKLQTVHSIPITILKIEATQRPVAS

SEQ ID NO: 56483 - protein, 25 aa, synthetic construct
  source 1..25: note = Seed: VKLQTVHSIPLTINKEEALQRPVAS
VKLQTVHSIPITILKIEAVQRPVAS

SEQ ID NO: 56484 - protein, 25 aa, synthetic construct
  source 1..25: note = Seed: VKLQTVHSIPLTINKEEALQRPVAS
VKLQTVHSIPITILKIEAYQRPVAS

SEQ ID NO: 56485 - protein, 25 aa, synthetic construct
  source 1..25: note = Seed: VKLQTVHSIPLTINKEEALQRPVAS
VKLQTVHSIPITILKKEAFQRPVAS

SEQ ID NO: 56486 - protein, 25 aa, synthetic construct
  source 1..25: note = Seed: VKLQTVHSIPLTINKEEALQRPVAS
VKLQTVHSIPITILKKEAIQRPVAS

SEQ ID NO: 56487 - protein, 25 aa, synthetic construct
  source 1..25: note = Seed: VKLQTVHSIPLTINKEEALQRPVAS
VKLQTVHSIPITILKKEALQRPVAS

SEQ ID NO: 56488 - protein, 25 aa, synthetic construct
  source 1..25: note = Seed: VKLQTVHSIPLTINKEEALQRPVAS
VKLQTVHSIPITILKKEAMQRPVAS

SEQ ID NO: 56489 - protein, 25 aa, synthetic construct
  source 1..25: note = Seed: VKLQTVHSIPLTINKEEALQRPVAS
VKLQTVHSIPITILKKEAVQRPVAS

SEQ ID NO: 56490 - protein, 25 aa, synthetic construct
  source 1..25: note = Seed: VKLQTVHSIPLTINKEEALQRPVAS
VKLQTVHSIPITILKKEAYQRPVAS

SEQ ID NO: 56491 - protein, 25 aa, synthetic construct
  source 1..25: note = Seed: VKLQTVHSIPLTINKEEALQRPVAS
VKLQTVHSIPITILKLEAAQRPVAS

SEQ ID NO: 56492 - protein, 25 aa, synthetic construct
  source 1..25: note = Seed: VKLQTVHSIPLTINKEEALQRPVAS
VKLQTVHSIPITILKLEADQRPVAS

SEQ ID NO: 56493 - protein, 25 aa, synthetic construct
  source 1..25: note = Seed: VKLQTVHSIPLTINKEEALQRPVAS
VKLQTVHSIPITILKLEAFQRPVAS

SEQ ID NO: 56494 - protein, 25 aa, synthetic construct
  source 1..25: note = Seed: VKLQTVHSIPLTINKEEALQRPVAS
VKLQTVHSIPITILKLEAIQRPVAS

SEQ ID NO: 56495 - protein, 25 aa, synthetic construct
  source 1..25: note = Seed: VKLQTVHSIPLTINKEEALQRPVAS
VKLQTVHSIPITILKLEALQRPVAS

SEQ ID NO: 56496 - protein, 25 aa, synthetic construct
  source 1..25: note = Seed: VKLQTVHSIPLTINKEEALQRPVAS
VKLQTVHSIPITILKLEAMQRPVAS

SEQ ID NO: 56497 - protein, 25 aa, synthetic construct
  source 1..25: note = Seed: VKLQTVHSIPLTINKEEALQRPVAS
VKLQTVHSIPITILKLEANQRPVAS

SEQ ID NO: 56498 - protein, 25 aa, synthetic construct
  source 1..25: note = Seed: VKLQTVHSIPLTINKEEALQRPVAS
VKLQTVHSIPITILKLEASQRPVAS

SEQ ID NO: 56499 - protein, 25 aa, synthetic construct
  source 1..25: note = Seed: VKLQTVHSIPLTINKEEALQRPVAS
VKLQTVHSIPITILKLEAVQRPVAS

SEQ ID NO: 56500 - protein, 25 aa, synthetic construct
  source 1..25: note = Seed: VKLQTVHSIPLTINKEEALQRPVAS
VKLQTVHSIPITILKLEAWQRPVAS

SEQ ID NO: 56501 - protein, 25 aa, synthetic construct
  source 1..25: note = Seed: VKLQTVHSIPLTINKEEALQRPVAS
VKLQTVHSIPITILKLEAYQRPVAS

SEQ ID NO: 56502 - protein, 25 aa, synthetic construct
  source 1..25: note = Seed: VKLQTVHSIPLTINKEEALQRPVAS
VKLQTVHSIPITILKMEAAQRPVAS

SEQ ID NO: 56503 - protein, 25 aa, synthetic construct
  source 1..25: note = Seed: VKLQTVHSIPLTINKEEALQRPVAS
VKLQTVHSIPITILKMEAFQRPVAS

SEQ ID NO: 56504 - protein, 25 aa, synthetic construct
  source 1..25: note = Seed: VKLQTVHSIPLTINKEEALQRPVAS
VKLQTVHSIPITILKMEAIQRPVAS

SEQ ID NO: 56505 - protein, 25 aa, synthetic construct
  source 1..25: note = Seed: VKLQTVHSIPLTINKEEALQRPVAS
VKLQTVHSIPITILKMEALQRPVAS

SEQ ID NO: 56506 - protein, 25 aa, synthetic construct
  source 1..25: note = Seed: VKLQTVHSIPLTINKEEALQRPVAS
VKLQTVHSIPITILKMEAMQRPVAS

SEQ ID NO: 56507 - protein, 25 aa, synthetic construct
  source 1..25: note = Seed: VKLQTVHSIPLTINKEEALQRPVAS
VKLQTVHSIPITILKMEANQRPVAS

SEQ ID NO: 56508 - protein, 25 aa, synthetic construct
  source 1..25: note = Seed: VKLQTVHSIPLTINKEEALQRPVAS
VKLQTVHSIPITILKMEARQRPVAS

SEQ ID NO: 56509 - protein, 25 aa, synthetic construct
  source 1..25: note = Seed: VKLQTVHSIPLTINKEEALQRPVAS
VKLQTVHSIPITILKMEASQRPVAS

SEQ ID NO: 56510 - protein, 25 aa, synthetic construct
  source 1..25: note = Seed: VKLQTVHSIPLTINKEEALQRPVAS
VKLQTVHSIPITILKMEATQRPVAS

SEQ ID NO: 56511 - protein, 25 aa, synthetic construct
  source 1..25: note = Seed: VKLQTVHSIPLTINKEEALQRPVAS
VKLQTVHSIPITILKMEAVQRPVAS

SEQ ID NO: 56512 - protein, 25 aa, synthetic construct
  source 1..25: note = Seed: VKLQTVHSIPLTINKEEALQRPVAS
VKLQTVHSIPITILKMEAYQRPVAS

SEQ ID NO: 56513 - protein, 25 aa, synthetic construct
  source 1..25: note = Seed: VKLQTVHSIPLTINKEEALQRPVAS
VKLQTVHSIPITILKNEAAQRPVAS

SEQ ID NO: 56514 - protein, 25 aa, synthetic construct
  source 1..25: note = Seed: VKLQTVHSIPLTINKEEALQRPVAS
VKLQTVHSIPITILKNEAIQRPVAS

SEQ ID NO: 56515 - protein, 25 aa, synthetic construct
  source 1..25: note = Seed: VKLQTVHSIPLTINKEEALQRPVAS
VKLQTVHSIPITILKNEALQRPVAS

SEQ ID NO: 56516 - protein, 25 aa, synthetic construct
  source 1..25: note = Seed: VKLQTVHSIPLTINKEEALQRPVAS
VKLQTVHSIPITILKNEAMQRPVAS

SEQ ID NO: 56517 - protein, 25 aa, synthetic construct
  source 1..25: note = Seed: VKLQTVHSIPLTINKEEALQRPVAS
VKLQTVHSIPITILKNEAVQRPVAS

SEQ ID NO: 56518 - protein, 25 aa, synthetic construct
  source 1..25: note = Seed: VKLQTVHSIPLTINKEEALQRPVAS
VKLQTVHSIPITILKNEAYQRPVAS

SEQ ID NO: 56519 - protein, 25 aa, synthetic construct
  source 1..25: note = Seed: VKLQTVHSIPLTINKEEALQRPVAS
VKLQTVHSIPITILKPEAIQRPVAS

SEQ ID NO: 56520 - protein, 25 aa, synthetic construct
  source 1..25: note = Seed: VKLQTVHSIPLTINKEEALQRPVAS
VKLQTVHSIPITILKPEAVQRPVAS

SEQ ID NO: 56521 - protein, 25 aa, synthetic construct
  source 1..25: note = Seed: VKLQTVHSIPLTINKEEALQRPVAS
VKLQTVHSIPITILKREAAQRPVAS

SEQ ID NO: 56522 - protein, 25 aa, synthetic construct
  source 1..25: note = Seed: VKLQTVHSIPLTINKEEALQRPVAS
VKLQTVHSIPITILKREAFQRPVAS

SEQ ID NO: 56523 - protein, 25 aa, synthetic construct
  source 1..25: note = Seed: VKLQTVHSIPLTINKEEALQRPVAS
VKLQTVHSIPITILKREAHQRPVAS

SEQ ID NO: 56524 - protein, 25 aa, synthetic construct
  source 1..25: note = Seed: VKLQTVHSIPLTINKEEALQRPVAS
VKLQTVHSIPITILKREAIQRPVAS

SEQ ID NO: 56525 - protein, 25 aa, synthetic construct
  source 1..25: note = Seed: VKLQTVHSIPLTINKEEALQRPVAS
VKLQTVHSIPITILKREALQRPVAS

SEQ ID NO: 56526 - protein, 25 aa, synthetic construct
  source 1..25: note = Seed: VKLQTVHSIPLTINKEEALQRPVAS
VKLQTVHSIPITILKREAMQRPVAS

SEQ ID NO: 56527 - protein, 25 aa, synthetic construct
  source 1..25: note = Seed: VKLQTVHSIPLTINKEEALQRPVAS
VKLQTVHSIPITILKREARQRPVAS

SEQ ID NO: 56528 - protein, 25 aa, synthetic construct
  source 1..25: note = Seed: VKLQTVHSIPLTINKEEALQRPVAS
VKLQTVHSIPITILKREAVQRPVAS

SEQ ID NO: 56529 - protein, 25 aa, synthetic construct
  source 1..25: note = Seed: VKLQTVHSIPLTINKEEALQRPVAS
VKLQTVHSIPITILKREAYQRPVAS

SEQ ID NO: 56530 - protein, 25 aa, synthetic construct
  source 1..25: note = Seed: VKLQTVHSIPLTINKEEALQRPVAS
VKLQTVHSIPITILKSEAAQRPVAS

SEQ ID NO: 56531 - protein, 25 aa, synthetic construct
  source 1..25: note = Seed: VKLQTVHSIPLTINKEEALQRPVAS
VKLQTVHSIPITILKSEAIQRPVAS

SEQ ID NO: 56532 - protein, 25 aa, synthetic construct
  source 1..25: note = Seed: VKLQTVHSIPLTINKEEALQRPVAS
VKLQTVHSIPITILKSEALQRPVAS

SEQ ID NO: 56533 - protein, 25 aa, synthetic construct
  source 1..25: note = Seed: VKLQTVHSIPLTINKEEALQRPVAS
VKLQTVHSIPITILKSEAMQRPVAS

SEQ ID NO: 56534 - protein, 25 aa, synthetic construct
  source 1..25: note = Seed: VKLQTVHSIPLTINKEEALQRPVAS
VKLQTVHSIPITILKSEAVQRPVAS

SEQ ID NO: 56535 - protein, 25 aa, synthetic construct
  source 1..25: note = Seed: VKLQTVHSIPLTINKEEALQRPVAS
VKLQTVHSIPITILKSEAYQRPVAS

SEQ ID NO: 56536 - protein, 25 aa, synthetic construct
  source 1..25: note = Seed: VKLQTVHSIPLTINKEEALQRPVAS
VKLQTVHSIPITILKTEAAQRPVAS

SEQ ID NO: 56537 - protein, 25 aa, synthetic construct
  source 1..25: note = Seed: VKLQTVHSIPLTINKEEALQRPVAS
VKLQTVHSIPITILKTEAFQRPVAS

SEQ ID NO: 56538 - protein, 25 aa, synthetic construct
  source 1..25: note = Seed: VKLQTVHSIPLTINKEEALQRPVAS
VKLQTVHSIPITILKTEAIQRPVAS

SEQ ID NO: 56539 - protein, 25 aa, synthetic construct
  source 1..25: note = Seed: VKLQTVHSIPLTINKEEALQRPVAS
VKLQTVHSIPITILKTEALQRPVAS

SEQ ID NO: 56540 - protein, 25 aa, synthetic construct
  source 1..25: note = Seed: VKLQTVHSIPLTINKEEALQRPVAS
VKLQTVHSIPITILKTEAMQRPVAS

SEQ ID NO: 56541 - protein, 25 aa, synthetic construct
  source 1..25: note = Seed: VKLQTVHSIPLTINKEEALQRPVAS
VKLQTVHSIPITILKTEAVQRPVAS

SEQ ID NO: 56542 - protein, 25 aa, synthetic construct
  source 1..25: note = Seed: VKLQTVHSIPLTINKEEALQRPVAS
VKLQTVHSIPITILKVEAAQRPVAS

SEQ ID NO: 56543 - protein, 25 aa, synthetic construct
  source 1..25: note = Seed: VKLQTVHSIPLTINKEEALQRPVAS
VKLQTVHSIPITILKVEAFQRPVAS

SEQ ID NO: 56544 - protein, 25 aa, synthetic construct
  source 1..25: note = Seed: VKLQTVHSIPLTINKEEALQRPVAS
VKLQTVHSIPITILKVEAIQRPVAS

SEQ ID NO: 56545 - protein, 25 aa, synthetic construct
  source 1..25: note = Seed: VKLQTVHSIPLTINKEEALQRPVAS
VKLQTVHSIPITILKVEALQRPVAS

SEQ ID NO: 56546 - protein, 25 aa, synthetic construct
  source 1..25: note = Seed: VKLQTVHSIPLTINKEEALQRPVAS
VKLQTVHSIPITILKVEAMQRPVAS

SEQ ID NO: 56547 - protein, 25 aa, synthetic construct
  source 1..25: note = Seed: VKLQTVHSIPLTINKEEALQRPVAS
VKLQTVHSIPITILKVEANQRPVAS

SEQ ID NO: 56548 - protein, 25 aa, synthetic construct
  source 1..25: note = Seed: VKLQTVHSIPLTINKEEALQRPVAS
VKLQTVHSIPITILKVEARQRPVAS

SEQ ID NO: 56549 - protein, 25 aa, synthetic construct
  source 1..25: note = Seed: VKLQTVHSIPLTINKEEALQRPVAS
VKLQTVHSIPITILKVEASQRPVAS

SEQ ID NO: 56550 - protein, 25 aa, synthetic construct
  source 1..25: note = Seed: VKLQTVHSIPLTINKEEALQRPVAS
VKLQTVHSIPITILKVEATQRPVAS

SEQ ID NO: 56551 - protein, 25 aa, synthetic construct
  source 1..25: note = Seed: VKLQTVHSIPLTINKEEALQRPVAS
VKLQTVHSIPITILKVEAVQRPVAS

SEQ ID NO: 56552 - protein, 25 aa, synthetic construct
  source 1..25: note = Seed: VKLQTVHSIPLTINKEEALQRPVAS
VKLQTVHSIPITILKVEAYQRPVAS

SEQ ID NO: 56553 - protein, 25 aa, synthetic construct
  source 1..25: note = Seed: VKLQTVHSIPLTINKEEALQRPVAS
VKLQTVHSIPITILKWEAFQRPVAS

SEQ ID NO: 56554 - protein, 25 aa, synthetic construct
  source 1..25: note = Seed: VKLQTVHSIPLTINKEEALQRPVAS
VKLQTVHSIPITILKWEAIQRPVAS

SEQ ID NO: 56555 - protein, 25 aa, synthetic construct
  source 1..25: note = Seed: VKLQTVHSIPLTINKEEALQRPVAS
VKLQTVHSIPITILKWEALQRPVAS

SEQ ID NO: 56556 - protein, 25 aa, synthetic construct
  source 1..25: note = Seed: VKLQTVHSIPLTINKEEALQRPVAS
VKLQTVHSIPITILKWEAMQRPVAS

SEQ ID NO: 56557 - protein, 25 aa, synthetic construct
  source 1..25: note = Seed: VKLQTVHSIPLTINKEEALQRPVAS
VKLQTVHSIPITILKWEAVQRPVAS

SEQ ID NO: 56558 - protein, 25 aa, synthetic construct
  source 1..25: note = Seed: VKLQTVHSIPLTINKEEALQRPVAS
VKLQTVHSIPITILKWEAYQRPVAS

SEQ ID NO: 56559 - protein, 25 aa, synthetic construct
  source 1..25: note = Seed: VKLQTVHSIPLTINKEEALQRPVAS
VKLQTVHSIPITILKYEAAQRPVAS

SEQ ID NO: 56560 - protein, 25 aa, synthetic construct
  source 1..25: note = Seed: VKLQTVHSIPLTINKEEALQRPVAS
VKLQTVHSIPITILKYEAFQRPVAS

SEQ ID NO: 56561 - protein, 25 aa, synthetic construct
  source 1..25: note = Seed: VKLQTVHSIPLTINKEEALQRPVAS
VKLQTVHSIPITILKYEAIQRPVAS

SEQ ID NO: 56562 - protein, 25 aa, synthetic construct
  source 1..25: note = Seed: VKLQTVHSIPLTINKEEALQRPVAS
VKLQTVHSIPITILKYEALQRPVAS

SEQ ID NO: 56563 - protein, 25 aa, synthetic construct
  source 1..25: note = Seed: VKLQTVHSIPLTINKEEALQRPVAS
VKLQTVHSIPITILKYEAMQRPVAS

SEQ ID NO: 56564 - protein, 25 aa, synthetic construct
  source 1..25: note = Seed: VKLQTVHSIPLTINKEEALQRPVAS
VKLQTVHSIPITILKYEAVQRPVAS

SEQ ID NO: 56565 - protein, 25 aa, synthetic construct
  source 1..25: note = Seed: VKLQTVHSIPLTINKEEALQRPVAS
VKLQTVHSIPITILKYEAWQRPVAS

SEQ ID NO: 56566 - protein, 25 aa, synthetic construct
  source 1..25: note = Seed: VKLQTVHSIPLTINKEEALQRPVAS
VKLQTVHSIPITILKYEAYQRPVAS

SEQ ID NO: 56567 - protein, 25 aa, synthetic construct
  source 1..25: note = Seed: VKLQTVHSIPLTINKEEALQRPVAS
VKLQTVHSIPITIMKAEAAQRPVAS

SEQ ID NO: 56568 - protein, 25 aa, synthetic construct
  source 1..25: note = Seed: VKLQTVHSIPLTINKEEALQRPVAS
VKLQTVHSIPITIMKAEACQRPVAS

SEQ ID NO: 56569 - protein, 25 aa, synthetic construct
  source 1..25: note = Seed: VKLQTVHSIPLTINKEEALQRPVAS
VKLQTVHSIPITIMKAEAFQRPVAS

SEQ ID NO: 56570 - protein, 25 aa, synthetic construct
  source 1..25: note = Seed: VKLQTVHSIPLTINKEEALQRPVAS
VKLQTVHSIPITIMKAEAIQRPVAS

SEQ ID NO: 56571 - protein, 25 aa, synthetic construct
  source 1..25: note = Seed: VKLQTVHSIPLTINKEEALQRPVAS
VKLQTVHSIPITIMKAEALQRPVAS

SEQ ID NO: 56572 - protein, 25 aa, synthetic construct
  source 1..25: note = Seed: VKLQTVHSIPLTINKEEALQRPVAS
VKLQTVHSIPITIMKAEAMQRPVAS

SEQ ID NO: 56573 - protein, 25 aa, synthetic construct
  source 1..25: note = Seed: VKLQTVHSIPLTINKEEALQRPVAS
VKLQTVHSIPITIMKAEANQRPVAS

SEQ ID NO: 56574 - protein, 25 aa, synthetic construct
  source 1..25: note = Seed: VKLQTVHSIPLTINKEEALQRPVAS
VKLQTVHSIPITIMKAEASQRPVAS

SEQ ID NO: 56575 - protein, 25 aa, synthetic construct
  source 1..25: note = Seed: VKLQTVHSIPLTINKEEALQRPVAS
VKLQTVHSIPITIMKAEATQRPVAS

SEQ ID NO: 56576 - protein, 25 aa, synthetic construct
  source 1..25: note = Seed: VKLQTVHSIPLTINKEEALQRPVAS
VKLQTVHSIPITIMKAEAVQRPVAS

SEQ ID NO: 56577 - protein, 25 aa, synthetic construct
  source 1..25: note = Seed: VKLQTVHSIPLTINKEEALQRPVAS
VKLQTVHSIPITIMKAEAYQRPVAS

SEQ ID NO: 56578 - protein, 25 aa, synthetic construct
  source 1..25: note = Seed: VKLQTVHSIPLTINKEEALQRPVAS
VKLQTVHSIPITIMKDEAAQRPVAS

SEQ ID NO: 56579 - protein, 25 aa, synthetic construct
  source 1..25: note = Seed: VKLQTVHSIPLTINKEEALQRPVAS
VKLQTVHSIPITIMKDEAFQRPVAS

SEQ ID NO: 56580 - protein, 25 aa, synthetic construct
  source 1..25: note = Seed: VKLQTVHSIPLTINKEEALQRPVAS
VKLQTVHSIPITIMKDEAIQRPVAS

SEQ ID NO: 56581 - protein, 25 aa, synthetic construct
  source 1..25: note = Seed: VKLQTVHSIPLTINKEEALQRPVAS
VKLQTVHSIPITIMKDEALQRPVAS

SEQ ID NO: 56582 - protein, 25 aa, synthetic construct
  source 1..25: note = Seed: VKLQTVHSIPLTINKEEALQRPVAS
VKLQTVHSIPITIMKDEAMQRPVAS

SEQ ID NO: 56583 - protein, 25 aa, synthetic construct
  source 1..25: note = Seed: VKLQTVHSIPLTINKEEALQRPVAS
VKLQTVHSIPITIMKDEASQRPVAS

SEQ ID NO: 56584 - protein, 25 aa, synthetic construct
  source 1..25: note = Seed: VKLQTVHSIPLTINKEEALQRPVAS
VKLQTVHSIPITIMKDEAVQRPVAS

SEQ ID NO: 56585 - protein, 25 aa, synthetic construct
  source 1..25: note = Seed: VKLQTVHSIPLTINKEEALQRPVAS
VKLQTVHSIPITIMKDEAYQRPVAS

SEQ ID NO: 56586 - protein, 25 aa, synthetic construct
  source 1..25: note = Seed: VKLQTVHSIPLTINKEEALQRPVAS
VKLQTVHSIPITIMKFEAAQRPVAS

SEQ ID NO: 56587 - protein, 25 aa, synthetic construct
  source 1..25: note = Seed: VKLQTVHSIPLTINKEEALQRPVAS
VKLQTVHSIPITIMKFEADQRPVAS

SEQ ID NO: 56588 - protein, 25 aa, synthetic construct
  source 1..25: note = Seed: VKLQTVHSIPLTINKEEALQRPVAS
VKLQTVHSIPITIMKFEAEQRPVAS

SEQ ID NO: 56589 - protein, 25 aa, synthetic construct
  source 1..25: note = Seed: VKLQTVHSIPLTINKEEALQRPVAS
VKLQTVHSIPITIMKFEAFQRPVAS

SEQ ID NO: 56590 - protein, 25 aa, synthetic construct
  source 1..25: note = Seed: VKLQTVHSIPLTINKEEALQRPVAS
VKLQTVHSIPITIMKFEAHQRPVAS

SEQ ID NO: 56591 - protein, 25 aa, synthetic construct
  source 1..25: note = Seed: VKLQTVHSIPLTINKEEALQRPVAS
VKLQTVHSIPITIMKFEAIQRPVAS

SEQ ID NO: 56592 - protein, 25 aa, synthetic construct
  source 1..25: note = Seed: VKLQTVHSIPLTINKEEALQRPVAS
VKLQTVHSIPITIMKFEALQRPVAS

SEQ ID NO: 56593 - protein, 25 aa, synthetic construct
  source 1..25: note = Seed: VKLQTVHSIPLTINKEEALQRPVAS
VKLQTVHSIPITIMKFEAMQRPVAS

SEQ ID NO: 56594 - protein, 25 aa, synthetic construct
  source 1..25: note = Seed: VKLQTVHSIPLTINKEEALQRPVAS
VKLQTVHSIPITIMKFEANQRPVAS

SEQ ID NO: 56595 - protein, 25 aa, synthetic construct
  source 1..25: note = Seed: VKLQTVHSIPLTINKEEALQRPVAS
VKLQTVHSIPITIMKFEASQRPVAS

SEQ ID NO: 56596 - protein, 25 aa, synthetic construct
  source 1..25: note = Seed: VKLQTVHSIPLTINKEEALQRPVAS
VKLQTVHSIPITIMKFEATQRPVAS

SEQ ID NO: 56597 - protein, 25 aa, synthetic construct
  source 1..25: note = Seed: VKLQTVHSIPLTINKEEALQRPVAS
VKLQTVHSIPITIMKFEAVQRPVAS

SEQ ID NO: 56598 - protein, 25 aa, synthetic construct
  source 1..25: note = Seed: VKLQTVHSIPLTINKEEALQRPVAS
VKLQTVHSIPITIMKFEAWQRPVAS

SEQ ID NO: 56599 - protein, 25 aa, synthetic construct
  source 1..25: note = Seed: VKLQTVHSIPLTINKEEALQRPVAS
VKLQTVHSIPITIMKFEAYQRPVAS

SEQ ID NO: 56600 - protein, 25 aa, synthetic construct
  source 1..25: note = Seed: VKLQTVHSIPLTINKEEALQRPVAS
VKLQTVHSIPITIMKGEAAQRPVAS

SEQ ID NO: 56601 - protein, 25 aa, synthetic construct
  source 1..25: note = Seed: VKLQTVHSIPLTINKEEALQRPVAS
VKLQTVHSIPITIMKGEAIQRPVAS

SEQ ID NO: 56602 - protein, 25 aa, synthetic construct
  source 1..25: note = Seed: VKLQTVHSIPLTINKEEALQRPVAS
VKLQTVHSIPITIMKGEALQRPVAS

SEQ ID NO: 56603 - protein, 25 aa, synthetic construct
  source 1..25: note = Seed: VKLQTVHSIPLTINKEEALQRPVAS
VKLQTVHSIPITIMKGEAVQRPVAS

SEQ ID NO: 56604 - protein, 25 aa, synthetic construct
  source 1..25: note = Seed: VKLQTVHSIPLTINKEEALQRPVAS
VKLQTVHSIPITIMKHEAFQRPVAS

SEQ ID NO: 56605 - protein, 25 aa, synthetic construct
  source 1..25: note = Seed: VKLQTVHSIPLTINKEEALQRPVAS
VKLQTVHSIPITIMKHEAIQRPVAS

SEQ ID NO: 56606 - protein, 25 aa, synthetic construct
  source 1..25: note = Seed: VKLQTVHSIPLTINKEEALQRPVAS
VKLQTVHSIPITIMKHEALQRPVAS

SEQ ID NO: 56607 - protein, 25 aa, synthetic construct
  source 1..25: note = Seed: VKLQTVHSIPLTINKEEALQRPVAS
VKLQTVHSIPITIMKHEAMQRPVAS

SEQ ID NO: 56608 - protein, 25 aa, synthetic construct
  source 1..25: note = Seed: VKLQTVHSIPLTINKEEALQRPVAS
VKLQTVHSIPITIMKHEAVQRPVAS

SEQ ID NO: 56609 - protein, 25 aa, synthetic construct
  source 1..25: note = Seed: VKLQTVHSIPLTINKEEALQRPVAS
VKLQTVHSIPITIMKHEAYQRPVAS

SEQ ID NO: 56610 - protein, 25 aa, synthetic construct
  source 1..25: note = Seed: VKLQTVHSIPLTINKEEALQRPVAS
VKLQTVHSIPITIMKIEAAQRPVAS

SEQ ID NO: 56611 - protein, 25 aa, synthetic construct
  source 1..25: note = Seed: VKLQTVHSIPLTINKEEALQRPVAS
VKLQTVHSIPITIMKIEACQRPVAS

SEQ ID NO: 56612 - protein, 25 aa, synthetic construct
  source 1..25: note = Seed: VKLQTVHSIPLTINKEEALQRPVAS
VKLQTVHSIPITIMKIEADQRPVAS

SEQ ID NO: 56613 - protein, 25 aa, synthetic construct
  source 1..25: note = Seed: VKLQTVHSIPLTINKEEALQRPVAS
VKLQTVHSIPITIMKIEAEQRPVAS

SEQ ID NO: 56614 - protein, 25 aa, synthetic construct
  source 1..25: note = Seed: VKLQTVHSIPLTINKEEALQRPVAS
VKLQTVHSIPITIMKIEAFQRPVAS

SEQ ID NO: 56615 - protein, 25 aa, synthetic construct
  source 1..25: note = Seed: VKLQTVHSIPLTINKEEALQRPVAS
VKLQTVHSIPITIMKIEAGQRPVAS

SEQ ID NO: 56616 - protein, 25 aa, synthetic construct
  source 1..25: note = Seed: VKLQTVHSIPLTINKEEALQRPVAS
VKLQTVHSIPITIMKIEAIQRPVAS

SEQ ID NO: 56617 - protein, 25 aa, synthetic construct
  source 1..25: note = Seed: VKLQTVHSIPLTINKEEALQRPVAS
VKLQTVHSIPITIMKIEALQRPVAS

SEQ ID NO: 56618 - protein, 25 aa, synthetic construct
  source 1..25: note = Seed: VKLQTVHSIPLTINKEEALQRPVAS
VKLQTVHSIPITIMKIEAMQRPVAS

SEQ ID NO: 56619 - protein, 25 aa, synthetic construct
  source 1..25: note = Seed: VKLQTVHSIPLTINKEEALQRPVAS
VKLQTVHSIPITIMKIEANQRPVAS

SEQ ID NO: 56620 - protein, 25 aa, synthetic construct
  source 1..25: note = Seed: VKLQTVHSIPLTINKEEALQRPVAS
VKLQTVHSIPITIMKIEAQQRPVAS

SEQ ID NO: 56621 - protein, 25 aa, synthetic construct
  source 1..25: note = Seed: VKLQTVHSIPLTINKEEALQRPVAS
VKLQTVHSIPITIMKIEARQRPVAS

SEQ ID NO: 56622 - protein, 25 aa, synthetic construct
  source 1..25: note = Seed: VKLQTVHSIPLTINKEEALQRPVAS
VKLQTVHSIPITIMKIEASQRPVAS

SEQ ID NO: 56623 - protein, 25 aa, synthetic construct
  source 1..25: note = Seed: VKLQTVHSIPLTINKEEALQRPVAS
VKLQTVHSIPITIMKIEATQRPVAS

SEQ ID NO: 56624 - protein, 25 aa, synthetic construct
  source 1..25: note = Seed: VKLQTVHSIPLTINKEEALQRPVAS
VKLQTVHSIPITIMKIEAVQRPVAS

SEQ ID NO: 56625 - protein, 25 aa, synthetic construct
  source 1..25: note = Seed: VKLQTVHSIPLTINKEEALQRPVAS
VKLQTVHSIPITIMKIEAYQRPVAS

SEQ ID NO: 56626 - protein, 25 aa, synthetic construct
  source 1..25: note = Seed: VKLQTVHSIPLTINKEEALQRPVAS
VKLQTVHSIPITIMKKEAFQRPVAS

SEQ ID NO: 56627 - protein, 25 aa, synthetic construct
  source 1..25: note = Seed: VKLQTVHSIPLTINKEEALQRPVAS
VKLQTVHSIPITIMKKEAIQRPVAS

SEQ ID NO: 56628 - protein, 25 aa, synthetic construct
  source 1..25: note = Seed: VKLQTVHSIPLTINKEEALQRPVAS
VKLQTVHSIPITIMKKEALQRPVAS

SEQ ID NO: 56629 - protein, 25 aa, synthetic construct
  source 1..25: note = Seed: VKLQTVHSIPLTINKEEALQRPVAS
VKLQTVHSIPITIMKKEAMQRPVAS

SEQ ID NO: 56630 - protein, 25 aa, synthetic construct
  source 1..25: note = Seed: VKLQTVHSIPLTINKEEALQRPVAS
VKLQTVHSIPITIMKKEAVQRPVAS

SEQ ID NO: 56631 - protein, 25 aa, synthetic construct
  source 1..25: note = Seed: VKLQTVHSIPLTINKEEALQRPVAS
VKLQTVHSIPITIMKKEAYQRPVAS

SEQ ID NO: 56632 - protein, 25 aa, synthetic construct
  source 1..25: note = Seed: VKLQTVHSIPLTINKEEALQRPVAS
VKLQTVHSIPITIMKLEAAQRPVAS

SEQ ID NO: 56633 - protein, 25 aa, synthetic construct
  source 1..25: note = Seed: VKLQTVHSIPLTINKEEALQRPVAS
VKLQTVHSIPITIMKLEADQRPVAS

SEQ ID NO: 56634 - protein, 25 aa, synthetic construct
  source 1..25: note = Seed: VKLQTVHSIPLTINKEEALQRPVAS
VKLQTVHSIPITIMKLEAFQRPVAS

SEQ ID NO: 56635 - protein, 25 aa, synthetic construct
  source 1..25: note = Seed: VKLQTVHSIPLTINKEEALQRPVAS
VKLQTVHSIPITIMKLEAIQRPVAS

SEQ ID NO: 56636 - protein, 25 aa, synthetic construct
  source 1..25: note = Seed: VKLQTVHSIPLTINKEEALQRPVAS
VKLQTVHSIPITIMKLEALQRPVAS

SEQ ID NO: 56637 - protein, 25 aa, synthetic construct
  source 1..25: note = Seed: VKLQTVHSIPLTINKEEALQRPVAS
VKLQTVHSIPITIMKLEAMQRPVAS

SEQ ID NO: 56638 - protein, 25 aa, synthetic construct
  source 1..25: note = Seed: VKLQTVHSIPLTINKEEALQRPVAS
VKLQTVHSIPITIMKLEANQRPVAS

SEQ ID NO: 56639 - protein, 25 aa, synthetic construct
  source 1..25: note = Seed: VKLQTVHSIPLTINKEEALQRPVAS
VKLQTVHSIPITIMKLEASQRPVAS

SEQ ID NO: 56640 - protein, 25 aa, synthetic construct
  source 1..25: note = Seed: VKLQTVHSIPLTINKEEALQRPVAS
VKLQTVHSIPITIMKLEATQRPVAS

SEQ ID NO: 56641 - protein, 25 aa, synthetic construct
  source 1..25: note = Seed: VKLQTVHSIPLTINKEEALQRPVAS
VKLQTVHSIPITIMKLEAVQRPVAS

SEQ ID NO: 56642 - protein, 25 aa, synthetic construct
  source 1..25: note = Seed: VKLQTVHSIPLTINKEEALQRPVAS
VKLQTVHSIPITIMKLEAYQRPVAS

SEQ ID NO: 56643 - protein, 25 aa, synthetic construct
  source 1..25: note = Seed: VKLQTVHSIPLTINKEEALQRPVAS
VKLQTVHSIPITIMKMEAAQRPVAS

SEQ ID NO: 56644 - protein, 25 aa, synthetic construct
  source 1..25: note = Seed: VKLQTVHSIPLTINKEEALQRPVAS
VKLQTVHSIPITIMKMEAFQRPVAS

SEQ ID NO: 56645 - protein, 25 aa, synthetic construct
  source 1..25: note = Seed: VKLQTVHSIPLTINKEEALQRPVAS
VKLQTVHSIPITIMKMEAIQRPVAS

SEQ ID NO: 56646 - protein, 25 aa, synthetic construct
  source 1..25: note = Seed: VKLQTVHSIPLTINKEEALQRPVAS
VKLQTVHSIPITIMKMEALQRPVAS

SEQ ID NO: 56647 - protein, 25 aa, synthetic construct
  source 1..25: note = Seed: VKLQTVHSIPLTINKEEALQRPVAS
VKLQTVHSIPITIMKMEAMQRPVAS

SEQ ID NO: 56648 - protein, 25 aa, synthetic construct
  source 1..25: note = Seed: VKLQTVHSIPLTINKEEALQRPVAS
VKLQTVHSIPITIMKMEANQRPVAS

SEQ ID NO: 56649 - protein, 25 aa, synthetic construct
  source 1..25: note = Seed: VKLQTVHSIPLTINKEEALQRPVAS
VKLQTVHSIPITIMKMEASQRPVAS

SEQ ID NO: 56650 - protein, 25 aa, synthetic construct
  source 1..25: note = Seed: VKLQTVHSIPLTINKEEALQRPVAS
VKLQTVHSIPITIMKMEATQRPVAS

SEQ ID NO: 56651 - protein, 25 aa, synthetic construct
  source 1..25: note = Seed: VKLQTVHSIPLTINKEEALQRPVAS
VKLQTVHSIPITIMKMEAVQRPVAS

SEQ ID NO: 56652 - protein, 25 aa, synthetic construct
  source 1..25: note = Seed: VKLQTVHSIPLTINKEEALQRPVAS
VKLQTVHSIPITIMKMEAYQRPVAS

SEQ ID NO: 56653 - protein, 25 aa, synthetic construct
  source 1..25: note = Seed: VKLQTVHSIPLTINKEEALQRPVAS
VKLQTVHSIPITIMKNEAAQRPVAS

SEQ ID NO: 56654 - protein, 25 aa, synthetic construct
  source 1..25: note = Seed: VKLQTVHSIPLTINKEEALQRPVAS
VKLQTVHSIPITIMKNEAFQRPVAS

SEQ ID NO: 56655 - protein, 25 aa, synthetic construct
  source 1..25: note = Seed: VKLQTVHSIPLTINKEEALQRPVAS
VKLQTVHSIPITIMKNEAIQRPVAS

SEQ ID NO: 56656 - protein, 25 aa, synthetic construct
  source 1..25: note = Seed: VKLQTVHSIPLTINKEEALQRPVAS
VKLQTVHSIPITIMKNEALQRPVAS

SEQ ID NO: 56657 - protein, 25 aa, synthetic construct
  source 1..25: note = Seed: VKLQTVHSIPLTINKEEALQRPVAS
VKLQTVHSIPITIMKNEAMQRPVAS

SEQ ID NO: 56658 - protein, 25 aa, synthetic construct
  source 1..25: note = Seed: VKLQTVHSIPLTINKEEALQRPVAS
VKLQTVHSIPITIMKNEASQRPVAS

SEQ ID NO: 56659 - protein, 25 aa, synthetic construct
  source 1..25: note = Seed: VKLQTVHSIPLTINKEEALQRPVAS
VKLQTVHSIPITIMKNEAVQRPVAS

SEQ ID NO: 56660 - protein, 25 aa, synthetic construct
  source 1..25: note = Seed: VKLQTVHSIPLTINKEEALQRPVAS
VKLQTVHSIPITIMKNEAYQRPVAS

SEQ ID NO: 56661 - protein, 25 aa, synthetic construct
  source 1..25: note = Seed: VKLQTVHSIPLTINKEEALQRPVAS
VKLQTVHSIPITIMKPEAAQRPVAS

SEQ ID NO: 56662 - protein, 25 aa, synthetic construct
  source 1..25: note = Seed: VKLQTVHSIPLTINKEEALQRPVAS
VKLQTVHSIPITIMKPEAIQRPVAS

SEQ ID NO: 56663 - protein, 25 aa, synthetic construct
  source 1..25: note = Seed: VKLQTVHSIPLTINKEEALQRPVAS
VKLQTVHSIPITIMKPEALQRPVAS

SEQ ID NO: 56664 - protein, 25 aa, synthetic construct
  source 1..25: note = Seed: VKLQTVHSIPLTINKEEALQRPVAS
VKLQTVHSIPITIMKPEAMQRPVAS

SEQ ID NO: 56665 - protein, 25 aa, synthetic construct
  source 1..25: note = Seed: VKLQTVHSIPLTINKEEALQRPVAS
VKLQTVHSIPITIMKPEAVQRPVAS

SEQ ID NO: 56666 - protein, 25 aa, synthetic construct
  source 1..25: note = Seed: VKLQTVHSIPLTINKEEALQRPVAS
VKLQTVHSIPITIMKREAAQRPVAS

SEQ ID NO: 56667 - protein, 25 aa, synthetic construct
  source 1..25: note = Seed: VKLQTVHSIPLTINKEEALQRPVAS
VKLQTVHSIPITIMKREAFQRPVAS

SEQ ID NO: 56668 - protein, 25 aa, synthetic construct
  source 1..25: note = Seed: VKLQTVHSIPLTINKEEALQRPVAS
VKLQTVHSIPITIMKREAHQRPVAS

SEQ ID NO: 56669 - protein, 25 aa, synthetic construct
  source 1..25: note = Seed: VKLQTVHSIPLTINKEEALQRPVAS
VKLQTVHSIPITIMKREAIQRPVAS

SEQ ID NO: 56670 - protein, 25 aa, synthetic construct
  source 1..25: note = Seed: VKLQTVHSIPLTINKEEALQRPVAS
VKLQTVHSIPITIMKREALQRPVAS

SEQ ID NO: 56671 - protein, 25 aa, synthetic construct
  source 1..25: note = Seed: VKLQTVHSIPLTINKEEALQRPVAS
VKLQTVHSIPITIMKREAMQRPVAS

SEQ ID NO: 56672 - protein, 25 aa, synthetic construct
  source 1..25: note = Seed: VKLQTVHSIPLTINKEEALQRPVAS
VKLQTVHSIPITIMKREARQRPVAS

SEQ ID NO: 56673 - protein, 25 aa, synthetic construct
  source 1..25: note = Seed: VKLQTVHSIPLTINKEEALQRPVAS
VKLQTVHSIPITIMKREAVQRPVAS

SEQ ID NO: 56674 - protein, 25 aa, synthetic construct
  source 1..25: note = Seed: VKLQTVHSIPLTINKEEALQRPVAS
VKLQTVHSIPITIMKREAYQRPVAS

SEQ ID NO: 56675 - protein, 25 aa, synthetic construct
  source 1..25: note = Seed: VKLQTVHSIPLTINKEEALQRPVAS
VKLQTVHSIPITIMKSEAAQRPVAS

SEQ ID NO: 56676 - protein, 25 aa, synthetic construct
  source 1..25: note = Seed: VKLQTVHSIPLTINKEEALQRPVAS
VKLQTVHSIPITIMKSEAFQRPVAS

SEQ ID NO: 56677 - protein, 25 aa, synthetic construct
  source 1..25: note = Seed: VKLQTVHSIPLTINKEEALQRPVAS
VKLQTVHSIPITIMKSEAIQRPVAS

SEQ ID NO: 56678 - protein, 25 aa, synthetic construct
  source 1..25: note = Seed: VKLQTVHSIPLTINKEEALQRPVAS
VKLQTVHSIPITIMKSEALQRPVAS

SEQ ID NO: 56679 - protein, 25 aa, synthetic construct
  source 1..25: note = Seed: VKLQTVHSIPLTINKEEALQRPVAS
VKLQTVHSIPITIMKSEAMQRPVAS

SEQ ID NO: 56680 - protein, 25 aa, synthetic construct
  source 1..25: note = Seed: VKLQTVHSIPLTINKEEALQRPVAS
VKLQTVHSIPITIMKSEASQRPVAS

SEQ ID NO: 56681 - protein, 25 aa, synthetic construct
  source 1..25: note = Seed: VKLQTVHSIPLTINKEEALQRPVAS
VKLQTVHSIPITIMKSEAVQRPVAS

SEQ ID NO: 56682 - protein, 25 aa, synthetic construct
  source 1..25: note = Seed: VKLQTVHSIPLTINKEEALQRPVAS
VKLQTVHSIPITIMKSEAYQRPVAS

SEQ ID NO: 56683 - protein, 25 aa, synthetic construct
  source 1..25: note = Seed: VKLQTVHSIPLTINKEEALQRPVAS
VKLQTVHSIPITIMKTEAAQRPVAS

SEQ ID NO: 56684 - protein, 25 aa, synthetic construct
  source 1..25: note = Seed: VKLQTVHSIPLTINKEEALQRPVAS
VKLQTVHSIPITIMKTEAFQRPVAS

SEQ ID NO: 56685 - protein, 25 aa, synthetic construct
  source 1..25: note = Seed: VKLQTVHSIPLTINKEEALQRPVAS
VKLQTVHSIPITIMKTEAIQRPVAS

SEQ ID NO: 56686 - protein, 25 aa, synthetic construct
  source 1..25: note = Seed: VKLQTVHSIPLTINKEEALQRPVAS
VKLQTVHSIPITIMKTEALQRPVAS

SEQ ID NO: 56687 - protein, 25 aa, synthetic construct
  source 1..25: note = Seed: VKLQTVHSIPLTINKEEALQRPVAS
VKLQTVHSIPITIMKTEAMQRPVAS

SEQ ID NO: 56688 - protein, 25 aa, synthetic construct
  source 1..25: note = Seed: VKLQTVHSIPLTINKEEALQRPVAS
VKLQTVHSIPITIMKTEAVQRPVAS

SEQ ID NO: 56689 - protein, 25 aa, synthetic construct
  source 1..25: note = Seed: VKLQTVHSIPLTINKEEALQRPVAS
VKLQTVHSIPITIMKVEAAQRPVAS

SEQ ID NO: 56690 - protein, 25 aa, synthetic construct
  source 1..25: note = Seed: VKLQTVHSIPLTINKEEALQRPVAS
VKLQTVHSIPITIMKVEADQRPVAS

SEQ ID NO: 56691 - protein, 25 aa, synthetic construct
  source 1..25: note = Seed: VKLQTVHSIPLTINKEEALQRPVAS
VKLQTVHSIPITIMKVEAFQRPVAS

SEQ ID NO: 56692 - protein, 25 aa, synthetic construct
  source 1..25: note = Seed: VKLQTVHSIPLTINKEEALQRPVAS
VKLQTVHSIPITIMKVEAGQRPVAS

SEQ ID NO: 56693 - protein, 25 aa, synthetic construct
  source 1..25: note = Seed: VKLQTVHSIPLTINKEEALQRPVAS
VKLQTVHSIPITIMKVEAIQRPVAS

SEQ ID NO: 56694 - protein, 25 aa, synthetic construct
  source 1..25: note = Seed: VKLQTVHSIPLTINKEEALQRPVAS
VKLQTVHSIPITIMKVEALQRPVAS

SEQ ID NO: 56695 - protein, 25 aa, synthetic construct
  source 1..25: note = Seed: VKLQTVHSIPLTINKEEALQRPVAS
VKLQTVHSIPITIMKVEAMQRPVAS

SEQ ID NO: 56696 - protein, 25 aa, synthetic construct
  source 1..25: note = Seed: VKLQTVHSIPLTINKEEALQRPVAS
VKLQTVHSIPITIMKVEANQRPVAS

SEQ ID NO: 56697 - protein, 25 aa, synthetic construct
  source 1..25: note = Seed: VKLQTVHSIPLTINKEEALQRPVAS
VKLQTVHSIPITIMKVEAQQRPVAS

SEQ ID NO: 56698 - protein, 25 aa, synthetic construct
  source 1..25: note = Seed: VKLQTVHSIPLTINKEEALQRPVAS
VKLQTVHSIPITIMKVEASQRPVAS

SEQ ID NO: 56699 - protein, 25 aa, synthetic construct
  source 1..25: note = Seed: VKLQTVHSIPLTINKEEALQRPVAS
VKLQTVHSIPITIMKVEATQRPVAS

SEQ ID NO: 56700 - protein, 25 aa, synthetic construct
  source 1..25: note = Seed: VKLQTVHSIPLTINKEEALQRPVAS
VKLQTVHSIPITIMKVEAVQRPVAS

SEQ ID NO: 56701 - protein, 25 aa, synthetic construct
  source 1..25: note = Seed: VKLQTVHSIPLTINKEEALQRPVAS
VKLQTVHSIPITIMKVEAYQRPVAS

SEQ ID NO: 56702 - protein, 25 aa, synthetic construct
  source 1..25: note = Seed: VKLQTVHSIPLTINKEEALQRPVAS
VKLQTVHSIPITIMKWEAAQRPVAS

SEQ ID NO: 56703 - protein, 25 aa, synthetic construct
  source 1..25: note = Seed: VKLQTVHSIPLTINKEEALQRPVAS
VKLQTVHSIPITIMKWEAFQRPVAS

SEQ ID NO: 56704 - protein, 25 aa, synthetic construct
  source 1..25: note = Seed: VKLQTVHSIPLTINKEEALQRPVAS
VKLQTVHSIPITIMKWEAIQRPVAS

SEQ ID NO: 56705 - protein, 25 aa, synthetic construct
  source 1..25: note = Seed: VKLQTVHSIPLTINKEEALQRPVAS
VKLQTVHSIPITIMKWEALQRPVAS

SEQ ID NO: 56706 - protein, 25 aa, synthetic construct
  source 1..25: note = Seed: VKLQTVHSIPLTINKEEALQRPVAS
VKLQTVHSIPITIMKWEAMQRPVAS

SEQ ID NO: 56707 - protein, 25 aa, synthetic construct
  source 1..25: note = Seed: VKLQTVHSIPLTINKEEALQRPVAS
VKLQTVHSIPITIMKWEAVQRPVAS

SEQ ID NO: 56708 - protein, 25 aa, synthetic construct
  source 1..25: note = Seed: VKLQTVHSIPLTINKEEALQRPVAS
VKLQTVHSIPITIMKYEAFQRPVAS

SEQ ID NO: 56709 - protein, 25 aa, synthetic construct
  source 1..25: note = Seed: VKLQTVHSIPLTINKEEALQRPVAS
VKLQTVHSIPITIMKYEAIQRPVAS

SEQ ID NO: 56710 - protein, 25 aa, synthetic construct
  source 1..25: note = Seed: VKLQTVHSIPLTINKEEALQRPVAS
VKLQTVHSIPITIMKYEALQRPVAS

SEQ ID NO: 56711 - protein, 25 aa, synthetic construct
  source 1..25: note = Seed: VKLQTVHSIPLTINKEEALQRPVAS
VKLQTVHSIPITIMKYEAMQRPVAS

SEQ ID NO: 56712 - protein, 25 aa, synthetic construct
  source 1..25: note = Seed: VKLQTVHSIPLTINKEEALQRPVAS
VKLQTVHSIPITIMKYEAVQRPVAS

SEQ ID NO: 56713 - protein, 25 aa, synthetic construct
  source 1..25: note = Seed: VKLQTVHSIPLTINKEEALQRPVAS
VKLQTVHSIPITIMKYEAYQRPVAS

SEQ ID NO: 56714 - protein, 25 aa, synthetic construct
  source 1..25: note = Seed: VKLQTVHSIPLTINKEEALQRPVAS
VKLQTVHSIPITINKAEAAQRPVAS

SEQ ID NO: 56715 - protein, 25 aa, synthetic construct
  source 1..25: note = Seed: VKLQTVHSIPLTINKEEALQRPVAS
VKLQTVHSIPITINKAEAFQRPVAS

SEQ ID NO: 56716 - protein, 25 aa, synthetic construct
  source 1..25: note = Seed: VKLQTVHSIPLTINKEEALQRPVAS
VKLQTVHSIPITINKAEAGQRPVAS

SEQ ID NO: 56717 - protein, 25 aa, synthetic construct
  source 1..25: note = Seed: VKLQTVHSIPLTINKEEALQRPVAS
VKLQTVHSIPITINKAEAHQRPVAS

SEQ ID NO: 56718 - protein, 25 aa, synthetic construct
  source 1..25: note = Seed: VKLQTVHSIPLTINKEEALQRPVAS
VKLQTVHSIPITINKAEAIQRPVAS

SEQ ID NO: 56719 - protein, 25 aa, synthetic construct
  source 1..25: note = Seed: VKLQTVHSIPLTINKEEALQRPVAS
VKLQTVHSIPITINKAEALQRPVAS

SEQ ID NO: 56720 - protein, 25 aa, synthetic construct
  source 1..25: note = Seed: VKLQTVHSIPLTINKEEALQRPVAS
VKLQTVHSIPITINKAEAMQRPVAS

SEQ ID NO: 56721 - protein, 25 aa, synthetic construct
  source 1..25: note = Seed: VKLQTVHSIPLTINKEEALQRPVAS
VKLQTVHSIPITINKAEANQRPVAS

SEQ ID NO: 56722 - protein, 25 aa, synthetic construct
  source 1..25: note = Seed: VKLQTVHSIPLTINKEEALQRPVAS
VKLQTVHSIPITINKAEAQQRPVAS

SEQ ID NO: 56723 - protein, 25 aa, synthetic construct
  source 1..25: note = Seed: VKLQTVHSIPLTINKEEALQRPVAS
VKLQTVHSIPITINKAEASQRPVAS

SEQ ID NO: 56724 - protein, 25 aa, synthetic construct
  source 1..25: note = Seed: VKLQTVHSIPLTINKEEALQRPVAS
VKLQTVHSIPITINKAEATQRPVAS

SEQ ID NO: 56725 - protein, 25 aa, synthetic construct
  source 1..25: note = Seed: VKLQTVHSIPLTINKEEALQRPVAS
VKLQTVHSIPITINKAEAVQRPVAS

SEQ ID NO: 56726 - protein, 25 aa, synthetic construct
  source 1..25: note = Seed: VKLQTVHSIPLTINKEEALQRPVAS
VKLQTVHSIPITINKAEAWQRPVAS

SEQ ID NO: 56727 - protein, 25 aa, synthetic construct
  source 1..25: note = Seed: VKLQTVHSIPLTINKEEALQRPVAS
VKLQTVHSIPITINKAEAYQRPVAS

SEQ ID NO: 56728 - protein, 25 aa, synthetic construct
  source 1..25: note = Seed: VKLQTVHSIPLTINKEEALQRPVAS
VKLQTVHSIPITINKCEAIQRPVAS

SEQ ID NO: 56729 - protein, 25 aa, synthetic construct
  source 1..25: note = Seed: VKLQTVHSIPLTINKEEALQRPVAS
VKLQTVHSIPITINKCEALQRPVAS

SEQ ID NO: 56730 - protein, 25 aa, synthetic construct
  source 1..25: note = Seed: VKLQTVHSIPLTINKEEALQRPVAS
VKLQTVHSIPITINKCEAVQRPVAS

SEQ ID NO: 56731 - protein, 25 aa, synthetic construct
  source 1..25: note = Seed: VKLQTVHSIPLTINKEEALQRPVAS
VKLQTVHSIPITINKDEAIQRPVAS

SEQ ID NO: 56732 - protein, 25 aa, synthetic construct
  source 1..25: note = Seed: VKLQTVHSIPLTINKEEALQRPVAS
VKLQTVHSIPITINKDEALQRPVAS

SEQ ID NO: 56733 - protein, 25 aa, synthetic construct
  source 1..25: note = Seed: VKLQTVHSIPLTINKEEALQRPVAS
VKLQTVHSIPITINKDEAVQRPVAS

SEQ ID NO: 56734 - protein, 25 aa, synthetic construct
  source 1..25: note = Seed: VKLQTVHSIPLTINKEEALQRPVAS
VKLQTVHSIPITINKEEAIQRPVAS

SEQ ID NO: 56735 - protein, 25 aa, synthetic construct
  source 1..25: note = Seed: VKLQTVHSIPLTINKEEALQRPVAS
VKLQTVHSIPITINKFEAAQRPVAS

SEQ ID NO: 56736 - protein, 25 aa, synthetic construct
  source 1..25: note = Seed: VKLQTVHSIPLTINKEEALQRPVAS
VKLQTVHSIPITINKFEAFQRPVAS

SEQ ID NO: 56737 - protein, 25 aa, synthetic construct
  source 1..25: note = Seed: VKLQTVHSIPLTINKEEALQRPVAS
VKLQTVHSIPITINKFEAIQRPVAS

SEQ ID NO: 56738 - protein, 25 aa, synthetic construct
  source 1..25: note = Seed: VKLQTVHSIPLTINKEEALQRPVAS
VKLQTVHSIPITINKFEALQRPVAS

SEQ ID NO: 56739 - protein, 25 aa, synthetic construct
  source 1..25: note = Seed: VKLQTVHSIPLTINKEEALQRPVAS
VKLQTVHSIPITINKFEAMQRPVAS

SEQ ID NO: 56740 - protein, 25 aa, synthetic construct
  source 1..25: note = Seed: VKLQTVHSIPLTINKEEALQRPVAS
VKLQTVHSIPITINKFEAVQRPVAS

SEQ ID NO: 56741 - protein, 25 aa, synthetic construct
  source 1..25: note = Seed: VKLQTVHSIPLTINKEEALQRPVAS
VKLQTVHSIPITINKFEAYQRPVAS

SEQ ID NO: 56742 - protein, 25 aa, synthetic construct
  source 1..25: note = Seed: VKLQTVHSIPLTINKEEALQRPVAS
VKLQTVHSIPITINKGEAAQRPVAS

SEQ ID NO: 56743 - protein, 25 aa, synthetic construct
  source 1..25: note = Seed: VKLQTVHSIPLTINKEEALQRPVAS
VKLQTVHSIPITINKGEAFQRPVAS

SEQ ID NO: 56744 - protein, 25 aa, synthetic construct
  source 1..25: note = Seed: VKLQTVHSIPLTINKEEALQRPVAS
VKLQTVHSIPITINKGEAIQRPVAS

SEQ ID NO: 56745 - protein, 25 aa, synthetic construct
  source 1..25: note = Seed: VKLQTVHSIPLTINKEEALQRPVAS
VKLQTVHSIPITINKGEALQRPVAS

SEQ ID NO: 56746 - protein, 25 aa, synthetic construct
  source 1..25: note = Seed: VKLQTVHSIPLTINKEEALQRPVAS
VKLQTVHSIPITINKGEAMQRPVAS

SEQ ID NO: 56747 - protein, 25 aa, synthetic construct
  source 1..25: note = Seed: VKLQTVHSIPLTINKEEALQRPVAS
VKLQTVHSIPITINKGEASQRPVAS

SEQ ID NO: 56748 - protein, 25 aa, synthetic construct
  source 1..25: note = Seed: VKLQTVHSIPLTINKEEALQRPVAS
VKLQTVHSIPITINKGEATQRPVAS

SEQ ID NO: 56749 - protein, 25 aa, synthetic construct
  source 1..25: note = Seed: VKLQTVHSIPLTINKEEALQRPVAS
VKLQTVHSIPITINKGEAVQRPVAS

SEQ ID NO: 56750 - protein, 25 aa, synthetic construct
  source 1..25: note = Seed: VKLQTVHSIPLTINKEEALQRPVAS
VKLQTVHSIPITINKGEAWQRPVAS

SEQ ID NO: 56751 - protein, 25 aa, synthetic construct
  source 1..25: note = Seed: VKLQTVHSIPLTINKEEALQRPVAS
VKLQTVHSIPITINKGEAYQRPVAS

SEQ ID NO: 56752 - protein, 25 aa, synthetic construct
  source 1..25: note = Seed: VKLQTVHSIPLTINKEEALQRPVAS
VKLQTVHSIPITINKHEAAQRPVAS

SEQ ID NO: 56753 - protein, 25 aa, synthetic construct
  source 1..25: note = Seed: VKLQTVHSIPLTINKEEALQRPVAS
VKLQTVHSIPITINKHEAFQRPVAS

SEQ ID NO: 56754 - protein, 25 aa, synthetic construct
  source 1..25: note = Seed: VKLQTVHSIPLTINKEEALQRPVAS
VKLQTVHSIPITINKHEAIQRPVAS

SEQ ID NO: 56755 - protein, 25 aa, synthetic construct
  source 1..25: note = Seed: VKLQTVHSIPLTINKEEALQRPVAS
VKLQTVHSIPITINKHEALQRPVAS

SEQ ID NO: 56756 - protein, 25 aa, synthetic construct
  source 1..25: note = Seed: VKLQTVHSIPLTINKEEALQRPVAS
VKLQTVHSIPITINKHEAMQRPVAS

SEQ ID NO: 56757 - protein, 25 aa, synthetic construct
  source 1..25: note = Seed: VKLQTVHSIPLTINKEEALQRPVAS
VKLQTVHSIPITINKHEAVQRPVAS

SEQ ID NO: 56758 - protein, 25 aa, synthetic construct
  source 1..25: note = Seed: VKLQTVHSIPLTINKEEALQRPVAS
VKLQTVHSIPITINKHEAYQRPVAS

SEQ ID NO: 56759 - protein, 25 aa, synthetic construct
  source 1..25: note = Seed: VKLQTVHSIPLTINKEEALQRPVAS
VKLQTVHSIPITINKIEAAQRPVAS

SEQ ID NO: 56760 - protein, 25 aa, synthetic construct
  source 1..25: note = Seed: VKLQTVHSIPLTINKEEALQRPVAS
VKLQTVHSIPITINKIEAFQRPVAS

SEQ ID NO: 56761 - protein, 25 aa, synthetic construct
  source 1..25: note = Seed: VKLQTVHSIPLTINKEEALQRPVAS
VKLQTVHSIPITINKIEAIQRPVAS

SEQ ID NO: 56762 - protein, 25 aa, synthetic construct
  source 1..25: note = Seed: VKLQTVHSIPLTINKEEALQRPVAS
VKLQTVHSIPITINKIEALQRPVAS

SEQ ID NO: 56763 - protein, 25 aa, synthetic construct
  source 1..25: note = Seed: VKLQTVHSIPLTINKEEALQRPVAS
VKLQTVHSIPITINKIEAMQRPVAS

SEQ ID NO: 56764 - protein, 25 aa, synthetic construct
  source 1..25: note = Seed: VKLQTVHSIPLTINKEEALQRPVAS
VKLQTVHSIPITINKIEANQRPVAS

SEQ ID NO: 56765 - protein, 25 aa, synthetic construct
  source 1..25: note = Seed: VKLQTVHSIPLTINKEEALQRPVAS
VKLQTVHSIPITINKIEASQRPVAS

SEQ ID NO: 56766 - protein, 25 aa, synthetic construct
  source 1..25: note = Seed: VKLQTVHSIPLTINKEEALQRPVAS
VKLQTVHSIPITINKIEATQRPVAS

SEQ ID NO: 56767 - protein, 25 aa, synthetic construct
  source 1..25: note = Seed: VKLQTVHSIPLTINKEEALQRPVAS
VKLQTVHSIPITINKIEAVQRPVAS

SEQ ID NO: 56768 - protein, 25 aa, synthetic construct
  source 1..25: note = Seed: VKLQTVHSIPLTINKEEALQRPVAS
VKLQTVHSIPITINKIEAWQRPVAS

SEQ ID NO: 56769 - protein, 25 aa, synthetic construct
  source 1..25: note = Seed: VKLQTVHSIPLTINKEEALQRPVAS
VKLQTVHSIPITINKIEAYQRPVAS

SEQ ID NO: 56770 - protein, 25 aa, synthetic construct
  source 1..25: note = Seed: VKLQTVHSIPLTINKEEALQRPVAS
VKLQTVHSIPITINKKEAIQRPVAS

SEQ ID NO: 56771 - protein, 25 aa, synthetic construct
  source 1..25: note = Seed: VKLQTVHSIPLTINKEEALQRPVAS
VKLQTVHSIPITINKKEAVQRPVAS

SEQ ID NO: 56772 - protein, 25 aa, synthetic construct
  source 1..25: note = Seed: VKLQTVHSIPLTINKEEALQRPVAS
VKLQTVHSIPITINKLEAAQRPVAS

SEQ ID NO: 56773 - protein, 25 aa, synthetic construct
  source 1..25: note = Seed: VKLQTVHSIPLTINKEEALQRPVAS
VKLQTVHSIPITINKLEAFQRPVAS

SEQ ID NO: 56774 - protein, 25 aa, synthetic construct
  source 1..25: note = Seed: VKLQTVHSIPLTINKEEALQRPVAS
VKLQTVHSIPITINKLEAIQRPVAS

SEQ ID NO: 56775 - protein, 25 aa, synthetic construct
  source 1..25: note = Seed: VKLQTVHSIPLTINKEEALQRPVAS
VKLQTVHSIPITINKLEALQRPVAS

SEQ ID NO: 56776 - protein, 25 aa, synthetic construct
  source 1..25: note = Seed: VKLQTVHSIPLTINKEEALQRPVAS
VKLQTVHSIPITINKLEAMQRPVAS

SEQ ID NO: 56777 - protein, 25 aa, synthetic construct
  source 1..25: note = Seed: VKLQTVHSIPLTINKEEALQRPVAS
VKLQTVHSIPITINKLEASQRPVAS

SEQ ID NO: 56778 - protein, 25 aa, synthetic construct
  source 1..25: note = Seed: VKLQTVHSIPLTINKEEALQRPVAS
VKLQTVHSIPITINKLEATQRPVAS

SEQ ID NO: 56779 - protein, 25 aa, synthetic construct
  source 1..25: note = Seed: VKLQTVHSIPLTINKEEALQRPVAS
VKLQTVHSIPITINKLEAVQRPVAS

SEQ ID NO: 56780 - protein, 25 aa, synthetic construct
  source 1..25: note = Seed: VKLQTVHSIPLTINKEEALQRPVAS
VKLQTVHSIPITINKLEAYQRPVAS

SEQ ID NO: 56781 - protein, 25 aa, synthetic construct
  source 1..25: note = Seed: VKLQTVHSIPLTINKEEALQRPVAS
VKLQTVHSIPITINKMEAAQRPVAS

SEQ ID NO: 56782 - protein, 25 aa, synthetic construct
  source 1..25: note = Seed: VKLQTVHSIPLTINKEEALQRPVAS
VKLQTVHSIPITINKMEAFQRPVAS

SEQ ID NO: 56783 - protein, 25 aa, synthetic construct
  source 1..25: note = Seed: VKLQTVHSIPLTINKEEALQRPVAS
VKLQTVHSIPITINKMEAIQRPVAS

SEQ ID NO: 56784 - protein, 25 aa, synthetic construct
  source 1..25: note = Seed: VKLQTVHSIPLTINKEEALQRPVAS
VKLQTVHSIPITINKMEALQRPVAS

SEQ ID NO: 56785 - protein, 25 aa, synthetic construct
  source 1..25: note = Seed: VKLQTVHSIPLTINKEEALQRPVAS
VKLQTVHSIPITINKMEAMQRPVAS

SEQ ID NO: 56786 - protein, 25 aa, synthetic construct
  source 1..25: note = Seed: VKLQTVHSIPLTINKEEALQRPVAS
VKLQTVHSIPITINKMEAVQRPVAS

SEQ ID NO: 56787 - protein, 25 aa, synthetic construct
  source 1..25: note = Seed: VKLQTVHSIPLTINKEEALQRPVAS
VKLQTVHSIPITINKMEAYQRPVAS

SEQ ID NO: 56788 - protein, 25 aa, synthetic construct
  source 1..25: note = Seed: VKLQTVHSIPLTINKEEALQRPVAS
VKLQTVHSIPITINKNEAAQRPVAS

SEQ ID NO: 56789 - protein, 25 aa, synthetic construct
  source 1..25: note = Seed: VKLQTVHSIPLTINKEEALQRPVAS
VKLQTVHSIPITINKNEAFQRPVAS

SEQ ID NO: 56790 - protein, 25 aa, synthetic construct
  source 1..25: note = Seed: VKLQTVHSIPLTINKEEALQRPVAS
VKLQTVHSIPITINKNEAGQRPVAS

SEQ ID NO: 56791 - protein, 25 aa, synthetic construct
  source 1..25: note = Seed: VKLQTVHSIPLTINKEEALQRPVAS
VKLQTVHSIPITINKNEAHQRPVAS

SEQ ID NO: 56792 - protein, 25 aa, synthetic construct
  source 1..25: note = Seed: VKLQTVHSIPLTINKEEALQRPVAS
VKLQTVHSIPITINKNEAIQRPVAS

SEQ ID NO: 56793 - protein, 25 aa, synthetic construct
  source 1..25: note = Seed: VKLQTVHSIPLTINKEEALQRPVAS
VKLQTVHSIPITINKNEALQRPVAS

SEQ ID NO: 56794 - protein, 25 aa, synthetic construct
  source 1..25: note = Seed: VKLQTVHSIPLTINKEEALQRPVAS
VKLQTVHSIPITINKNEAMQRPVAS

SEQ ID NO: 56795 - protein, 25 aa, synthetic construct
  source 1..25: note = Seed: VKLQTVHSIPLTINKEEALQRPVAS
VKLQTVHSIPITINKNEANQRPVAS

SEQ ID NO: 56796 - protein, 25 aa, synthetic construct
  source 1..25: note = Seed: VKLQTVHSIPLTINKEEALQRPVAS
VKLQTVHSIPITINKNEAQQRPVAS

SEQ ID NO: 56797 - protein, 25 aa, synthetic construct
  source 1..25: note = Seed: VKLQTVHSIPLTINKEEALQRPVAS
VKLQTVHSIPITINKNEASQRPVAS

SEQ ID NO: 56798 - protein, 25 aa, synthetic construct
  source 1..25: note = Seed: VKLQTVHSIPLTINKEEALQRPVAS
VKLQTVHSIPITINKNEATQRPVAS

SEQ ID NO: 56799 - protein, 25 aa, synthetic construct
  source 1..25: note = Seed: VKLQTVHSIPLTINKEEALQRPVAS
VKLQTVHSIPITINKNEAVQRPVAS

SEQ ID NO: 56800 - protein, 25 aa, synthetic construct
  source 1..25: note = Seed: VKLQTVHSIPLTINKEEALQRPVAS
VKLQTVHSIPITINKNEAWQRPVAS

SEQ ID NO: 56801 - protein, 25 aa, synthetic construct
  source 1..25: note = Seed: VKLQTVHSIPLTINKEEALQRPVAS
VKLQTVHSIPITINKNEAYQRPVAS

SEQ ID NO: 56802 - protein, 25 aa, synthetic construct
  source 1..25: note = Seed: VKLQTVHSIPLTINKEEALQRPVAS
VKLQTVHSIPITINKPEAAQRPVAS

SEQ ID NO: 56803 - protein, 25 aa, synthetic construct
  source 1..25: note = Seed: VKLQTVHSIPLTINKEEALQRPVAS
VKLQTVHSIPITINKPEAFQRPVAS

SEQ ID NO: 56804 - protein, 25 aa, synthetic construct
  source 1..25: note = Seed: VKLQTVHSIPLTINKEEALQRPVAS
VKLQTVHSIPITINKPEAIQRPVAS

SEQ ID NO: 56805 - protein, 25 aa, synthetic construct
  source 1..25: note = Seed: VKLQTVHSIPLTINKEEALQRPVAS
VKLQTVHSIPITINKPEALQRPVAS

SEQ ID NO: 56806 - protein, 25 aa, synthetic construct
  source 1..25: note = Seed: VKLQTVHSIPLTINKEEALQRPVAS
VKLQTVHSIPITINKPEAMQRPVAS

SEQ ID NO: 56807 - protein, 25 aa, synthetic construct
  source 1..25: note = Seed: VKLQTVHSIPLTINKEEALQRPVAS
VKLQTVHSIPITINKPEASQRPVAS

SEQ ID NO: 56808 - protein, 25 aa, synthetic construct
  source 1..25: note = Seed: VKLQTVHSIPLTINKEEALQRPVAS
VKLQTVHSIPITINKPEATQRPVAS

SEQ ID NO: 56809 - protein, 25 aa, synthetic construct
  source 1..25: note = Seed: VKLQTVHSIPLTINKEEALQRPVAS
VKLQTVHSIPITINKPEAVQRPVAS

SEQ ID NO: 56810 - protein, 25 aa, synthetic construct
  source 1..25: note = Seed: VKLQTVHSIPLTINKEEALQRPVAS
VKLQTVHSIPITINKPEAWQRPVAS

SEQ ID NO: 56811 - protein, 25 aa, synthetic construct
  source 1..25: note = Seed: VKLQTVHSIPLTINKEEALQRPVAS
VKLQTVHSIPITINKPEAYQRPVAS

SEQ ID NO: 56812 - protein, 25 aa, synthetic construct
  source 1..25: note = Seed: VKLQTVHSIPLTINKEEALQRPVAS
VKLQTVHSIPITINKQEAIQRPVAS

SEQ ID NO: 56813 - protein, 25 aa, synthetic construct
  source 1..25: note = Seed: VKLQTVHSIPLTINKEEALQRPVAS
VKLQTVHSIPITINKQEALQRPVAS

SEQ ID NO: 56814 - protein, 25 aa, synthetic construct
  source 1..25: note = Seed: VKLQTVHSIPLTINKEEALQRPVAS
VKLQTVHSIPITINKQEAVQRPVAS

SEQ ID NO: 56815 - protein, 25 aa, synthetic construct
  source 1..25: note = Seed: VKLQTVHSIPLTINKEEALQRPVAS
VKLQTVHSIPITINKREAIQRPVAS

SEQ ID NO: 56816 - protein, 25 aa, synthetic construct
  source 1..25: note = Seed: VKLQTVHSIPLTINKEEALQRPVAS
VKLQTVHSIPITINKREALQRPVAS

SEQ ID NO: 56817 - protein, 25 aa, synthetic construct
  source 1..25: note = Seed: VKLQTVHSIPLTINKEEALQRPVAS
VKLQTVHSIPITINKREAVQRPVAS

SEQ ID NO: 56818 - protein, 25 aa, synthetic construct
  source 1..25: note = Seed: VKLQTVHSIPLTINKEEALQRPVAS
VKLQTVHSIPITINKSEAAQRPVAS

SEQ ID NO: 56819 - protein, 25 aa, synthetic construct
  source 1..25: note = Seed: VKLQTVHSIPLTINKEEALQRPVAS
VKLQTVHSIPITINKSEAFQRPVAS

SEQ ID NO: 56820 - protein, 25 aa, synthetic construct
  source 1..25: note = Seed: VKLQTVHSIPLTINKEEALQRPVAS
VKLQTVHSIPITINKSEAIQRPVAS

SEQ ID NO: 56821 - protein, 25 aa, synthetic construct
  source 1..25: note = Seed: VKLQTVHSIPLTINKEEALQRPVAS
VKLQTVHSIPITINKSEALQRPVAS

SEQ ID NO: 56822 - protein, 25 aa, synthetic construct
  source 1..25: note = Seed: VKLQTVHSIPLTINKEEALQRPVAS
VKLQTVHSIPITINKSEAMQRPVAS

SEQ ID NO: 56823 - protein, 25 aa, synthetic construct
  source 1..25: note = Seed: VKLQTVHSIPLTINKEEALQRPVAS
VKLQTVHSIPITINKSEANQRPVAS

SEQ ID NO: 56824 - protein, 25 aa, synthetic construct
  source 1..25: note = Seed: VKLQTVHSIPLTINKEEALQRPVAS
VKLQTVHSIPITINKSEASQRPVAS

SEQ ID NO: 56825 - protein, 25 aa, synthetic construct
  source 1..25: note = Seed: VKLQTVHSIPLTINKEEALQRPVAS
VKLQTVHSIPITINKSEATQRPVAS

SEQ ID NO: 56826 - protein, 25 aa, synthetic construct
  source 1..25: note = Seed: VKLQTVHSIPLTINKEEALQRPVAS
VKLQTVHSIPITINKSEAVQRPVAS

SEQ ID NO: 56827 - protein, 25 aa, synthetic construct
  source 1..25: note = Seed: VKLQTVHSIPLTINKEEALQRPVAS
VKLQTVHSIPITINKSEAWQRPVAS

SEQ ID NO: 56828 - protein, 25 aa, synthetic construct
  source 1..25: note = Seed: VKLQTVHSIPLTINKEEALQRPVAS
VKLQTVHSIPITINKSEAYQRPVAS

SEQ ID NO: 56829 - protein, 25 aa, synthetic construct
  source 1..25: note = Seed: VKLQTVHSIPLTINKEEALQRPVAS
VKLQTVHSIPITINKTEAAQRPVAS

SEQ ID NO: 56830 - protein, 25 aa, synthetic construct
  source 1..25: note = Seed: VKLQTVHSIPLTINKEEALQRPVAS
VKLQTVHSIPITINKTEAFQRPVAS

SEQ ID NO: 56831 - protein, 25 aa, synthetic construct
  source 1..25: note = Seed: VKLQTVHSIPLTINKEEALQRPVAS
VKLQTVHSIPITINKTEAIQRPVAS

SEQ ID NO: 56832 - protein, 25 aa, synthetic construct
  source 1..25: note = Seed: VKLQTVHSIPLTINKEEALQRPVAS
VKLQTVHSIPITINKTEALQRPVAS

SEQ ID NO: 56833 - protein, 25 aa, synthetic construct
  source 1..25: note = Seed: VKLQTVHSIPLTINKEEALQRPVAS
VKLQTVHSIPITINKTEAMQRPVAS

SEQ ID NO: 56834 - protein, 25 aa, synthetic construct
  source 1..25: note = Seed: VKLQTVHSIPLTINKEEALQRPVAS
VKLQTVHSIPITINKTEASQRPVAS

SEQ ID NO: 56835 - protein, 25 aa, synthetic construct
  source 1..25: note = Seed: VKLQTVHSIPLTINKEEALQRPVAS
VKLQTVHSIPITINKTEATQRPVAS

SEQ ID NO: 56836 - protein, 25 aa, synthetic construct
  source 1..25: note = Seed: VKLQTVHSIPLTINKEEALQRPVAS
VKLQTVHSIPITINKTEAVQRPVAS

SEQ ID NO: 56837 - protein, 25 aa, synthetic construct
  source 1..25: note = Seed: VKLQTVHSIPLTINKEEALQRPVAS
VKLQTVHSIPITINKTEAWQRPVAS

SEQ ID NO: 56838 - protein, 25 aa, synthetic construct
  source 1..25: note = Seed: VKLQTVHSIPLTINKEEALQRPVAS
VKLQTVHSIPITINKTEAYQRPVAS

SEQ ID NO: 56839 - protein, 25 aa, synthetic construct
  source 1..25: note = Seed: VKLQTVHSIPLTINKEEALQRPVAS
VKLQTVHSIPITINKVEAAQRPVAS

SEQ ID NO: 56840 - protein, 25 aa, synthetic construct
  source 1..25: note = Seed: VKLQTVHSIPLTINKEEALQRPVAS
VKLQTVHSIPITINKVEAFQRPVAS

SEQ ID NO: 56841 - protein, 25 aa, synthetic construct
  source 1..25: note = Seed: VKLQTVHSIPLTINKEEALQRPVAS
VKLQTVHSIPITINKVEAIQRPVAS

SEQ ID NO: 56842 - protein, 25 aa, synthetic construct
  source 1..25: note = Seed: VKLQTVHSIPLTINKEEALQRPVAS
VKLQTVHSIPITINKVEALQRPVAS

SEQ ID NO: 56843 - protein, 25 aa, synthetic construct
  source 1..25: note = Seed: VKLQTVHSIPLTINKEEALQRPVAS
VKLQTVHSIPITINKVEAMQRPVAS

SEQ ID NO: 56844 - protein, 25 aa, synthetic construct
  source 1..25: note = Seed: VKLQTVHSIPLTINKEEALQRPVAS
VKLQTVHSIPITINKVEASQRPVAS

SEQ ID NO: 56845 - protein, 25 aa, synthetic construct
  source 1..25: note = Seed: VKLQTVHSIPLTINKEEALQRPVAS
VKLQTVHSIPITINKVEATQRPVAS

SEQ ID NO: 56846 - protein, 25 aa, synthetic construct
  source 1..25: note = Seed: VKLQTVHSIPLTINKEEALQRPVAS
VKLQTVHSIPITINKVEAVQRPVAS

SEQ ID NO: 56847 - protein, 25 aa, synthetic construct
  source 1..25: note = Seed: VKLQTVHSIPLTINKEEALQRPVAS
VKLQTVHSIPITINKVEAWQRPVAS

SEQ ID NO: 56848 - protein, 25 aa, synthetic construct
  source 1..25: note = Seed: VKLQTVHSIPLTINKEEALQRPVAS
VKLQTVHSIPITINKVEAYQRPVAS

SEQ ID NO: 56849 - protein, 25 aa, synthetic construct
  source 1..25: note = Seed: VKLQTVHSIPLTINKEEALQRPVAS
VKLQTVHSIPITINKWEAIQRPVAS

SEQ ID NO: 56850 - protein, 25 aa, synthetic construct
  source 1..25: note = Seed: VKLQTVHSIPLTINKEEALQRPVAS
VKLQTVHSIPITINKWEAVQRPVAS

SEQ ID NO: 56851 - protein, 25 aa, synthetic construct
  source 1..25: note = Seed: VKLQTVHSIPLTINKEEALQRPVAS
VKLQTVHSIPITINKYEAFQRPVAS

SEQ ID NO: 56852 - protein, 25 aa, synthetic construct
  source 1..25: note = Seed: VKLQTVHSIPLTINKEEALQRPVAS
VKLQTVHSIPITINKYEAIQRPVAS

SEQ ID NO: 56853 - protein, 25 aa, synthetic construct
  source 1..25: note = Seed: VKLQTVHSIPLTINKEEALQRPVAS
VKLQTVHSIPITINKYEALQRPVAS

SEQ ID NO: 56854 - protein, 25 aa, synthetic construct
  source 1..25: note = Seed: VKLQTVHSIPLTINKEEALQRPVAS
VKLQTVHSIPITINKYEAVQRPVAS

SEQ ID NO: 56855 - protein, 25 aa, synthetic construct
  source 1..25: note = Seed: VKLQTVHSIPLTINKEEALQRPVAS
VKLQTVHSIPITIQKAEAIQRPVAS

SEQ ID NO: 56856 - protein, 25 aa, synthetic construct
  source 1..25: note = Seed: VKLQTVHSIPLTINKEEALQRPVAS
VKLQTVHSIPITIQKAEALQRPVAS

SEQ ID NO: 56857 - protein, 25 aa, synthetic construct
  source 1..25: note = Seed: VKLQTVHSIPLTINKEEALQRPVAS
VKLQTVHSIPITIQKAEAVQRPVAS

SEQ ID NO: 56858 - protein, 25 aa, synthetic construct
  source 1..25: note = Seed: VKLQTVHSIPLTINKEEALQRPVAS
VKLQTVHSIPITIQKFEAAQRPVAS

SEQ ID NO: 56859 - protein, 25 aa, synthetic construct
  source 1..25: note = Seed: VKLQTVHSIPLTINKEEALQRPVAS
VKLQTVHSIPITIQKFEAFQRPVAS

SEQ ID NO: 56860 - protein, 25 aa, synthetic construct
  source 1..25: note = Seed: VKLQTVHSIPLTINKEEALQRPVAS
VKLQTVHSIPITIQKFEAIQRPVAS

SEQ ID NO: 56861 - protein, 25 aa, synthetic construct
  source 1..25: note = Seed: VKLQTVHSIPLTINKEEALQRPVAS
VKLQTVHSIPITIQKFEALQRPVAS

SEQ ID NO: 56862 - protein, 25 aa, synthetic construct
  source 1..25: note = Seed: VKLQTVHSIPLTINKEEALQRPVAS
VKLQTVHSIPITIQKFEAMQRPVAS

SEQ ID NO: 56863 - protein, 25 aa, synthetic construct
  source 1..25: note = Seed: VKLQTVHSIPLTINKEEALQRPVAS
VKLQTVHSIPITIQKFEASQRPVAS

SEQ ID NO: 56864 - protein, 25 aa, synthetic construct
  source 1..25: note = Seed: VKLQTVHSIPLTINKEEALQRPVAS
VKLQTVHSIPITIQKFEATQRPVAS

SEQ ID NO: 56865 - protein, 25 aa, synthetic construct
  source 1..25: note = Seed: VKLQTVHSIPLTINKEEALQRPVAS
VKLQTVHSIPITIQKFEAVQRPVAS

SEQ ID NO: 56866 - protein, 25 aa, synthetic construct
  source 1..25: note = Seed: VKLQTVHSIPLTINKEEALQRPVAS
VKLQTVHSIPITIQKFEAYQRPVAS

SEQ ID NO: 56867 - protein, 25 aa, synthetic construct
  source 1..25: note = Seed: VKLQTVHSIPLTINKEEALQRPVAS
VKLQTVHSIPITIQKHEALQRPVAS

SEQ ID NO: 56868 - protein, 25 aa, synthetic construct
  source 1..25: note = Seed: VKLQTVHSIPLTINKEEALQRPVAS
VKLQTVHSIPITIQKIEAAQRPVAS

SEQ ID NO: 56869 - protein, 25 aa, synthetic construct
  source 1..25: note = Seed: VKLQTVHSIPLTINKEEALQRPVAS
VKLQTVHSIPITIQKIEAIQRPVAS

SEQ ID NO: 56870 - protein, 25 aa, synthetic construct
  source 1..25: note = Seed: VKLQTVHSIPLTINKEEALQRPVAS
VKLQTVHSIPITIQKIEALQRPVAS

SEQ ID NO: 56871 - protein, 25 aa, synthetic construct
  source 1..25: note = Seed: VKLQTVHSIPLTINKEEALQRPVAS
VKLQTVHSIPITIQKIEAMQRPVAS

SEQ ID NO: 56872 - protein, 25 aa, synthetic construct
  source 1..25: note = Seed: VKLQTVHSIPLTINKEEALQRPVAS
VKLQTVHSIPITIQKIEAVQRPVAS

SEQ ID NO: 56873 - protein, 25 aa, synthetic construct
  source 1..25: note = Seed: VKLQTVHSIPLTINKEEALQRPVAS
VKLQTVHSIPITIQKLEALQRPVAS

SEQ ID NO: 56874 - protein, 25 aa, synthetic construct
  source 1..25: note = Seed: VKLQTVHSIPLTINKEEALQRPVAS
VKLQTVHSIPITIQKNEAFQRPVAS

SEQ ID NO: 56875 - protein, 25 aa, synthetic construct
  source 1..25: note = Seed: VKLQTVHSIPLTINKEEALQRPVAS
VKLQTVHSIPITIQKNEAIQRPVAS

SEQ ID NO: 56876 - protein, 25 aa, synthetic construct
  source 1..25: note = Seed: VKLQTVHSIPLTINKEEALQRPVAS
VKLQTVHSIPITIQKNEALQRPVAS

SEQ ID NO: 56877 - protein, 25 aa, synthetic construct
  source 1..25: note = Seed: VKLQTVHSIPLTINKEEALQRPVAS
VKLQTVHSIPITIQKNEAMQRPVAS

SEQ ID NO: 56878 - protein, 25 aa, synthetic construct
  source 1..25: note = Seed: VKLQTVHSIPLTINKEEALQRPVAS
VKLQTVHSIPITIQKNEAVQRPVAS

SEQ ID NO: 56879 - protein, 25 aa, synthetic construct
  source 1..25: note = Seed: VKLQTVHSIPLTINKEEALQRPVAS
VKLQTVHSIPITIQKREAFQRPVAS

SEQ ID NO: 56880 - protein, 25 aa, synthetic construct
  source 1..25: note = Seed: VKLQTVHSIPLTINKEEALQRPVAS
VKLQTVHSIPITIQKREAIQRPVAS

SEQ ID NO: 56881 - protein, 25 aa, synthetic construct
  source 1..25: note = Seed: VKLQTVHSIPLTINKEEALQRPVAS
VKLQTVHSIPITIQKREALQRPVAS

SEQ ID NO: 56882 - protein, 25 aa, synthetic construct
  source 1..25: note = Seed: VKLQTVHSIPLTINKEEALQRPVAS
VKLQTVHSIPITIQKREAVQRPVAS

SEQ ID NO: 56883 - protein, 25 aa, synthetic construct
  source 1..25: note = Seed: VKLQTVHSIPLTINKEEALQRPVAS
VKLQTVHSIPITIQKREAYQRPVAS

SEQ ID NO: 56884 - protein, 25 aa, synthetic construct
  source 1..25: note = Seed: VKLQTVHSIPLTINKEEALQRPVAS
VKLQTVHSIPITIQKSEAIQRPVAS

SEQ ID NO: 56885 - protein, 25 aa, synthetic construct
  source 1..25: note = Seed: VKLQTVHSIPLTINKEEALQRPVAS
VKLQTVHSIPITIQKSEAVQRPVAS

SEQ ID NO: 56886 - protein, 25 aa, synthetic construct
  source 1..25: note = Seed: VKLQTVHSIPLTINKEEALQRPVAS
VKLQTVHSIPITIQKVEAVQRPVAS

SEQ ID NO: 56887 - protein, 25 aa, synthetic construct
  source 1..25: note = Seed: VKLQTVHSIPLTINKEEALQRPVAS
VKLQTVHSIPITIQKYEAFQRPVAS

SEQ ID NO: 56888 - protein, 25 aa, synthetic construct
  source 1..25: note = Seed: VKLQTVHSIPLTINKEEALQRPVAS
VKLQTVHSIPITIQKYEAIQRPVAS

SEQ ID NO: 56889 - protein, 25 aa, synthetic construct
  source 1..25: note = Seed: VKLQTVHSIPLTINKEEALQRPVAS
VKLQTVHSIPITIQKYEALQRPVAS

SEQ ID NO: 56890 - protein, 25 aa, synthetic construct
  source 1..25: note = Seed: VKLQTVHSIPLTINKEEALQRPVAS
VKLQTVHSIPITIRKAEAFQRPVAS

SEQ ID NO: 56891 - protein, 25 aa, synthetic construct
  source 1..25: note = Seed: VKLQTVHSIPLTINKEEALQRPVAS
VKLQTVHSIPITIRKAEAIQRPVAS

SEQ ID NO: 56892 - protein, 25 aa, synthetic construct
  source 1..25: note = Seed: VKLQTVHSIPLTINKEEALQRPVAS
VKLQTVHSIPITIRKAEALQRPVAS

SEQ ID NO: 56893 - protein, 25 aa, synthetic construct
  source 1..25: note = Seed: VKLQTVHSIPLTINKEEALQRPVAS
VKLQTVHSIPITIRKAEAMQRPVAS

SEQ ID NO: 56894 - protein, 25 aa, synthetic construct
  source 1..25: note = Seed: VKLQTVHSIPLTINKEEALQRPVAS
VKLQTVHSIPITIRKFEAFQRPVAS

SEQ ID NO: 56895 - protein, 25 aa, synthetic construct
  source 1..25: note = Seed: VKLQTVHSIPLTINKEEALQRPVAS
VKLQTVHSIPITIRKFEAIQRPVAS

SEQ ID NO: 56896 - protein, 25 aa, synthetic construct
  source 1..25: note = Seed: VKLQTVHSIPLTINKEEALQRPVAS
VKLQTVHSIPITIRKFEALQRPVAS

SEQ ID NO: 56897 - protein, 25 aa, synthetic construct
  source 1..25: note = Seed: VKLQTVHSIPLTINKEEALQRPVAS
VKLQTVHSIPITIRKFEAVQRPVAS

SEQ ID NO: 56898 - protein, 25 aa, synthetic construct
  source 1..25: note = Seed: VKLQTVHSIPLTINKEEALQRPVAS
VKLQTVHSIPITIRKHEAFQRPVAS

SEQ ID NO: 56899 - protein, 25 aa, synthetic construct
  source 1..25: note = Seed: VKLQTVHSIPLTINKEEALQRPVAS
VKLQTVHSIPITIRKHEAIQRPVAS

SEQ ID NO: 56900 - protein, 25 aa, synthetic construct
  source 1..25: note = Seed: VKLQTVHSIPLTINKEEALQRPVAS
VKLQTVHSIPITIRKHEAMQRPVAS

SEQ ID NO: 56901 - protein, 25 aa, synthetic construct
  source 1..25: note = Seed: VKLQTVHSIPLTINKEEALQRPVAS
VKLQTVHSIPITIRKHEAVQRPVAS

SEQ ID NO: 56902 - protein, 25 aa, synthetic construct
  source 1..25: note = Seed: VKLQTVHSIPLTINKEEALQRPVAS
VKLQTVHSIPITIRKHEAYQRPVAS

SEQ ID NO: 56903 - protein, 25 aa, synthetic construct
  source 1..25: note = Seed: VKLQTVHSIPLTINKEEALQRPVAS
VKLQTVHSIPITIRKIEARQRPVAS

SEQ ID NO: 56904 - protein, 25 aa, synthetic construct
  source 1..25: note = Seed: VKLQTVHSIPLTINKEEALQRPVAS
VKLQTVHSIPITIRKKEAFQRPVAS

SEQ ID NO: 56905 - protein, 25 aa, synthetic construct
  source 1..25: note = Seed: VKLQTVHSIPLTINKEEALQRPVAS
VKLQTVHSIPITIRKKEAIQRPVAS

SEQ ID NO: 56906 - protein, 25 aa, synthetic construct
  source 1..25: note = Seed: VKLQTVHSIPLTINKEEALQRPVAS
VKLQTVHSIPITIRKKEALQRPVAS

SEQ ID NO: 56907 - protein, 25 aa, synthetic construct
  source 1..25: note = Seed: VKLQTVHSIPLTINKEEALQRPVAS
VKLQTVHSIPITIRKLEARQRPVAS

SEQ ID NO: 56908 - protein, 25 aa, synthetic construct
  source 1..25: note = Seed: VKLQTVHSIPLTINKEEALQRPVAS
VKLQTVHSIPITIRKLEAYQRPVAS

SEQ ID NO: 56909 - protein, 25 aa, synthetic construct
  source 1..25: note = Seed: VKLQTVHSIPLTINKEEALQRPVAS
VKLQTVHSIPITIRKQEALQRPVAS

SEQ ID NO: 56910 - protein, 25 aa, synthetic construct
  source 1..25: note = Seed: VKLQTVHSIPLTINKEEALQRPVAS
VKLQTVHSIPITIRKREAFQRPVAS

SEQ ID NO: 56911 - protein, 25 aa, synthetic construct
  source 1..25: note = Seed: VKLQTVHSIPLTINKEEALQRPVAS
VKLQTVHSIPITIRKREAIQRPVAS

SEQ ID NO: 56912 - protein, 25 aa, synthetic construct
  source 1..25: note = Seed: VKLQTVHSIPLTINKEEALQRPVAS
VKLQTVHSIPITIRKREALQRPVAS

SEQ ID NO: 56913 - protein, 25 aa, synthetic construct
  source 1..25: note = Seed: VKLQTVHSIPLTINKEEALQRPVAS
VKLQTVHSIPITIRKREAMQRPVAS

SEQ ID NO: 56914 - protein, 25 aa, synthetic construct
  source 1..25: note = Seed: VKLQTVHSIPLTINKEEALQRPVAS
VKLQTVHSIPITIRKREAVQRPVAS

SEQ ID NO: 56915 - protein, 25 aa, synthetic construct
  source 1..25: note = Seed: VKLQTVHSIPLTINKEEALQRPVAS
VKLQTVHSIPITIRKREAWQRPVAS

SEQ ID NO: 56916 - protein, 25 aa, synthetic construct
  source 1..25: note = Seed: VKLQTVHSIPLTINKEEALQRPVAS
VKLQTVHSIPITIRKREAYQRPVAS

SEQ ID NO: 56917 - protein, 25 aa, synthetic construct
  source 1..25: note = Seed: VKLQTVHSIPLTINKEEALQRPVAS
VKLQTVHSIPITIRKSEAFQRPVAS

SEQ ID NO: 56918 - protein, 25 aa, synthetic construct
  source 1..25: note = Seed: VKLQTVHSIPLTINKEEALQRPVAS
VKLQTVHSIPITIRKSEAIQRPVAS

SEQ ID NO: 56919 - protein, 25 aa, synthetic construct
  source 1..25: note = Seed: VKLQTVHSIPLTINKEEALQRPVAS
VKLQTVHSIPITIRKSEALQRPVAS

SEQ ID NO: 56920 - protein, 25 aa, synthetic construct
  source 1..25: note = Seed: VKLQTVHSIPLTINKEEALQRPVAS
VKLQTVHSIPITIRKTEAFQRPVAS

SEQ ID NO: 56921 - protein, 25 aa, synthetic construct
  source 1..25: note = Seed: VKLQTVHSIPLTINKEEALQRPVAS
VKLQTVHSIPITIRKVEAFQRPVAS

SEQ ID NO: 56922 - protein, 25 aa, synthetic construct
  source 1..25: note = Seed: VKLQTVHSIPLTINKEEALQRPVAS
VKLQTVHSIPITIRKVEAMQRPVAS

SEQ ID NO: 56923 - protein, 25 aa, synthetic construct
  source 1..25: note = Seed: VKLQTVHSIPLTINKEEALQRPVAS
VKLQTVHSIPITIRKVEARQRPVAS

SEQ ID NO: 56924 - protein, 25 aa, synthetic construct
  source 1..25: note = Seed: VKLQTVHSIPLTINKEEALQRPVAS
VKLQTVHSIPITIRKVEAVQRPVAS

SEQ ID NO: 56925 - protein, 25 aa, synthetic construct
  source 1..25: note = Seed: VKLQTVHSIPLTINKEEALQRPVAS
VKLQTVHSIPITIRKVEAYQRPVAS

SEQ ID NO: 56926 - protein, 25 aa, synthetic construct
  source 1..25: note = Seed: VKLQTVHSIPLTINKEEALQRPVAS
VKLQTVHSIPITISKAEAAQRPVAS

SEQ ID NO: 56927 - protein, 25 aa, synthetic construct
  source 1..25: note = Seed: VKLQTVHSIPLTINKEEALQRPVAS
VKLQTVHSIPITISKAEAFQRPVAS

SEQ ID NO: 56928 - protein, 25 aa, synthetic construct
  source 1..25: note = Seed: VKLQTVHSIPLTINKEEALQRPVAS
VKLQTVHSIPITISKAEAIQRPVAS

SEQ ID NO: 56929 - protein, 25 aa, synthetic construct
  source 1..25: note = Seed: VKLQTVHSIPLTINKEEALQRPVAS
VKLQTVHSIPITISKAEALQRPVAS

SEQ ID NO: 56930 - protein, 25 aa, synthetic construct
  source 1..25: note = Seed: VKLQTVHSIPLTINKEEALQRPVAS
VKLQTVHSIPITISKAEAMQRPVAS

SEQ ID NO: 56931 - protein, 25 aa, synthetic construct
  source 1..25: note = Seed: VKLQTVHSIPLTINKEEALQRPVAS
VKLQTVHSIPITISKAEAVQRPVAS

SEQ ID NO: 56932 - protein, 25 aa, synthetic construct
  source 1..25: note = Seed: VKLQTVHSIPLTINKEEALQRPVAS
VKLQTVHSIPITISKAEAYQRPVAS

SEQ ID NO: 56933 - protein, 25 aa, synthetic construct
  source 1..25: note = Seed: VKLQTVHSIPLTINKEEALQRPVAS
VKLQTVHSIPITISKFEAAQRPVAS

SEQ ID NO: 56934 - protein, 25 aa, synthetic construct
  source 1..25: note = Seed: VKLQTVHSIPLTINKEEALQRPVAS
VKLQTVHSIPITISKFEAEQRPVAS

SEQ ID NO: 56935 - protein, 25 aa, synthetic construct
  source 1..25: note = Seed: VKLQTVHSIPLTINKEEALQRPVAS
VKLQTVHSIPITISKFEAFQRPVAS

SEQ ID NO: 56936 - protein, 25 aa, synthetic construct
  source 1..25: note = Seed: VKLQTVHSIPLTINKEEALQRPVAS
VKLQTVHSIPITISKFEAIQRPVAS

SEQ ID NO: 56937 - protein, 25 aa, synthetic construct
  source 1..25: note = Seed: VKLQTVHSIPLTINKEEALQRPVAS
VKLQTVHSIPITISKFEALQRPVAS

SEQ ID NO: 56938 - protein, 25 aa, synthetic construct
  source 1..25: note = Seed: VKLQTVHSIPLTINKEEALQRPVAS
VKLQTVHSIPITISKFEAMQRPVAS

SEQ ID NO: 56939 - protein, 25 aa, synthetic construct
  source 1..25: note = Seed: VKLQTVHSIPLTINKEEALQRPVAS
VKLQTVHSIPITISKFEANQRPVAS

SEQ ID NO: 56940 - protein, 25 aa, synthetic construct
  source 1..25: note = Seed: VKLQTVHSIPLTINKEEALQRPVAS
VKLQTVHSIPITISKFEASQRPVAS

SEQ ID NO: 56941 - protein, 25 aa, synthetic construct
  source 1..25: note = Seed: VKLQTVHSIPLTINKEEALQRPVAS
VKLQTVHSIPITISKFEATQRPVAS

SEQ ID NO: 56942 - protein, 25 aa, synthetic construct
  source 1..25: note = Seed: VKLQTVHSIPLTINKEEALQRPVAS
VKLQTVHSIPITISKFEAVQRPVAS

SEQ ID NO: 56943 - protein, 25 aa, synthetic construct
  source 1..25: note = Seed: VKLQTVHSIPLTINKEEALQRPVAS
VKLQTVHSIPITISKFEAYQRPVAS

SEQ ID NO: 56944 - protein, 25 aa, synthetic construct
  source 1..25: note = Seed: VKLQTVHSIPLTINKEEALQRPVAS
VKLQTVHSIPITISKGEAIQRPVAS

SEQ ID NO: 56945 - protein, 25 aa, synthetic construct
  source 1..25: note = Seed: VKLQTVHSIPLTINKEEALQRPVAS
VKLQTVHSIPITISKGEALQRPVAS

SEQ ID NO: 56946 - protein, 25 aa, synthetic construct
  source 1..25: note = Seed: VKLQTVHSIPLTINKEEALQRPVAS
VKLQTVHSIPITISKGEAVQRPVAS

SEQ ID NO: 56947 - protein, 25 aa, synthetic construct
  source 1..25: note = Seed: VKLQTVHSIPLTINKEEALQRPVAS
VKLQTVHSIPITISKIEAAQRPVAS

SEQ ID NO: 56948 - protein, 25 aa, synthetic construct
  source 1..25: note = Seed: VKLQTVHSIPLTINKEEALQRPVAS
VKLQTVHSIPITISKIEAFQRPVAS

SEQ ID NO: 56949 - protein, 25 aa, synthetic construct
  source 1..25: note = Seed: VKLQTVHSIPLTINKEEALQRPVAS
VKLQTVHSIPITISKIEAIQRPVAS

SEQ ID NO: 56950 - protein, 25 aa, synthetic construct
  source 1..25: note = Seed: VKLQTVHSIPLTINKEEALQRPVAS
VKLQTVHSIPITISKIEALQRPVAS

SEQ ID NO: 56951 - protein, 25 aa, synthetic construct
  source 1..25: note = Seed: VKLQTVHSIPLTINKEEALQRPVAS
VKLQTVHSIPITISKIEAMQRPVAS

SEQ ID NO: 56952 - protein, 25 aa, synthetic construct
  source 1..25: note = Seed: VKLQTVHSIPLTINKEEALQRPVAS
VKLQTVHSIPITISKIEASQRPVAS

SEQ ID NO: 56953 - protein, 25 aa, synthetic construct
  source 1..25: note = Seed: VKLQTVHSIPLTINKEEALQRPVAS
VKLQTVHSIPITISKIEAVQRPVAS

SEQ ID NO: 56954 - protein, 25 aa, synthetic construct
  source 1..25: note = Seed: VKLQTVHSIPLTINKEEALQRPVAS
VKLQTVHSIPITISKIEAYQRPVAS

SEQ ID NO: 56955 - protein, 25 aa, synthetic construct
  source 1..25: note = Seed: VKLQTVHSIPLTINKEEALQRPVAS
VKLQTVHSIPITISKLEAAQRPVAS

SEQ ID NO: 56956 - protein, 25 aa, synthetic construct
  source 1..25: note = Seed: VKLQTVHSIPLTINKEEALQRPVAS
VKLQTVHSIPITISKLEAFQRPVAS

SEQ ID NO: 56957 - protein, 25 aa, synthetic construct
  source 1..25: note = Seed: VKLQTVHSIPLTINKEEALQRPVAS
VKLQTVHSIPITISKLEAIQRPVAS

SEQ ID NO: 56958 - protein, 25 aa, synthetic construct
  source 1..25: note = Seed: VKLQTVHSIPLTINKEEALQRPVAS
VKLQTVHSIPITISKLEALQRPVAS

SEQ ID NO: 56959 - protein, 25 aa, synthetic construct
  source 1..25: note = Seed: VKLQTVHSIPLTINKEEALQRPVAS
VKLQTVHSIPITISKLEAMQRPVAS

SEQ ID NO: 56960 - protein, 25 aa, synthetic construct
  source 1..25: note = Seed: VKLQTVHSIPLTINKEEALQRPVAS
VKLQTVHSIPITISKLEAVQRPVAS

SEQ ID NO: 56961 - protein, 25 aa, synthetic construct
  source 1..25: note = Seed: VKLQTVHSIPLTINKEEALQRPVAS
VKLQTVHSIPITISKLEAYQRPVAS

SEQ ID NO: 56962 - protein, 25 aa, synthetic construct
  source 1..25: note = Seed: VKLQTVHSIPLTINKEEALQRPVAS
VKLQTVHSIPITISKMEAAQRPVAS

SEQ ID NO: 56963 - protein, 25 aa, synthetic construct
  source 1..25: note = Seed: VKLQTVHSIPLTINKEEALQRPVAS
VKLQTVHSIPITISKMEAFQRPVAS

SEQ ID NO: 56964 - protein, 25 aa, synthetic construct
  source 1..25: note = Seed: VKLQTVHSIPLTINKEEALQRPVAS
VKLQTVHSIPITISKMEAIQRPVAS

SEQ ID NO: 56965 - protein, 25 aa, synthetic construct
  source 1..25: note = Seed: VKLQTVHSIPLTINKEEALQRPVAS
VKLQTVHSIPITISKMEALQRPVAS

SEQ ID NO: 56966 - protein, 25 aa, synthetic construct
  source 1..25: note = Seed: VKLQTVHSIPLTINKEEALQRPVAS
VKLQTVHSIPITISKMEAMQRPVAS

SEQ ID NO: 56967 - protein, 25 aa, synthetic construct
  source 1..25: note = Seed: VKLQTVHSIPLTINKEEALQRPVAS
VKLQTVHSIPITISKMEAVQRPVAS

SEQ ID NO: 56968 - protein, 25 aa, synthetic construct
  source 1..25: note = Seed: VKLQTVHSIPLTINKEEALQRPVAS
VKLQTVHSIPITISKNEAAQRPVAS

SEQ ID NO: 56969 - protein, 25 aa, synthetic construct
  source 1..25: note = Seed: VKLQTVHSIPLTINKEEALQRPVAS
VKLQTVHSIPITISKNEAFQRPVAS

SEQ ID NO: 56970 - protein, 25 aa, synthetic construct
  source 1..25: note = Seed: VKLQTVHSIPLTINKEEALQRPVAS
VKLQTVHSIPITISKNEAIQRPVAS

SEQ ID NO: 56971 - protein, 25 aa, synthetic construct
  source 1..25: note = Seed: VKLQTVHSIPLTINKEEALQRPVAS
VKLQTVHSIPITISKNEALQRPVAS

SEQ ID NO: 56972 - protein, 25 aa, synthetic construct
  source 1..25: note = Seed: VKLQTVHSIPLTINKEEALQRPVAS
VKLQTVHSIPITISKNEAMQRPVAS

SEQ ID NO: 56973 - protein, 25 aa, synthetic construct
  source 1..25: note = Seed: VKLQTVHSIPLTINKEEALQRPVAS
VKLQTVHSIPITISKNEAVQRPVAS

SEQ ID NO: 56974 - protein, 25 aa, synthetic construct
  source 1..25: note = Seed: VKLQTVHSIPLTINKEEALQRPVAS
VKLQTVHSIPITISKNEAYQRPVAS

SEQ ID NO: 56975 - protein, 25 aa, synthetic construct
  source 1..25: note = Seed: VKLQTVHSIPLTINKEEALQRPVAS
VKLQTVHSIPITISKPEAIQRPVAS

SEQ ID NO: 56976 - protein, 25 aa, synthetic construct
  source 1..25: note = Seed: VKLQTVHSIPLTINKEEALQRPVAS
VKLQTVHSIPITISKPEAVQRPVAS

SEQ ID NO: 56977 - protein, 25 aa, synthetic construct
  source 1..25: note = Seed: VKLQTVHSIPLTINKEEALQRPVAS
VKLQTVHSIPITISKREAFQRPVAS

SEQ ID NO: 56978 - protein, 25 aa, synthetic construct
  source 1..25: note = Seed: VKLQTVHSIPLTINKEEALQRPVAS
VKLQTVHSIPITISKREALQRPVAS

SEQ ID NO: 56979 - protein, 25 aa, synthetic construct
  source 1..25: note = Seed: VKLQTVHSIPLTINKEEALQRPVAS
VKLQTVHSIPITISKREAYQRPVAS

SEQ ID NO: 56980 - protein, 25 aa, synthetic construct
  source 1..25: note = Seed: VKLQTVHSIPLTINKEEALQRPVAS
VKLQTVHSIPITISKSEAFQRPVAS

SEQ ID NO: 56981 - protein, 25 aa, synthetic construct
  source 1..25: note = Seed: VKLQTVHSIPLTINKEEALQRPVAS
VKLQTVHSIPITISKSEAIQRPVAS

SEQ ID NO: 56982 - protein, 25 aa, synthetic construct
  source 1..25: note = Seed: VKLQTVHSIPLTINKEEALQRPVAS
VKLQTVHSIPITISKSEALQRPVAS

SEQ ID NO: 56983 - protein, 25 aa, synthetic construct
  source 1..25: note = Seed: VKLQTVHSIPLTINKEEALQRPVAS
VKLQTVHSIPITISKSEAMQRPVAS

SEQ ID NO: 56984 - protein, 25 aa, synthetic construct
  source 1..25: note = Seed: VKLQTVHSIPLTINKEEALQRPVAS
VKLQTVHSIPITISKSEAVQRPVAS

SEQ ID NO: 56985 - protein, 25 aa, synthetic construct
  source 1..25: note = Seed: VKLQTVHSIPLTINKEEALQRPVAS
VKLQTVHSIPITISKSEAYQRPVAS

SEQ ID NO: 56986 - protein, 25 aa, synthetic construct
  source 1..25: note = Seed: VKLQTVHSIPLTINKEEALQRPVAS
VKLQTVHSIPITISKTEAIQRPVAS

SEQ ID NO: 56987 - protein, 25 aa, synthetic construct
  source 1..25: note = Seed: VKLQTVHSIPLTINKEEALQRPVAS
VKLQTVHSIPITISKTEALQRPVAS

SEQ ID NO: 56988 - protein, 25 aa, synthetic construct
  source 1..25: note = Seed: VKLQTVHSIPLTINKEEALQRPVAS
VKLQTVHSIPITISKTEAVQRPVAS

SEQ ID NO: 56989 - protein, 25 aa, synthetic construct
  source 1..25: note = Seed: VKLQTVHSIPLTINKEEALQRPVAS
VKLQTVHSIPITISKVEAAQRPVAS

SEQ ID NO: 56990 - protein, 25 aa, synthetic construct
  source 1..25: note = Seed: VKLQTVHSIPLTINKEEALQRPVAS
VKLQTVHSIPITISKVEAFQRPVAS

SEQ ID NO: 56991 - protein, 25 aa, synthetic construct
  source 1..25: note = Seed: VKLQTVHSIPLTINKEEALQRPVAS
VKLQTVHSIPITISKVEAIQRPVAS

SEQ ID NO: 56992 - protein, 25 aa, synthetic construct
  source 1..25: note = Seed: VKLQTVHSIPLTINKEEALQRPVAS
VKLQTVHSIPITISKVEALQRPVAS

SEQ ID NO: 56993 - protein, 25 aa, synthetic construct
  source 1..25: note = Seed: VKLQTVHSIPLTINKEEALQRPVAS
VKLQTVHSIPITISKVEAMQRPVAS

SEQ ID NO: 56994 - protein, 25 aa, synthetic construct
  source 1..25: note = Seed: VKLQTVHSIPLTINKEEALQRPVAS
VKLQTVHSIPITISKVEAVQRPVAS

SEQ ID NO: 56995 - protein, 25 aa, synthetic construct
  source 1..25: note = Seed: VKLQTVHSIPLTINKEEALQRPVAS
VKLQTVHSIPITISKVEAYQRPVAS

SEQ ID NO: 56996 - protein, 25 aa, synthetic construct
  source 1..25: note = Seed: VKLQTVHSIPLTINKEEALQRPVAS
VKLQTVHSIPITISKWEAFQRPVAS

SEQ ID NO: 56997 - protein, 25 aa, synthetic construct
  source 1..25: note = Seed: VKLQTVHSIPLTINKEEALQRPVAS
VKLQTVHSIPITISKWEAIQRPVAS

SEQ ID NO: 56998 - protein, 25 aa, synthetic construct
  source 1..25: note = Seed: VKLQTVHSIPLTINKEEALQRPVAS
VKLQTVHSIPITISKWEALQRPVAS

SEQ ID NO: 56999 - protein, 25 aa, synthetic construct
  source 1..25: note = Seed: VKLQTVHSIPLTINKEEALQRPVAS
VKLQTVHSIPITISKWEAVQRPVAS

SEQ ID NO: 57000 - protein, 25 aa, synthetic construct
  source 1..25: note = Seed: VKLQTVHSIPLTINKEEALQRPVAS
VKLQTVHSIPITISKYEAFQRPVAS

SEQ ID NO: 57001 - protein, 25 aa, synthetic construct
  source 1..25: note = Seed: VKLQTVHSIPLTINKEEALQRPVAS
VKLQTVHSIPITISKYEAIQRPVAS

SEQ ID NO: 57002 - protein, 25 aa, synthetic construct
  source 1..25: note = Seed: VKLQTVHSIPLTINKEEALQRPVAS
VKLQTVHSIPITISKYEALQRPVAS

SEQ ID NO: 57003 - protein, 25 aa, synthetic construct
  source 1..25: note = Seed: VKLQTVHSIPLTINKEEALQRPVAS
VKLQTVHSIPITISKYEAVQRPVAS

SEQ ID NO: 57004 - protein, 25 aa, synthetic construct
  source 1..25: note = Seed: VKLQTVHSIPLTINKEEALQRPVAS
VKLQTVHSIPITITKAEAIQRPVAS

SEQ ID NO: 57005 - protein, 25 aa, synthetic construct
  source 1..25: note = Seed: VKLQTVHSIPLTINKEEALQRPVAS
VKLQTVHSIPITITKAEAVQRPVAS

SEQ ID NO: 57006 - protein, 25 aa, synthetic construct
  source 1..25: note = Seed: VKLQTVHSIPLTINKEEALQRPVAS
VKLQTVHSIPITITKFEAAQRPVAS

SEQ ID NO: 57007 - protein, 25 aa, synthetic construct
  source 1..25: note = Seed: VKLQTVHSIPLTINKEEALQRPVAS
VKLQTVHSIPITITKFEAEQRPVAS

SEQ ID NO: 57008 - protein, 25 aa, synthetic construct
  source 1..25: note = Seed: VKLQTVHSIPLTINKEEALQRPVAS
VKLQTVHSIPITITKFEAFQRPVAS

SEQ ID NO: 57009 - protein, 25 aa, synthetic construct
  source 1..25: note = Seed: VKLQTVHSIPLTINKEEALQRPVAS
VKLQTVHSIPITITKFEAIQRPVAS

SEQ ID NO: 57010 - protein, 25 aa, synthetic construct
  source 1..25: note = Seed: VKLQTVHSIPLTINKEEALQRPVAS
VKLQTVHSIPITITKFEALQRPVAS

SEQ ID NO: 57011 - protein, 25 aa, synthetic construct
  source 1..25: note = Seed: VKLQTVHSIPLTINKEEALQRPVAS
VKLQTVHSIPITITKFEAMQRPVAS

SEQ ID NO: 57012 - protein, 25 aa, synthetic construct
  source 1..25: note = Seed: VKLQTVHSIPLTINKEEALQRPVAS
VKLQTVHSIPITITKFEANQRPVAS

SEQ ID NO: 57013 - protein, 25 aa, synthetic construct
  source 1..25: note = Seed: VKLQTVHSIPLTINKEEALQRPVAS
VKLQTVHSIPITITKFEASQRPVAS

SEQ ID NO: 57014 - protein, 25 aa, synthetic construct
  source 1..25: note = Seed: VKLQTVHSIPLTINKEEALQRPVAS
VKLQTVHSIPITITKFEATQRPVAS

SEQ ID NO: 57015 - protein, 25 aa, synthetic construct
  source 1..25: note = Seed: VKLQTVHSIPLTINKEEALQRPVAS
VKLQTVHSIPITITKFEAVQRPVAS

SEQ ID NO: 57016 - protein, 25 aa, synthetic construct
  source 1..25: note = Seed: VKLQTVHSIPLTINKEEALQRPVAS
VKLQTVHSIPITITKFEAYQRPVAS

SEQ ID NO: 57017 - protein, 25 aa, synthetic construct
  source 1..25: note = Seed: VKLQTVHSIPLTINKEEALQRPVAS
VKLQTVHSIPITITKIEAAQRPVAS

SEQ ID NO: 57018 - protein, 25 aa, synthetic construct
  source 1..25: note = Seed: VKLQTVHSIPLTINKEEALQRPVAS
VKLQTVHSIPITITKIEAIQRPVAS

SEQ ID NO: 57019 - protein, 25 aa, synthetic construct
  source 1..25: note = Seed: VKLQTVHSIPLTINKEEALQRPVAS
VKLQTVHSIPITITKIEALQRPVAS

SEQ ID NO: 57020 - protein, 25 aa, synthetic construct
  source 1..25: note = Seed: VKLQTVHSIPLTINKEEALQRPVAS
VKLQTVHSIPITITKIEAMQRPVAS

SEQ ID NO: 57021 - protein, 25 aa, synthetic construct
  source 1..25: note = Seed: VKLQTVHSIPLTINKEEALQRPVAS
VKLQTVHSIPITITKIEAVQRPVAS

SEQ ID NO: 57022 - protein, 25 aa, synthetic construct
  source 1..25: note = Seed: VKLQTVHSIPLTINKEEALQRPVAS
VKLQTVHSIPITITKLEAFQRPVAS

SEQ ID NO: 57023 - protein, 25 aa, synthetic construct
  source 1..25: note = Seed: VKLQTVHSIPLTINKEEALQRPVAS
VKLQTVHSIPITITKLEAIQRPVAS

SEQ ID NO: 57024 - protein, 25 aa, synthetic construct
  source 1..25: note = Seed: VKLQTVHSIPLTINKEEALQRPVAS
VKLQTVHSIPITITKLEALQRPVAS

SEQ ID NO: 57025 - protein, 25 aa, synthetic construct
  source 1..25: note = Seed: VKLQTVHSIPLTINKEEALQRPVAS
VKLQTVHSIPITITKLEAVQRPVAS

SEQ ID NO: 57026 - protein, 25 aa, synthetic construct
  source 1..25: note = Seed: VKLQTVHSIPLTINKEEALQRPVAS
VKLQTVHSIPITITKNEAFQRPVAS

SEQ ID NO: 57027 - protein, 25 aa, synthetic construct
  source 1..25: note = Seed: VKLQTVHSIPLTINKEEALQRPVAS
VKLQTVHSIPITITKNEAIQRPVAS

SEQ ID NO: 57028 - protein, 25 aa, synthetic construct
  source 1..25: note = Seed: VKLQTVHSIPLTINKEEALQRPVAS
VKLQTVHSIPITITKNEALQRPVAS

SEQ ID NO: 57029 - protein, 25 aa, synthetic construct
  source 1..25: note = Seed: VKLQTVHSIPLTINKEEALQRPVAS
VKLQTVHSIPITITKNEAVQRPVAS

SEQ ID NO: 57030 - protein, 25 aa, synthetic construct
  source 1..25: note = Seed: VKLQTVHSIPLTINKEEALQRPVAS
VKLQTVHSIPITITKSEAIQRPVAS

SEQ ID NO: 57031 - protein, 25 aa, synthetic construct
  source 1..25: note = Seed: VKLQTVHSIPLTINKEEALQRPVAS
VKLQTVHSIPITITKSEAVQRPVAS

SEQ ID NO: 57032 - protein, 25 aa, synthetic construct
  source 1..25: note = Seed: VKLQTVHSIPLTINKEEALQRPVAS
VKLQTVHSIPITITKWEAFQRPVAS

SEQ ID NO: 57033 - protein, 25 aa, synthetic construct
  source 1..25: note = Seed: VKLQTVHSIPLTINKEEALQRPVAS
VKLQTVHSIPITITKWEAIQRPVAS

SEQ ID NO: 57034 - protein, 25 aa, synthetic construct
  source 1..25: note = Seed: VKLQTVHSIPLTINKEEALQRPVAS
VKLQTVHSIPITITKWEALQRPVAS

SEQ ID NO: 57035 - protein, 25 aa, synthetic construct
  source 1..25: note = Seed: VKLQTVHSIPLTINKEEALQRPVAS
VKLQTVHSIPITITKWEAVQRPVAS

SEQ ID NO: 57036 - protein, 25 aa, synthetic construct
  source 1..25: note = Seed: VKLQTVHSIPLTINKEEALQRPVAS
VKLQTVHSIPITITKYEAFQRPVAS

SEQ ID NO: 57037 - protein, 25 aa, synthetic construct
  source 1..25: note = Seed: VKLQTVHSIPLTINKEEALQRPVAS
VKLQTVHSIPITITKYEAIQRPVAS

SEQ ID NO: 57038 - protein, 25 aa, synthetic construct
  source 1..25: note = Seed: VKLQTVHSIPLTINKEEALQRPVAS
VKLQTVHSIPITITKYEALQRPVAS

SEQ ID NO: 57039 - protein, 25 aa, synthetic construct
  source 1..25: note = Seed: VKLQTVHSIPLTINKEEALQRPVAS
VKLQTVHSIPITITKYEAVQRPVAS

SEQ ID NO: 57040 - protein, 25 aa, synthetic construct
  source 1..25: note = Seed: VKLQTVHSIPLTINKEEALQRPVAS
VKLQTVHSIPITIVKAEAAQRPVAS

SEQ ID NO: 57041 - protein, 25 aa, synthetic construct
  source 1..25: note = Seed: VKLQTVHSIPLTINKEEALQRPVAS
VKLQTVHSIPITIVKAEAFQRPVAS

SEQ ID NO: 57042 - protein, 25 aa, synthetic construct
  source 1..25: note = Seed: VKLQTVHSIPLTINKEEALQRPVAS
VKLQTVHSIPITIVKAEAIQRPVAS

SEQ ID NO: 57043 - protein, 25 aa, synthetic construct
  source 1..25: note = Seed: VKLQTVHSIPLTINKEEALQRPVAS
VKLQTVHSIPITIVKAEALQRPVAS

SEQ ID NO: 57044 - protein, 25 aa, synthetic construct
  source 1..25: note = Seed: VKLQTVHSIPLTINKEEALQRPVAS
VKLQTVHSIPITIVKAEAMQRPVAS

SEQ ID NO: 57045 - protein, 25 aa, synthetic construct
  source 1..25: note = Seed: VKLQTVHSIPLTINKEEALQRPVAS
VKLQTVHSIPITIVKAEASQRPVAS

SEQ ID NO: 57046 - protein, 25 aa, synthetic construct
  source 1..25: note = Seed: VKLQTVHSIPLTINKEEALQRPVAS
VKLQTVHSIPITIVKAEATQRPVAS

SEQ ID NO: 57047 - protein, 25 aa, synthetic construct
  source 1..25: note = Seed: VKLQTVHSIPLTINKEEALQRPVAS
VKLQTVHSIPITIVKAEAVQRPVAS

SEQ ID NO: 57048 - protein, 25 aa, synthetic construct
  source 1..25: note = Seed: VKLQTVHSIPLTINKEEALQRPVAS
VKLQTVHSIPITIVKAEAYQRPVAS

SEQ ID NO: 57049 - protein, 25 aa, synthetic construct
  source 1..25: note = Seed: VKLQTVHSIPLTINKEEALQRPVAS
VKLQTVHSIPITIVKDEAAQRPVAS

SEQ ID NO: 57050 - protein, 25 aa, synthetic construct
  source 1..25: note = Seed: VKLQTVHSIPLTINKEEALQRPVAS
VKLQTVHSIPITIVKDEAFQRPVAS

SEQ ID NO: 57051 - protein, 25 aa, synthetic construct
  source 1..25: note = Seed: VKLQTVHSIPLTINKEEALQRPVAS
VKLQTVHSIPITIVKDEAIQRPVAS

SEQ ID NO: 57052 - protein, 25 aa, synthetic construct
  source 1..25: note = Seed: VKLQTVHSIPLTINKEEALQRPVAS
VKLQTVHSIPITIVKDEALQRPVAS

SEQ ID NO: 57053 - protein, 25 aa, synthetic construct
  source 1..25: note = Seed: VKLQTVHSIPLTINKEEALQRPVAS
VKLQTVHSIPITIVKDEAMQRPVAS

SEQ ID NO: 57054 - protein, 25 aa, synthetic construct
  source 1..25: note = Seed: VKLQTVHSIPLTINKEEALQRPVAS
VKLQTVHSIPITIVKDEASQRPVAS

SEQ ID NO: 57055 - protein, 25 aa, synthetic construct
  source 1..25: note = Seed: VKLQTVHSIPLTINKEEALQRPVAS
VKLQTVHSIPITIVKDEAVQRPVAS

SEQ ID NO: 57056 - protein, 25 aa, synthetic construct
  source 1..25: note = Seed: VKLQTVHSIPLTINKEEALQRPVAS
VKLQTVHSIPITIVKDEAYQRPVAS

SEQ ID NO: 57057 - protein, 25 aa, synthetic construct
  source 1..25: note = Seed: VKLQTVHSIPLTINKEEALQRPVAS
VKLQTVHSIPITIVKFEAAQRPVAS

SEQ ID NO: 57058 - protein, 25 aa, synthetic construct
  source 1..25: note = Seed: VKLQTVHSIPLTINKEEALQRPVAS
VKLQTVHSIPITIVKFEADQRPVAS

SEQ ID NO: 57059 - protein, 25 aa, synthetic construct
  source 1..25: note = Seed: VKLQTVHSIPLTINKEEALQRPVAS
VKLQTVHSIPITIVKFEAEQRPVAS

SEQ ID NO: 57060 - protein, 25 aa, synthetic construct
  source 1..25: note = Seed: VKLQTVHSIPLTINKEEALQRPVAS
VKLQTVHSIPITIVKFEAFQRPVAS

SEQ ID NO: 57061 - protein, 25 aa, synthetic construct
  source 1..25: note = Seed: VKLQTVHSIPLTINKEEALQRPVAS
VKLQTVHSIPITIVKFEAHQRPVAS

SEQ ID NO: 57062 - protein, 25 aa, synthetic construct
  source 1..25: note = Seed: VKLQTVHSIPLTINKEEALQRPVAS
VKLQTVHSIPITIVKFEAIQRPVAS

SEQ ID NO: 57063 - protein, 25 aa, synthetic construct
  source 1..25: note = Seed: VKLQTVHSIPLTINKEEALQRPVAS
VKLQTVHSIPITIVKFEALQRPVAS

SEQ ID NO: 57064 - protein, 25 aa, synthetic construct
  source 1..25: note = Seed: VKLQTVHSIPLTINKEEALQRPVAS
VKLQTVHSIPITIVKFEAMQRPVAS

SEQ ID NO: 57065 - protein, 25 aa, synthetic construct
  source 1..25: note = Seed: VKLQTVHSIPLTINKEEALQRPVAS
VKLQTVHSIPITIVKFEANQRPVAS

SEQ ID NO: 57066 - protein, 25 aa, synthetic construct
  source 1..25: note = Seed: VKLQTVHSIPLTINKEEALQRPVAS
VKLQTVHSIPITIVKFEAPQRPVAS

SEQ ID NO: 57067 - protein, 25 aa, synthetic construct
  source 1..25: note = Seed: VKLQTVHSIPLTINKEEALQRPVAS
VKLQTVHSIPITIVKFEAQQRPVAS

SEQ ID NO: 57068 - protein, 25 aa, synthetic construct
  source 1..25: note = Seed: VKLQTVHSIPLTINKEEALQRPVAS
VKLQTVHSIPITIVKFEARQRPVAS

SEQ ID NO: 57069 - protein, 25 aa, synthetic construct
  source 1..25: note = Seed: VKLQTVHSIPLTINKEEALQRPVAS
VKLQTVHSIPITIVKFEASQRPVAS

SEQ ID NO: 57070 - protein, 25 aa, synthetic construct
  source 1..25: note = Seed: VKLQTVHSIPLTINKEEALQRPVAS
VKLQTVHSIPITIVKFEATQRPVAS

SEQ ID NO: 57071 - protein, 25 aa, synthetic construct
  source 1..25: note = Seed: VKLQTVHSIPLTINKEEALQRPVAS
VKLQTVHSIPITIVKFEAVQRPVAS

SEQ ID NO: 57072 - protein, 25 aa, synthetic construct
  source 1..25: note = Seed: VKLQTVHSIPLTINKEEALQRPVAS
VKLQTVHSIPITIVKFEAWQRPVAS

SEQ ID NO: 57073 - protein, 25 aa, synthetic construct
  source 1..25: note = Seed: VKLQTVHSIPLTINKEEALQRPVAS
VKLQTVHSIPITIVKFEAYQRPVAS

SEQ ID NO: 57074 - protein, 25 aa, synthetic construct
  source 1..25: note = Seed: VKLQTVHSIPLTINKEEALQRPVAS
VKLQTVHSIPITIVKHEAFQRPVAS

SEQ ID NO: 57075 - protein, 25 aa, synthetic construct
  source 1..25: note = Seed: VKLQTVHSIPLTINKEEALQRPVAS
VKLQTVHSIPITIVKHEAIQRPVAS

SEQ ID NO: 57076 - protein, 25 aa, synthetic construct
  source 1..25: note = Seed: VKLQTVHSIPLTINKEEALQRPVAS
VKLQTVHSIPITIVKHEALQRPVAS

SEQ ID NO: 57077 - protein, 25 aa, synthetic construct
  source 1..25: note = Seed: VKLQTVHSIPLTINKEEALQRPVAS
VKLQTVHSIPITIVKHEARQRPVAS

SEQ ID NO: 57078 - protein, 25 aa, synthetic construct
  source 1..25: note = Seed: VKLQTVHSIPLTINKEEALQRPVAS
VKLQTVHSIPITIVKHEAYQRPVAS

SEQ ID NO: 57079 - protein, 25 aa, synthetic construct
  source 1..25: note = Seed: VKLQTVHSIPLTINKEEALQRPVAS
VKLQTVHSIPITIVKIEAAQRPVAS

SEQ ID NO: 57080 - protein, 25 aa, synthetic construct
  source 1..25: note = Seed: VKLQTVHSIPLTINKEEALQRPVAS
VKLQTVHSIPITIVKIEAFQRPVAS

SEQ ID NO: 57081 - protein, 25 aa, synthetic construct
  source 1..25: note = Seed: VKLQTVHSIPLTINKEEALQRPVAS
VKLQTVHSIPITIVKIEAGQRPVAS

SEQ ID NO: 57082 - protein, 25 aa, synthetic construct
  source 1..25: note = Seed: VKLQTVHSIPLTINKEEALQRPVAS
VKLQTVHSIPITIVKIEAIQRPVAS

SEQ ID NO: 57083 - protein, 25 aa, synthetic construct
  source 1..25: note = Seed: VKLQTVHSIPLTINKEEALQRPVAS
VKLQTVHSIPITIVKIEALQRPVAS

SEQ ID NO: 57084 - protein, 25 aa, synthetic construct
  source 1..25: note = Seed: VKLQTVHSIPLTINKEEALQRPVAS
VKLQTVHSIPITIVKIEAMQRPVAS

SEQ ID NO: 57085 - protein, 25 aa, synthetic construct
  source 1..25: note = Seed: VKLQTVHSIPLTINKEEALQRPVAS
VKLQTVHSIPITIVKIEANQRPVAS

SEQ ID NO: 57086 - protein, 25 aa, synthetic construct
  source 1..25: note = Seed: VKLQTVHSIPLTINKEEALQRPVAS
VKLQTVHSIPITIVKIEAQQRPVAS

SEQ ID NO: 57087 - protein, 25 aa, synthetic construct
  source 1..25: note = Seed: VKLQTVHSIPLTINKEEALQRPVAS
VKLQTVHSIPITIVKIEARQRPVAS

SEQ ID NO: 57088 - protein, 25 aa, synthetic construct
  source 1..25: note = Seed: VKLQTVHSIPLTINKEEALQRPVAS
VKLQTVHSIPITIVKIEASQRPVAS

SEQ ID NO: 57089 - protein, 25 aa, synthetic construct
  source 1..25: note = Seed: VKLQTVHSIPLTINKEEALQRPVAS
VKLQTVHSIPITIVKIEATQRPVAS

SEQ ID NO: 57090 - protein, 25 aa, synthetic construct
  source 1..25: note = Seed: VKLQTVHSIPLTINKEEALQRPVAS
VKLQTVHSIPITIVKIEAVQRPVAS

SEQ ID NO: 57091 - protein, 25 aa, synthetic construct
  source 1..25: note = Seed: VKLQTVHSIPLTINKEEALQRPVAS
VKLQTVHSIPITIVKIEAYQRPVAS

SEQ ID NO: 57092 - protein, 25 aa, synthetic construct
  source 1..25: note = Seed: VKLQTVHSIPLTINKEEALQRPVAS
VKLQTVHSIPITIVKKEAFQRPVAS

SEQ ID NO: 57093 - protein, 25 aa, synthetic construct
  source 1..25: note = Seed: VKLQTVHSIPLTINKEEALQRPVAS
VKLQTVHSIPITIVKKEAIQRPVAS

SEQ ID NO: 57094 - protein, 25 aa, synthetic construct
  source 1..25: note = Seed: VKLQTVHSIPLTINKEEALQRPVAS
VKLQTVHSIPITIVKKEALQRPVAS

SEQ ID NO: 57095 - protein, 25 aa, synthetic construct
  source 1..25: note = Seed: VKLQTVHSIPLTINKEEALQRPVAS
VKLQTVHSIPITIVKKEAMQRPVAS

SEQ ID NO: 57096 - protein, 25 aa, synthetic construct
  source 1..25: note = Seed: VKLQTVHSIPLTINKEEALQRPVAS
VKLQTVHSIPITIVKKEAVQRPVAS

SEQ ID NO: 57097 - protein, 25 aa, synthetic construct
  source 1..25: note = Seed: VKLQTVHSIPLTINKEEALQRPVAS
VKLQTVHSIPITIVKKEAYQRPVAS

SEQ ID NO: 57098 - protein, 25 aa, synthetic construct
  source 1..25: note = Seed: VKLQTVHSIPLTINKEEALQRPVAS
VKLQTVHSIPITIVKLEAAQRPVAS

SEQ ID NO: 57099 - protein, 25 aa, synthetic construct
  source 1..25: note = Seed: VKLQTVHSIPLTINKEEALQRPVAS
VKLQTVHSIPITIVKLEAFQRPVAS

SEQ ID NO: 57100 - protein, 25 aa, synthetic construct
  source 1..25: note = Seed: VKLQTVHSIPLTINKEEALQRPVAS
VKLQTVHSIPITIVKLEAIQRPVAS

SEQ ID NO: 57101 - protein, 25 aa, synthetic construct
  source 1..25: note = Seed: VKLQTVHSIPLTINKEEALQRPVAS
VKLQTVHSIPITIVKLEALQRPVAS

SEQ ID NO: 57102 - protein, 25 aa, synthetic construct
  source 1..25: note = Seed: VKLQTVHSIPLTINKEEALQRPVAS
VKLQTVHSIPITIVKLEAMQRPVAS

SEQ ID NO: 57103 - protein, 25 aa, synthetic construct
  source 1..25: note = Seed: VKLQTVHSIPLTINKEEALQRPVAS
VKLQTVHSIPITIVKLEANQRPVAS

SEQ ID NO: 57104 - protein, 25 aa, synthetic construct
  source 1..25: note = Seed: VKLQTVHSIPLTINKEEALQRPVAS
VKLQTVHSIPITIVKLEASQRPVAS

SEQ ID NO: 57105 - protein, 25 aa, synthetic construct
  source 1..25: note = Seed: VKLQTVHSIPLTINKEEALQRPVAS
VKLQTVHSIPITIVKLEAVQRPVAS

SEQ ID NO: 57106 - protein, 25 aa, synthetic construct
  source 1..25: note = Seed: VKLQTVHSIPLTINKEEALQRPVAS
VKLQTVHSIPITIVKLEAYQRPVAS

SEQ ID NO: 57107 - protein, 25 aa, synthetic construct
  source 1..25: note = Seed: VKLQTVHSIPLTINKEEALQRPVAS
VKLQTVHSIPITIVKMEAAQRPVAS

SEQ ID NO: 57108 - protein, 25 aa, synthetic construct
  source 1..25: note = Seed: VKLQTVHSIPLTINKEEALQRPVAS
VKLQTVHSIPITIVKMEAFQRPVAS

SEQ ID NO: 57109 - protein, 25 aa, synthetic construct
  source 1..25: note = Seed: VKLQTVHSIPLTINKEEALQRPVAS
VKLQTVHSIPITIVKMEAIQRPVAS

SEQ ID NO: 57110 - protein, 25 aa, synthetic construct
  source 1..25: note = Seed: VKLQTVHSIPLTINKEEALQRPVAS
VKLQTVHSIPITIVKMEALQRPVAS

SEQ ID NO: 57111 - protein, 25 aa, synthetic construct
  source 1..25: note = Seed: VKLQTVHSIPLTINKEEALQRPVAS
VKLQTVHSIPITIVKMEAMQRPVAS

SEQ ID NO: 57112 - protein, 25 aa, synthetic construct
  source 1..25: note = Seed: VKLQTVHSIPLTINKEEALQRPVAS
VKLQTVHSIPITIVKMEANQRPVAS

SEQ ID NO: 57113 - protein, 25 aa, synthetic construct
  source 1..25: note = Seed: VKLQTVHSIPLTINKEEALQRPVAS
VKLQTVHSIPITIVKMEASQRPVAS

SEQ ID NO: 57114 - protein, 25 aa, synthetic construct
  source 1..25: note = Seed: VKLQTVHSIPLTINKEEALQRPVAS
VKLQTVHSIPITIVKMEAVQRPVAS

SEQ ID NO: 57115 - protein, 25 aa, synthetic construct
  source 1..25: note = Seed: VKLQTVHSIPLTINKEEALQRPVAS
VKLQTVHSIPITIVKMEAYQRPVAS

SEQ ID NO: 57116 - protein, 25 aa, synthetic construct
  source 1..25: note = Seed: VKLQTVHSIPLTINKEEALQRPVAS
VKLQTVHSIPITIVKNEAAQRPVAS

SEQ ID NO: 57117 - protein, 25 aa, synthetic construct
  source 1..25: note = Seed: VKLQTVHSIPLTINKEEALQRPVAS
VKLQTVHSIPITIVKNEAFQRPVAS

SEQ ID NO: 57118 - protein, 25 aa, synthetic construct
  source 1..25: note = Seed: VKLQTVHSIPLTINKEEALQRPVAS
VKLQTVHSIPITIVKNEAIQRPVAS

SEQ ID NO: 57119 - protein, 25 aa, synthetic construct
  source 1..25: note = Seed: VKLQTVHSIPLTINKEEALQRPVAS
VKLQTVHSIPITIVKNEALQRPVAS

SEQ ID NO: 57120 - protein, 25 aa, synthetic construct
  source 1..25: note = Seed: VKLQTVHSIPLTINKEEALQRPVAS
VKLQTVHSIPITIVKNEAMQRPVAS

SEQ ID NO: 57121 - protein, 25 aa, synthetic construct
  source 1..25: note = Seed: VKLQTVHSIPLTINKEEALQRPVAS
VKLQTVHSIPITIVKNEAVQRPVAS

SEQ ID NO: 57122 - protein, 25 aa, synthetic construct
  source 1..25: note = Seed: VKLQTVHSIPLTINKEEALQRPVAS
VKLQTVHSIPITIVKNEAYQRPVAS

SEQ ID NO: 57123 - protein, 25 aa, synthetic construct
  source 1..25: note = Seed: VKLQTVHSIPLTINKEEALQRPVAS
VKLQTVHSIPITIVKPEAIQRPVAS

SEQ ID NO: 57124 - protein, 25 aa, synthetic construct
  source 1..25: note = Seed: VKLQTVHSIPLTINKEEALQRPVAS
VKLQTVHSIPITIVKREAAQRPVAS

SEQ ID NO: 57125 - protein, 25 aa, synthetic construct
  source 1..25: note = Seed: VKLQTVHSIPLTINKEEALQRPVAS
VKLQTVHSIPITIVKREAFQRPVAS

SEQ ID NO: 57126 - protein, 25 aa, synthetic construct
  source 1..25: note = Seed: VKLQTVHSIPLTINKEEALQRPVAS
VKLQTVHSIPITIVKREAHQRPVAS

SEQ ID NO: 57127 - protein, 25 aa, synthetic construct
  source 1..25: note = Seed: VKLQTVHSIPLTINKEEALQRPVAS
VKLQTVHSIPITIVKREAIQRPVAS

SEQ ID NO: 57128 - protein, 25 aa, synthetic construct
  source 1..25: note = Seed: VKLQTVHSIPLTINKEEALQRPVAS
VKLQTVHSIPITIVKREALQRPVAS

SEQ ID NO: 57129 - protein, 25 aa, synthetic construct
  source 1..25: note = Seed: VKLQTVHSIPLTINKEEALQRPVAS
VKLQTVHSIPITIVKREAMQRPVAS

SEQ ID NO: 57130 - protein, 25 aa, synthetic construct
  source 1..25: note = Seed: VKLQTVHSIPLTINKEEALQRPVAS
VKLQTVHSIPITIVKREARQRPVAS

SEQ ID NO: 57131 - protein, 25 aa, synthetic construct
  source 1..25: note = Seed: VKLQTVHSIPLTINKEEALQRPVAS
VKLQTVHSIPITIVKREAVQRPVAS

SEQ ID NO: 57132 - protein, 25 aa, synthetic construct
  source 1..25: note = Seed: VKLQTVHSIPLTINKEEALQRPVAS
VKLQTVHSIPITIVKREAYQRPVAS

SEQ ID NO: 57133 - protein, 25 aa, synthetic construct
  source 1..25: note = Seed: VKLQTVHSIPLTINKEEALQRPVAS
VKLQTVHSIPITIVKSEAAQRPVAS

SEQ ID NO: 57134 - protein, 25 aa, synthetic construct
  source 1..25: note = Seed: VKLQTVHSIPLTINKEEALQRPVAS
VKLQTVHSIPITIVKSEAFQRPVAS

SEQ ID NO: 57135 - protein, 25 aa, synthetic construct
  source 1..25: note = Seed: VKLQTVHSIPLTINKEEALQRPVAS
VKLQTVHSIPITIVKSEAIQRPVAS

SEQ ID NO: 57136 - protein, 25 aa, synthetic construct
  source 1..25: note = Seed: VKLQTVHSIPLTINKEEALQRPVAS
VKLQTVHSIPITIVKSEALQRPVAS

SEQ ID NO: 57137 - protein, 25 aa, synthetic construct
  source 1..25: note = Seed: VKLQTVHSIPLTINKEEALQRPVAS
VKLQTVHSIPITIVKSEAMQRPVAS

SEQ ID NO: 57138 - protein, 25 aa, synthetic construct
  source 1..25: note = Seed: VKLQTVHSIPLTINKEEALQRPVAS
VKLQTVHSIPITIVKSEAVQRPVAS

SEQ ID NO: 57139 - protein, 25 aa, synthetic construct
  source 1..25: note = Seed: VKLQTVHSIPLTINKEEALQRPVAS
VKLQTVHSIPITIVKTEAAQRPVAS

SEQ ID NO: 57140 - protein, 25 aa, synthetic construct
  source 1..25: note = Seed: VKLQTVHSIPLTINKEEALQRPVAS
VKLQTVHSIPITIVKTEAIQRPVAS

SEQ ID NO: 57141 - protein, 25 aa, synthetic construct
  source 1..25: note = Seed: VKLQTVHSIPLTINKEEALQRPVAS
VKLQTVHSIPITIVKTEALQRPVAS

SEQ ID NO: 57142 - protein, 25 aa, synthetic construct
  source 1..25: note = Seed: VKLQTVHSIPLTINKEEALQRPVAS
VKLQTVHSIPITIVKTEAVQRPVAS

SEQ ID NO: 57143 - protein, 25 aa, synthetic construct
  source 1..25: note = Seed: VKLQTVHSIPLTINKEEALQRPVAS
VKLQTVHSIPITIVKVEAAQRPVAS

SEQ ID NO: 57144 - protein, 25 aa, synthetic construct
  source 1..25: note = Seed: VKLQTVHSIPLTINKEEALQRPVAS
VKLQTVHSIPITIVKVEAFQRPVAS

SEQ ID NO: 57145 - protein, 25 aa, synthetic construct
  source 1..25: note = Seed: VKLQTVHSIPLTINKEEALQRPVAS
VKLQTVHSIPITIVKVEAIQRPVAS

SEQ ID NO: 57146 - protein, 25 aa, synthetic construct
  source 1..25: note = Seed: VKLQTVHSIPLTINKEEALQRPVAS
VKLQTVHSIPITIVKVEALQRPVAS

SEQ ID NO: 57147 - protein, 25 aa, synthetic construct
  source 1..25: note = Seed: VKLQTVHSIPLTINKEEALQRPVAS
VKLQTVHSIPITIVKVEAMQRPVAS

SEQ ID NO: 57148 - protein, 25 aa, synthetic construct
  source 1..25: note = Seed: VKLQTVHSIPLTINKEEALQRPVAS
VKLQTVHSIPITIVKVEASQRPVAS

SEQ ID NO: 57149 - protein, 25 aa, synthetic construct
  source 1..25: note = Seed: VKLQTVHSIPLTINKEEALQRPVAS
VKLQTVHSIPITIVKVEATQRPVAS

SEQ ID NO: 57150 - protein, 25 aa, synthetic construct
  source 1..25: note = Seed: VKLQTVHSIPLTINKEEALQRPVAS
VKLQTVHSIPITIVKVEAVQRPVAS

SEQ ID NO: 57151 - protein, 25 aa, synthetic construct
  source 1..25: note = Seed: VKLQTVHSIPLTINKEEALQRPVAS
VKLQTVHSIPITIVKVEAYQRPVAS

SEQ ID NO: 57152 - protein, 25 aa, synthetic construct
  source 1..25: note = Seed: VKLQTVHSIPLTINKEEALQRPVAS
VKLQTVHSIPITIVKWEAFQRPVAS

SEQ ID NO: 57153 - protein, 25 aa, synthetic construct
  source 1..25: note = Seed: VKLQTVHSIPLTINKEEALQRPVAS
VKLQTVHSIPITIVKWEAIQRPVAS

SEQ ID NO: 57154 - protein, 25 aa, synthetic construct
  source 1..25: note = Seed: VKLQTVHSIPLTINKEEALQRPVAS
VKLQTVHSIPITIVKWEALQRPVAS

SEQ ID NO: 57155 - protein, 25 aa, synthetic construct
  source 1..25: note = Seed: VKLQTVHSIPLTINKEEALQRPVAS
VKLQTVHSIPITIVKWEAMQRPVAS

SEQ ID NO: 57156 - protein, 25 aa, synthetic construct
  source 1..25: note = Seed: VKLQTVHSIPLTINKEEALQRPVAS
VKLQTVHSIPITIVKWEAVQRPVAS

SEQ ID NO: 57157 - protein, 25 aa, synthetic construct
  source 1..25: note = Seed: VKLQTVHSIPLTINKEEALQRPVAS
VKLQTVHSIPITIVKWEAYQRPVAS

SEQ ID NO: 57158 - protein, 25 aa, synthetic construct
  source 1..25: note = Seed: VKLQTVHSIPLTINKEEALQRPVAS
VKLQTVHSIPITIVKYEAAQRPVAS

SEQ ID NO: 57159 - protein, 25 aa, synthetic construct
  source 1..25: note = Seed: VKLQTVHSIPLTINKEEALQRPVAS
VKLQTVHSIPITIVKYEAFQRPVAS

SEQ ID NO: 57160 - protein, 25 aa, synthetic construct
  source 1..25: note = Seed: VKLQTVHSIPLTINKEEALQRPVAS
VKLQTVHSIPITIVKYEAIQRPVAS

SEQ ID NO: 57161 - protein, 25 aa, synthetic construct
  source 1..25: note = Seed: VKLQTVHSIPLTINKEEALQRPVAS
VKLQTVHSIPITIVKYEALQRPVAS

SEQ ID NO: 57162 - protein, 25 aa, synthetic construct
  source 1..25: note = Seed: VKLQTVHSIPLTINKEEALQRPVAS
VKLQTVHSIPITIVKYEAMQRPVAS

SEQ ID NO: 57163 - protein, 25 aa, synthetic construct
  source 1..25: note = Seed: VKLQTVHSIPLTINKEEALQRPVAS
VKLQTVHSIPITIVKYEAVQRPVAS

SEQ ID NO: 57164 - protein, 25 aa, synthetic construct
  source 1..25: note = Seed: VKLQTVHSIPLTINKEEALQRPVAS
VKLQTVHSIPITIVKYEAYQRPVAS

SEQ ID NO: 57165 - protein, 25 aa, synthetic construct
  source 1..25: note = Seed: VKLQTVHSIPLTINKEEALQRPVAS
VKLQTVHSIPITIWKAEAAQRPVAS

SEQ ID NO: 57166 - protein, 25 aa, synthetic construct
  source 1..25: note = Seed: VKLQTVHSIPLTINKEEALQRPVAS
VKLQTVHSIPITIWKAEACQRPVAS

SEQ ID NO: 57167 - protein, 25 aa, synthetic construct
  source 1..25: note = Seed: VKLQTVHSIPLTINKEEALQRPVAS
VKLQTVHSIPITIWKAEAFQRPVAS

SEQ ID NO: 57168 - protein, 25 aa, synthetic construct
  source 1..25: note = Seed: VKLQTVHSIPLTINKEEALQRPVAS
VKLQTVHSIPITIWKAEAIQRPVAS

SEQ ID NO: 57169 - protein, 25 aa, synthetic construct
  source 1..25: note = Seed: VKLQTVHSIPLTINKEEALQRPVAS
VKLQTVHSIPITIWKAEALQRPVAS

SEQ ID NO: 57170 - protein, 25 aa, synthetic construct
  source 1..25: note = Seed: VKLQTVHSIPLTINKEEALQRPVAS
VKLQTVHSIPITIWKAEAMQRPVAS

SEQ ID NO: 57171 - protein, 25 aa, synthetic construct
  source 1..25: note = Seed: VKLQTVHSIPLTINKEEALQRPVAS
VKLQTVHSIPITIWKAEASQRPVAS

SEQ ID NO: 57172 - protein, 25 aa, synthetic construct
  source 1..25: note = Seed: VKLQTVHSIPLTINKEEALQRPVAS
VKLQTVHSIPITIWKAEATQRPVAS

SEQ ID NO: 57173 - protein, 25 aa, synthetic construct
  source 1..25: note = Seed: VKLQTVHSIPLTINKEEALQRPVAS
VKLQTVHSIPITIWKAEAVQRPVAS

SEQ ID NO: 57174 - protein, 25 aa, synthetic construct
  source 1..25: note = Seed: VKLQTVHSIPLTINKEEALQRPVAS
VKLQTVHSIPITIWKAEAYQRPVAS

SEQ ID NO: 57175 - protein, 25 aa, synthetic construct
  source 1..25: note = Seed: VKLQTVHSIPLTINKEEALQRPVAS
VKLQTVHSIPITIWKDEAAQRPVAS

SEQ ID NO: 57176 - protein, 25 aa, synthetic construct
  source 1..25: note = Seed: VKLQTVHSIPLTINKEEALQRPVAS
VKLQTVHSIPITIWKDEAFQRPVAS

SEQ ID NO: 57177 - protein, 25 aa, synthetic construct
  source 1..25: note = Seed: VKLQTVHSIPLTINKEEALQRPVAS
VKLQTVHSIPITIWKDEAIQRPVAS

SEQ ID NO: 57178 - protein, 25 aa, synthetic construct
  source 1..25: note = Seed: VKLQTVHSIPLTINKEEALQRPVAS
VKLQTVHSIPITIWKDEALQRPVAS

SEQ ID NO: 57179 - protein, 25 aa, synthetic construct
  source 1..25: note = Seed: VKLQTVHSIPLTINKEEALQRPVAS
VKLQTVHSIPITIWKDEAMQRPVAS

SEQ ID NO: 57180 - protein, 25 aa, synthetic construct
  source 1..25: note = Seed: VKLQTVHSIPLTINKEEALQRPVAS
VKLQTVHSIPITIWKDEASQRPVAS

SEQ ID NO: 57181 - protein, 25 aa, synthetic construct
  source 1..25: note = Seed: VKLQTVHSIPLTINKEEALQRPVAS
VKLQTVHSIPITIWKDEATQRPVAS

SEQ ID NO: 57182 - protein, 25 aa, synthetic construct
  source 1..25: note = Seed: VKLQTVHSIPLTINKEEALQRPVAS
VKLQTVHSIPITIWKDEAVQRPVAS

SEQ ID NO: 57183 - protein, 25 aa, synthetic construct
  source 1..25: note = Seed: VKLQTVHSIPLTINKEEALQRPVAS
VKLQTVHSIPITIWKDEAYQRPVAS

SEQ ID NO: 57184 - protein, 25 aa, synthetic construct
  source 1..25: note = Seed: VKLQTVHSIPLTINKEEALQRPVAS
VKLQTVHSIPITIWKFEAFQRPVAS

SEQ ID NO: 57185 - protein, 25 aa, synthetic construct
  source 1..25: note = Seed: VKLQTVHSIPLTINKEEALQRPVAS
VKLQTVHSIPITIWKFEAIQRPVAS

SEQ ID NO: 57186 - protein, 25 aa, synthetic construct
  source 1..25: note = Seed: VKLQTVHSIPLTINKEEALQRPVAS
VKLQTVHSIPITIWKFEALQRPVAS

SEQ ID NO: 57187 - protein, 25 aa, synthetic construct
  source 1..25: note = Seed: VKLQTVHSIPLTINKEEALQRPVAS
VKLQTVHSIPITIWKFEAMQRPVAS

SEQ ID NO: 57188 - protein, 25 aa, synthetic construct
  source 1..25: note = Seed: VKLQTVHSIPLTINKEEALQRPVAS
VKLQTVHSIPITIWKFEAVQRPVAS

SEQ ID NO: 57189 - protein, 25 aa, synthetic construct
  source 1..25: note = Seed: VKLQTVHSIPLTINKEEALQRPVAS
VKLQTVHSIPITIWKFEAYQRPVAS

SEQ ID NO: 57190 - protein, 25 aa, synthetic construct
  source 1..25: note = Seed: VKLQTVHSIPLTINKEEALQRPVAS
VKLQTVHSIPITIWKGEAIQRPVAS

SEQ ID NO: 57191 - protein, 25 aa, synthetic construct
  source 1..25: note = Seed: VKLQTVHSIPLTINKEEALQRPVAS
VKLQTVHSIPITIWKHEAFQRPVAS

SEQ ID NO: 57192 - protein, 25 aa, synthetic construct
  source 1..25: note = Seed: VKLQTVHSIPLTINKEEALQRPVAS
VKLQTVHSIPITIWKHEAIQRPVAS

SEQ ID NO: 57193 - protein, 25 aa, synthetic construct
  source 1..25: note = Seed: VKLQTVHSIPLTINKEEALQRPVAS
VKLQTVHSIPITIWKHEALQRPVAS

SEQ ID NO: 57194 - protein, 25 aa, synthetic construct
  source 1..25: note = Seed: VKLQTVHSIPLTINKEEALQRPVAS
VKLQTVHSIPITIWKHEAYQRPVAS

SEQ ID NO: 57195 - protein, 25 aa, synthetic construct
  source 1..25: note = Seed: VKLQTVHSIPLTINKEEALQRPVAS
VKLQTVHSIPITIWKIEAAQRPVAS

SEQ ID NO: 57196 - protein, 25 aa, synthetic construct
  source 1..25: note = Seed: VKLQTVHSIPLTINKEEALQRPVAS
VKLQTVHSIPITIWKIEADQRPVAS

SEQ ID NO: 57197 - protein, 25 aa, synthetic construct
  source 1..25: note = Seed: VKLQTVHSIPLTINKEEALQRPVAS
VKLQTVHSIPITIWKIEAFQRPVAS

SEQ ID NO: 57198 - protein, 25 aa, synthetic construct
  source 1..25: note = Seed: VKLQTVHSIPLTINKEEALQRPVAS
VKLQTVHSIPITIWKIEAGQRPVAS

SEQ ID NO: 57199 - protein, 25 aa, synthetic construct
  source 1..25: note = Seed: VKLQTVHSIPLTINKEEALQRPVAS
VKLQTVHSIPITIWKIEAIQRPVAS

SEQ ID NO: 57200 - protein, 25 aa, synthetic construct
  source 1..25: note = Seed: VKLQTVHSIPLTINKEEALQRPVAS
VKLQTVHSIPITIWKIEALQRPVAS

SEQ ID NO: 57201 - protein, 25 aa, synthetic construct
  source 1..25: note = Seed: VKLQTVHSIPLTINKEEALQRPVAS
VKLQTVHSIPITIWKIEAMQRPVAS

SEQ ID NO: 57202 - protein, 25 aa, synthetic construct
  source 1..25: note = Seed: VKLQTVHSIPLTINKEEALQRPVAS
VKLQTVHSIPITIWKIEANQRPVAS

SEQ ID NO: 57203 - protein, 25 aa, synthetic construct
  source 1..25: note = Seed: VKLQTVHSIPLTINKEEALQRPVAS
VKLQTVHSIPITIWKIEARQRPVAS

SEQ ID NO: 57204 - protein, 25 aa, synthetic construct
  source 1..25: note = Seed: VKLQTVHSIPLTINKEEALQRPVAS
VKLQTVHSIPITIWKIEASQRPVAS

SEQ ID NO: 57205 - protein, 25 aa, synthetic construct
  source 1..25: note = Seed: VKLQTVHSIPLTINKEEALQRPVAS
VKLQTVHSIPITIWKIEATQRPVAS

SEQ ID NO: 57206 - protein, 25 aa, synthetic construct
  source 1..25: note = Seed: VKLQTVHSIPLTINKEEALQRPVAS
VKLQTVHSIPITIWKIEAVQRPVAS

SEQ ID NO: 57207 - protein, 25 aa, synthetic construct
  source 1..25: note = Seed: VKLQTVHSIPLTINKEEALQRPVAS
VKLQTVHSIPITIWKIEAYQRPVAS

SEQ ID NO: 57208 - protein, 25 aa, synthetic construct
  source 1..25: note = Seed: VKLQTVHSIPLTINKEEALQRPVAS
VKLQTVHSIPITIWKKEAFQRPVAS

SEQ ID NO: 57209 - protein, 25 aa, synthetic construct
  source 1..25: note = Seed: VKLQTVHSIPLTINKEEALQRPVAS
VKLQTVHSIPITIWKKEAIQRPVAS

SEQ ID NO: 57210 - protein, 25 aa, synthetic construct
  source 1..25: note = Seed: VKLQTVHSIPLTINKEEALQRPVAS
VKLQTVHSIPITIWKKEALQRPVAS

SEQ ID NO: 57211 - protein, 25 aa, synthetic construct
  source 1..25: note = Seed: VKLQTVHSIPLTINKEEALQRPVAS
VKLQTVHSIPITIWKKEAMQRPVAS

SEQ ID NO: 57212 - protein, 25 aa, synthetic construct
  source 1..25: note = Seed: VKLQTVHSIPLTINKEEALQRPVAS
VKLQTVHSIPITIWKKEAVQRPVAS

SEQ ID NO: 57213 - protein, 25 aa, synthetic construct
  source 1..25: note = Seed: VKLQTVHSIPLTINKEEALQRPVAS
VKLQTVHSIPITIWKKEAYQRPVAS

SEQ ID NO: 57214 - protein, 25 aa, synthetic construct
  source 1..25: note = Seed: VKLQTVHSIPLTINKEEALQRPVAS
VKLQTVHSIPITIWKLEAAQRPVAS

SEQ ID NO: 57215 - protein, 25 aa, synthetic construct
  source 1..25: note = Seed: VKLQTVHSIPLTINKEEALQRPVAS
VKLQTVHSIPITIWKLEAFQRPVAS

SEQ ID NO: 57216 - protein, 25 aa, synthetic construct
  source 1..25: note = Seed: VKLQTVHSIPLTINKEEALQRPVAS
VKLQTVHSIPITIWKLEAIQRPVAS

SEQ ID NO: 57217 - protein, 25 aa, synthetic construct
  source 1..25: note = Seed: VKLQTVHSIPLTINKEEALQRPVAS
VKLQTVHSIPITIWKLEALQRPVAS

SEQ ID NO: 57218 - protein, 25 aa, synthetic construct
  source 1..25: note = Seed: VKLQTVHSIPLTINKEEALQRPVAS
VKLQTVHSIPITIWKLEAMQRPVAS

SEQ ID NO: 57219 - protein, 25 aa, synthetic construct
  source 1..25: note = Seed: VKLQTVHSIPLTINKEEALQRPVAS
VKLQTVHSIPITIWKLEASQRPVAS

SEQ ID NO: 57220 - protein, 25 aa, synthetic construct
  source 1..25: note = Seed: VKLQTVHSIPLTINKEEALQRPVAS
VKLQTVHSIPITIWKLEAVQRPVAS

SEQ ID NO: 57221 - protein, 25 aa, synthetic construct
  source 1..25: note = Seed: VKLQTVHSIPLTINKEEALQRPVAS
VKLQTVHSIPITIWKLEAYQRPVAS

SEQ ID NO: 57222 - protein, 25 aa, synthetic construct
  source 1..25: note = Seed: VKLQTVHSIPLTINKEEALQRPVAS
VKLQTVHSIPITIWKMEAAQRPVAS

SEQ ID NO: 57223 - protein, 25 aa, synthetic construct
  source 1..25: note = Seed: VKLQTVHSIPLTINKEEALQRPVAS
VKLQTVHSIPITIWKMEAFQRPVAS

SEQ ID NO: 57224 - protein, 25 aa, synthetic construct
  source 1..25: note = Seed: VKLQTVHSIPLTINKEEALQRPVAS
VKLQTVHSIPITIWKMEAIQRPVAS

SEQ ID NO: 57225 - protein, 25 aa, synthetic construct
  source 1..25: note = Seed: VKLQTVHSIPLTINKEEALQRPVAS
VKLQTVHSIPITIWKMEALQRPVAS

SEQ ID NO: 57226 - protein, 25 aa, synthetic construct
  source 1..25: note = Seed: VKLQTVHSIPLTINKEEALQRPVAS
VKLQTVHSIPITIWKMEAMQRPVAS

SEQ ID NO: 57227 - protein, 25 aa, synthetic construct
  source 1..25: note = Seed: VKLQTVHSIPLTINKEEALQRPVAS
VKLQTVHSIPITIWKMEASQRPVAS

SEQ ID NO: 57228 - protein, 25 aa, synthetic construct
  source 1..25: note = Seed: VKLQTVHSIPLTINKEEALQRPVAS
VKLQTVHSIPITIWKMEAVQRPVAS

SEQ ID NO: 57229 - protein, 25 aa, synthetic construct
  source 1..25: note = Seed: VKLQTVHSIPLTINKEEALQRPVAS
VKLQTVHSIPITIWKMEAYQRPVAS

SEQ ID NO: 57230 - protein, 25 aa, synthetic construct
  source 1..25: note = Seed: VKLQTVHSIPLTINKEEALQRPVAS
VKLQTVHSIPITIWKNEAAQRPVAS

SEQ ID NO: 57231 - protein, 25 aa, synthetic construct
  source 1..25: note = Seed: VKLQTVHSIPLTINKEEALQRPVAS
VKLQTVHSIPITIWKNEAFQRPVAS

SEQ ID NO: 57232 - protein, 25 aa, synthetic construct
  source 1..25: note = Seed: VKLQTVHSIPLTINKEEALQRPVAS
VKLQTVHSIPITIWKNEAIQRPVAS

SEQ ID NO: 57233 - protein, 25 aa, synthetic construct
  source 1..25: note = Seed: VKLQTVHSIPLTINKEEALQRPVAS
VKLQTVHSIPITIWKNEALQRPVAS

SEQ ID NO: 57234 - protein, 25 aa, synthetic construct
  source 1..25: note = Seed: VKLQTVHSIPLTINKEEALQRPVAS
VKLQTVHSIPITIWKNEAMQRPVAS

SEQ ID NO: 57235 - protein, 25 aa, synthetic construct
  source 1..25: note = Seed: VKLQTVHSIPLTINKEEALQRPVAS
VKLQTVHSIPITIWKNEAVQRPVAS

SEQ ID NO: 57236 - protein, 25 aa, synthetic construct
  source 1..25: note = Seed: VKLQTVHSIPLTINKEEALQRPVAS
VKLQTVHSIPITIWKNEAYQRPVAS

SEQ ID NO: 57237 - protein, 25 aa, synthetic construct
  source 1..25: note = Seed: VKLQTVHSIPLTINKEEALQRPVAS
VKLQTVHSIPITIWKPEAIQRPVAS

SEQ ID NO: 57238 - protein, 25 aa, synthetic construct
  source 1..25: note = Seed: VKLQTVHSIPLTINKEEALQRPVAS
VKLQTVHSIPITIWKPEALQRPVAS

SEQ ID NO: 57239 - protein, 25 aa, synthetic construct
  source 1..25: note = Seed: VKLQTVHSIPLTINKEEALQRPVAS
VKLQTVHSIPITIWKPEAVQRPVAS

SEQ ID NO: 57240 - protein, 25 aa, synthetic construct
  source 1..25: note = Seed: VKLQTVHSIPLTINKEEALQRPVAS
VKLQTVHSIPITIWKREAFQRPVAS

SEQ ID NO: 57241 - protein, 25 aa, synthetic construct
  source 1..25: note = Seed: VKLQTVHSIPLTINKEEALQRPVAS
VKLQTVHSIPITIWKREAIQRPVAS

SEQ ID NO: 57242 - protein, 25 aa, synthetic construct
  source 1..25: note = Seed: VKLQTVHSIPLTINKEEALQRPVAS
VKLQTVHSIPITIWKREALQRPVAS

SEQ ID NO: 57243 - protein, 25 aa, synthetic construct
  source 1..25: note = Seed: VKLQTVHSIPLTINKEEALQRPVAS
VKLQTVHSIPITIWKREAMQRPVAS

SEQ ID NO: 57244 - protein, 25 aa, synthetic construct
  source 1..25: note = Seed: VKLQTVHSIPLTINKEEALQRPVAS
VKLQTVHSIPITIWKREARQRPVAS

SEQ ID NO: 57245 - protein, 25 aa, synthetic construct
  source 1..25: note = Seed: VKLQTVHSIPLTINKEEALQRPVAS
VKLQTVHSIPITIWKREAVQRPVAS

SEQ ID NO: 57246 - protein, 25 aa, synthetic construct
  source 1..25: note = Seed: VKLQTVHSIPLTINKEEALQRPVAS
VKLQTVHSIPITIWKREAYQRPVAS

SEQ ID NO: 57247 - protein, 25 aa, synthetic construct
  source 1..25: note = Seed: VKLQTVHSIPLTINKEEALQRPVAS
VKLQTVHSIPITIWKSEAAQRPVAS

SEQ ID NO: 57248 - protein, 25 aa, synthetic construct
  source 1..25: note = Seed: VKLQTVHSIPLTINKEEALQRPVAS
VKLQTVHSIPITIWKSEAFQRPVAS

SEQ ID NO: 57249 - protein, 25 aa, synthetic construct
  source 1..25: note = Seed: VKLQTVHSIPLTINKEEALQRPVAS
VKLQTVHSIPITIWKSEAIQRPVAS

SEQ ID NO: 57250 - protein, 25 aa, synthetic construct
  source 1..25: note = Seed: VKLQTVHSIPLTINKEEALQRPVAS
VKLQTVHSIPITIWKSEALQRPVAS

SEQ ID NO: 57251 - protein, 25 aa, synthetic construct
  source 1..25: note = Seed: VKLQTVHSIPLTINKEEALQRPVAS
VKLQTVHSIPITIWKSEAMQRPVAS

SEQ ID NO: 57252 - protein, 25 aa, synthetic construct
  source 1..25: note = Seed: VKLQTVHSIPLTINKEEALQRPVAS
VKLQTVHSIPITIWKSEAVQRPVAS

SEQ ID NO: 57253 - protein, 25 aa, synthetic construct
  source 1..25: note = Seed: VKLQTVHSIPLTINKEEALQRPVAS
VKLQTVHSIPITIWKTEAAQRPVAS

SEQ ID NO: 57254 - protein, 25 aa, synthetic construct
  source 1..25: note = Seed: VKLQTVHSIPLTINKEEALQRPVAS
VKLQTVHSIPITIWKTEAFQRPVAS

SEQ ID NO: 57255 - protein, 25 aa, synthetic construct
  source 1..25: note = Seed: VKLQTVHSIPLTINKEEALQRPVAS
VKLQTVHSIPITIWKTEAIQRPVAS

SEQ ID NO: 57256 - protein, 25 aa, synthetic construct
  source 1..25: note = Seed: VKLQTVHSIPLTINKEEALQRPVAS
VKLQTVHSIPITIWKTEALQRPVAS

SEQ ID NO: 57257 - protein, 25 aa, synthetic construct
  source 1..25: note = Seed: VKLQTVHSIPLTINKEEALQRPVAS
VKLQTVHSIPITIWKTEAMQRPVAS

SEQ ID NO: 57258 - protein, 25 aa, synthetic construct
  source 1..25: note = Seed: VKLQTVHSIPLTINKEEALQRPVAS
VKLQTVHSIPITIWKTEAVQRPVAS

SEQ ID NO: 57259 - protein, 25 aa, synthetic construct
  source 1..25: note = Seed: VKLQTVHSIPLTINKEEALQRPVAS
VKLQTVHSIPITIWKVEAAQRPVAS

SEQ ID NO: 57260 - protein, 25 aa, synthetic construct
  source 1..25: note = Seed: VKLQTVHSIPLTINKEEALQRPVAS
VKLQTVHSIPITIWKVEAFQRPVAS

SEQ ID NO: 57261 - protein, 25 aa, synthetic construct
  source 1..25: note = Seed: VKLQTVHSIPLTINKEEALQRPVAS
VKLQTVHSIPITIWKVEAIQRPVAS

SEQ ID NO: 57262 - protein, 25 aa, synthetic construct
  source 1..25: note = Seed: VKLQTVHSIPLTINKEEALQRPVAS
VKLQTVHSIPITIWKVEALQRPVAS

SEQ ID NO: 57263 - protein, 25 aa, synthetic construct
  source 1..25: note = Seed: VKLQTVHSIPLTINKEEALQRPVAS
VKLQTVHSIPITIWKVEAMQRPVAS

SEQ ID NO: 57264 - protein, 25 aa, synthetic construct
  source 1..25: note = Seed: VKLQTVHSIPLTINKEEALQRPVAS
VKLQTVHSIPITIWKVEASQRPVAS

SEQ ID NO: 57265 - protein, 25 aa, synthetic construct
  source 1..25: note = Seed: VKLQTVHSIPLTINKEEALQRPVAS
VKLQTVHSIPITIWKVEATQRPVAS

SEQ ID NO: 57266 - protein, 25 aa, synthetic construct
  source 1..25: note = Seed: VKLQTVHSIPLTINKEEALQRPVAS
VKLQTVHSIPITIWKVEAVQRPVAS

SEQ ID NO: 57267 - protein, 25 aa, synthetic construct
  source 1..25: note = Seed: VKLQTVHSIPLTINKEEALQRPVAS
VKLQTVHSIPITIWKVEAYQRPVAS

SEQ ID NO: 57268 - protein, 25 aa, synthetic construct
  source 1..25: note = Seed: VKLQTVHSIPLTINKEEALQRPVAS
VKLQTVHSIPITIWKWEAFQRPVAS

SEQ ID NO: 57269 - protein, 25 aa, synthetic construct
  source 1..25: note = Seed: VKLQTVHSIPLTINKEEALQRPVAS
VKLQTVHSIPITIWKWEAIQRPVAS

SEQ ID NO: 57270 - protein, 25 aa, synthetic construct
  source 1..25: note = Seed: VKLQTVHSIPLTINKEEALQRPVAS
VKLQTVHSIPITIWKWEALQRPVAS

SEQ ID NO: 57271 - protein, 25 aa, synthetic construct
  source 1..25: note = Seed: VKLQTVHSIPLTINKEEALQRPVAS
VKLQTVHSIPITIWKWEAVQRPVAS

SEQ ID NO: 57272 - protein, 25 aa, synthetic construct
  source 1..25: note = Seed: VKLQTVHSIPLTINKEEALQRPVAS
VKLQTVHSIPITIWKYEAFQRPVAS

SEQ ID NO: 57273 - protein, 25 aa, synthetic construct
  source 1..25: note = Seed: VKLQTVHSIPLTINKEEALQRPVAS
VKLQTVHSIPITIWKYEAIQRPVAS

SEQ ID NO: 57274 - protein, 25 aa, synthetic construct
  source 1..25: note = Seed: VKLQTVHSIPLTINKEEALQRPVAS
VKLQTVHSIPITIWKYEALQRPVAS

SEQ ID NO: 57275 - protein, 25 aa, synthetic construct
  source 1..25: note = Seed: VKLQTVHSIPLTINKEEALQRPVAS
VKLQTVHSIPITIWKYEAMQRPVAS

SEQ ID NO: 57276 - protein, 25 aa, synthetic construct
  source 1..25: note = Seed: VKLQTVHSIPLTINKEEALQRPVAS
VKLQTVHSIPITIWKYEAVQRPVAS

SEQ ID NO: 57277 - protein, 25 aa, synthetic construct
  source 1..25: note = Seed: VKLQTVHSIPLTINKEEALQRPVAS
VKLQTVHSIPITIYKAEAAQRPVAS

SEQ ID NO: 57278 - protein, 25 aa, synthetic construct
  source 1..25: note = Seed: VKLQTVHSIPLTINKEEALQRPVAS
VKLQTVHSIPITIYKAEACQRPVAS

SEQ ID NO: 57279 - protein, 25 aa, synthetic construct
  source 1..25: note = Seed: VKLQTVHSIPLTINKEEALQRPVAS
VKLQTVHSIPITIYKAEAFQRPVAS

SEQ ID NO: 57280 - protein, 25 aa, synthetic construct
  source 1..25: note = Seed: VKLQTVHSIPLTINKEEALQRPVAS
VKLQTVHSIPITIYKAEAGQRPVAS

SEQ ID NO: 57281 - protein, 25 aa, synthetic construct
  source 1..25: note = Seed: VKLQTVHSIPLTINKEEALQRPVAS
VKLQTVHSIPITIYKAEAIQRPVAS

SEQ ID NO: 57282 - protein, 25 aa, synthetic construct
  source 1..25: note = Seed: VKLQTVHSIPLTINKEEALQRPVAS
VKLQTVHSIPITIYKAEALQRPVAS

SEQ ID NO: 57283 - protein, 25 aa, synthetic construct
  source 1..25: note = Seed: VKLQTVHSIPLTINKEEALQRPVAS
VKLQTVHSIPITIYKAEAMQRPVAS

SEQ ID NO: 57284 - protein, 25 aa, synthetic construct
  source 1..25: note = Seed: VKLQTVHSIPLTINKEEALQRPVAS
VKLQTVHSIPITIYKAEANQRPVAS

SEQ ID NO: 57285 - protein, 25 aa, synthetic construct
  source 1..25: note = Seed: VKLQTVHSIPLTINKEEALQRPVAS
VKLQTVHSIPITIYKAEAQQRPVAS

SEQ ID NO: 57286 - protein, 25 aa, synthetic construct
  source 1..25: note = Seed: VKLQTVHSIPLTINKEEALQRPVAS
VKLQTVHSIPITIYKAEARQRPVAS

SEQ ID NO: 57287 - protein, 25 aa, synthetic construct
  source 1..25: note = Seed: VKLQTVHSIPLTINKEEALQRPVAS
VKLQTVHSIPITIYKAEASQRPVAS

SEQ ID NO: 57288 - protein, 25 aa, synthetic construct
  source 1..25: note = Seed: VKLQTVHSIPLTINKEEALQRPVAS
VKLQTVHSIPITIYKAEATQRPVAS

SEQ ID NO: 57289 - protein, 25 aa, synthetic construct
  source 1..25: note = Seed: VKLQTVHSIPLTINKEEALQRPVAS
VKLQTVHSIPITIYKAEAVQRPVAS

SEQ ID NO: 57290 - protein, 25 aa, synthetic construct
  source 1..25: note = Seed: VKLQTVHSIPLTINKEEALQRPVAS
VKLQTVHSIPITIYKAEAYQRPVAS

SEQ ID NO: 57291 - protein, 25 aa, synthetic construct
  source 1..25: note = Seed: VKLQTVHSIPLTINKEEALQRPVAS
VKLQTVHSIPITIYKDEAAQRPVAS

SEQ ID NO: 57292 - protein, 25 aa, synthetic construct
  source 1..25: note = Seed: VKLQTVHSIPLTINKEEALQRPVAS
VKLQTVHSIPITIYKDEACQRPVAS

SEQ ID NO: 57293 - protein, 25 aa, synthetic construct
  source 1..25: note = Seed: VKLQTVHSIPLTINKEEALQRPVAS
VKLQTVHSIPITIYKDEADQRPVAS

SEQ ID NO: 57294 - protein, 25 aa, synthetic construct
  source 1..25: note = Seed: VKLQTVHSIPLTINKEEALQRPVAS
VKLQTVHSIPITIYKDEAEQRPVAS

SEQ ID NO: 57295 - protein, 25 aa, synthetic construct
  source 1..25: note = Seed: VKLQTVHSIPLTINKEEALQRPVAS
VKLQTVHSIPITIYKDEAFQRPVAS

SEQ ID NO: 57296 - protein, 25 aa, synthetic construct
  source 1..25: note = Seed: VKLQTVHSIPLTINKEEALQRPVAS
VKLQTVHSIPITIYKDEAGQRPVAS

SEQ ID NO: 57297 - protein, 25 aa, synthetic construct
  source 1..25: note = Seed: VKLQTVHSIPLTINKEEALQRPVAS
VKLQTVHSIPITIYKDEAIQRPVAS

SEQ ID NO: 57298 - protein, 25 aa, synthetic construct
  source 1..25: note = Seed: VKLQTVHSIPLTINKEEALQRPVAS
VKLQTVHSIPITIYKDEALQRPVAS

SEQ ID NO: 57299 - protein, 25 aa, synthetic construct
  source 1..25: note = Seed: VKLQTVHSIPLTINKEEALQRPVAS
VKLQTVHSIPITIYKDEAMQRPVAS

SEQ ID NO: 57300 - protein, 25 aa, synthetic construct
  source 1..25: note = Seed: VKLQTVHSIPLTINKEEALQRPVAS
VKLQTVHSIPITIYKDEANQRPVAS

SEQ ID NO: 57301 - protein, 25 aa, synthetic construct
  source 1..25: note = Seed: VKLQTVHSIPLTINKEEALQRPVAS
VKLQTVHSIPITIYKDEAQQRPVAS

SEQ ID NO: 57302 - protein, 25 aa, synthetic construct
  source 1..25: note = Seed: VKLQTVHSIPLTINKEEALQRPVAS
VKLQTVHSIPITIYKDEASQRPVAS

SEQ ID NO: 57303 - protein, 25 aa, synthetic construct
  source 1..25: note = Seed: VKLQTVHSIPLTINKEEALQRPVAS
VKLQTVHSIPITIYKDEATQRPVAS

SEQ ID NO: 57304 - protein, 25 aa, synthetic construct
  source 1..25: note = Seed: VKLQTVHSIPLTINKEEALQRPVAS
VKLQTVHSIPITIYKDEAVQRPVAS

SEQ ID NO: 57305 - protein, 25 aa, synthetic construct
  source 1..25: note = Seed: VKLQTVHSIPLTINKEEALQRPVAS
VKLQTVHSIPITIYKDEAWQRPVAS

SEQ ID NO: 57306 - protein, 25 aa, synthetic construct
  source 1..25: note = Seed: VKLQTVHSIPLTINKEEALQRPVAS
VKLQTVHSIPITIYKDEAYQRPVAS

SEQ ID NO: 57307 - protein, 25 aa, synthetic construct
  source 1..25: note = Seed: VKLQTVHSIPLTINKEEALQRPVAS
VKLQTVHSIPITIYKEEAAQRPVAS

SEQ ID NO: 57308 - protein, 25 aa, synthetic construct
  source 1..25: note = Seed: VKLQTVHSIPLTINKEEALQRPVAS
VKLQTVHSIPITIYKFEAAQRPVAS

SEQ ID NO: 57309 - protein, 25 aa, synthetic construct
  source 1..25: note = Seed: VKLQTVHSIPLTINKEEALQRPVAS
VKLQTVHSIPITIYKFEAEQRPVAS

SEQ ID NO: 57310 - protein, 25 aa, synthetic construct
  source 1..25: note = Seed: VKLQTVHSIPLTINKEEALQRPVAS
VKLQTVHSIPITIYKFEAFQRPVAS

SEQ ID NO: 57311 - protein, 25 aa, synthetic construct
  source 1..25: note = Seed: VKLQTVHSIPLTINKEEALQRPVAS
VKLQTVHSIPITIYKFEAIQRPVAS

SEQ ID NO: 57312 - protein, 25 aa, synthetic construct
  source 1..25: note = Seed: VKLQTVHSIPLTINKEEALQRPVAS
VKLQTVHSIPITIYKFEALQRPVAS

SEQ ID NO: 57313 - protein, 25 aa, synthetic construct
  source 1..25: note = Seed: VKLQTVHSIPLTINKEEALQRPVAS
VKLQTVHSIPITIYKFEAMQRPVAS

SEQ ID NO: 57314 - protein, 25 aa, synthetic construct
  source 1..25: note = Seed: VKLQTVHSIPLTINKEEALQRPVAS
VKLQTVHSIPITIYKFEANQRPVAS

SEQ ID NO: 57315 - protein, 25 aa, synthetic construct
  source 1..25: note = Seed: VKLQTVHSIPLTINKEEALQRPVAS
VKLQTVHSIPITIYKFEASQRPVAS

SEQ ID NO: 57316 - protein, 25 aa, synthetic construct
  source 1..25: note = Seed: VKLQTVHSIPLTINKEEALQRPVAS
VKLQTVHSIPITIYKFEATQRPVAS

SEQ ID NO: 57317 - protein, 25 aa, synthetic construct
  source 1..25: note = Seed: VKLQTVHSIPLTINKEEALQRPVAS
VKLQTVHSIPITIYKFEAVQRPVAS

SEQ ID NO: 57318 - protein, 25 aa, synthetic construct
  source 1..25: note = Seed: VKLQTVHSIPLTINKEEALQRPVAS
VKLQTVHSIPITIYKFEAWQRPVAS

SEQ ID NO: 57319 - protein, 25 aa, synthetic construct
  source 1..25: note = Seed: VKLQTVHSIPLTINKEEALQRPVAS
VKLQTVHSIPITIYKFEAYQRPVAS

SEQ ID NO: 57320 - protein, 25 aa, synthetic construct
  source 1..25: note = Seed: VKLQTVHSIPLTINKEEALQRPVAS
VKLQTVHSIPITIYKGEAAQRPVAS

SEQ ID NO: 57321 - protein, 25 aa, synthetic construct
  source 1..25: note = Seed: VKLQTVHSIPLTINKEEALQRPVAS
VKLQTVHSIPITIYKGEAIQRPVAS

SEQ ID NO: 57322 - protein, 25 aa, synthetic construct
  source 1..25: note = Seed: VKLQTVHSIPLTINKEEALQRPVAS
VKLQTVHSIPITIYKGEALQRPVAS

SEQ ID NO: 57323 - protein, 25 aa, synthetic construct
  source 1..25: note = Seed: VKLQTVHSIPLTINKEEALQRPVAS
VKLQTVHSIPITIYKGEAMQRPVAS

SEQ ID NO: 57324 - protein, 25 aa, synthetic construct
  source 1..25: note = Seed: VKLQTVHSIPLTINKEEALQRPVAS
VKLQTVHSIPITIYKGEAVQRPVAS

SEQ ID NO: 57325 - protein, 25 aa, synthetic construct
  source 1..25: note = Seed: VKLQTVHSIPLTINKEEALQRPVAS
VKLQTVHSIPITIYKHEAFQRPVAS

SEQ ID NO: 57326 - protein, 25 aa, synthetic construct
  source 1..25: note = Seed: VKLQTVHSIPLTINKEEALQRPVAS
VKLQTVHSIPITIYKHEAIQRPVAS

SEQ ID NO: 57327 - protein, 25 aa, synthetic construct
  source 1..25: note = Seed: VKLQTVHSIPLTINKEEALQRPVAS
VKLQTVHSIPITIYKHEALQRPVAS

SEQ ID NO: 57328 - protein, 25 aa, synthetic construct
  source 1..25: note = Seed: VKLQTVHSIPLTINKEEALQRPVAS
VKLQTVHSIPITIYKHEAMQRPVAS

SEQ ID NO: 57329 - protein, 25 aa, synthetic construct
  source 1..25: note = Seed: VKLQTVHSIPLTINKEEALQRPVAS
VKLQTVHSIPITIYKHEAVQRPVAS

SEQ ID NO: 57330 - protein, 25 aa, synthetic construct
  source 1..25: note = Seed: VKLQTVHSIPLTINKEEALQRPVAS
VKLQTVHSIPITIYKHEAYQRPVAS

SEQ ID NO: 57331 - protein, 25 aa, synthetic construct
  source 1..25: note = Seed: VKLQTVHSIPLTINKEEALQRPVAS
VKLQTVHSIPITIYKIEAAQRPVAS

SEQ ID NO: 57332 - protein, 25 aa, synthetic construct
  source 1..25: note = Seed: VKLQTVHSIPLTINKEEALQRPVAS
VKLQTVHSIPITIYKIEACQRPVAS

SEQ ID NO: 57333 - protein, 25 aa, synthetic construct
  source 1..25: note = Seed: VKLQTVHSIPLTINKEEALQRPVAS
VKLQTVHSIPITIYKIEADQRPVAS

SEQ ID NO: 57334 - protein, 25 aa, synthetic construct
  source 1..25: note = Seed: VKLQTVHSIPLTINKEEALQRPVAS
VKLQTVHSIPITIYKIEAEQRPVAS

SEQ ID NO: 57335 - protein, 25 aa, synthetic construct
  source 1..25: note = Seed: VKLQTVHSIPLTINKEEALQRPVAS
VKLQTVHSIPITIYKIEAFQRPVAS

SEQ ID NO: 57336 - protein, 25 aa, synthetic construct
  source 1..25: note = Seed: VKLQTVHSIPLTINKEEALQRPVAS
VKLQTVHSIPITIYKIEAGQRPVAS

SEQ ID NO: 57337 - protein, 25 aa, synthetic construct
  source 1..25: note = Seed: VKLQTVHSIPLTINKEEALQRPVAS
VKLQTVHSIPITIYKIEAHQRPVAS

SEQ ID NO: 57338 - protein, 25 aa, synthetic construct
  source 1..25: note = Seed: VKLQTVHSIPLTINKEEALQRPVAS
VKLQTVHSIPITIYKIEAIQRPVAS

SEQ ID NO: 57339 - protein, 25 aa, synthetic construct
  source 1..25: note = Seed: VKLQTVHSIPLTINKEEALQRPVAS
VKLQTVHSIPITIYKIEALQRPVAS

SEQ ID NO: 57340 - protein, 25 aa, synthetic construct
  source 1..25: note = Seed: VKLQTVHSIPLTINKEEALQRPVAS
VKLQTVHSIPITIYKIEAMQRPVAS

SEQ ID NO: 57341 - protein, 25 aa, synthetic construct
  source 1..25: note = Seed: VKLQTVHSIPLTINKEEALQRPVAS
VKLQTVHSIPITIYKIEANQRPVAS

SEQ ID NO: 57342 - protein, 25 aa, synthetic construct
  source 1..25: note = Seed: VKLQTVHSIPLTINKEEALQRPVAS
VKLQTVHSIPITIYKIEAPQRPVAS

SEQ ID NO: 57343 - protein, 25 aa, synthetic construct
  source 1..25: note = Seed: VKLQTVHSIPLTINKEEALQRPVAS
VKLQTVHSIPITIYKIEAQQRPVAS

SEQ ID NO: 57344 - protein, 25 aa, synthetic construct
  source 1..25: note = Seed: VKLQTVHSIPLTINKEEALQRPVAS
VKLQTVHSIPITIYKIEARQRPVAS

SEQ ID NO: 57345 - protein, 25 aa, synthetic construct
  source 1..25: note = Seed: VKLQTVHSIPLTINKEEALQRPVAS
VKLQTVHSIPITIYKIEASQRPVAS

SEQ ID NO: 57346 - protein, 25 aa, synthetic construct
  source 1..25: note = Seed: VKLQTVHSIPLTINKEEALQRPVAS
VKLQTVHSIPITIYKIEATQRPVAS

SEQ ID NO: 57347 - protein, 25 aa, synthetic construct
  source 1..25: note = Seed: VKLQTVHSIPLTINKEEALQRPVAS
VKLQTVHSIPITIYKIEAVQRPVAS

SEQ ID NO: 57348 - protein, 25 aa, synthetic construct
  source 1..25: note = Seed: VKLQTVHSIPLTINKEEALQRPVAS
VKLQTVHSIPITIYKIEAYQRPVAS

SEQ ID NO: 57349 - protein, 25 aa, synthetic construct
  source 1..25: note = Seed: VKLQTVHSIPLTINKEEALQRPVAS
VKLQTVHSIPITIYKKEAFQRPVAS

SEQ ID NO: 57350 - protein, 25 aa, synthetic construct
  source 1..25: note = Seed: VKLQTVHSIPLTINKEEALQRPVAS
VKLQTVHSIPITIYKKEAIQRPVAS

SEQ ID NO: 57351 - protein, 25 aa, synthetic construct
  source 1..25: note = Seed: VKLQTVHSIPLTINKEEALQRPVAS
VKLQTVHSIPITIYKKEALQRPVAS

SEQ ID NO: 57352 - protein, 25 aa, synthetic construct
  source 1..25: note = Seed: VKLQTVHSIPLTINKEEALQRPVAS
VKLQTVHSIPITIYKKEAMQRPVAS

SEQ ID NO: 57353 - protein, 25 aa, synthetic construct
  source 1..25: note = Seed: VKLQTVHSIPLTINKEEALQRPVAS
VKLQTVHSIPITIYKKEAVQRPVAS

SEQ ID NO: 57354 - protein, 25 aa, synthetic construct
  source 1..25: note = Seed: VKLQTVHSIPLTINKEEALQRPVAS
VKLQTVHSIPITIYKKEAYQRPVAS

SEQ ID NO: 57355 - protein, 25 aa, synthetic construct
  source 1..25: note = Seed: VKLQTVHSIPLTINKEEALQRPVAS
VKLQTVHSIPITIYKLEAAQRPVAS

SEQ ID NO: 57356 - protein, 25 aa, synthetic construct
  source 1..25: note = Seed: VKLQTVHSIPLTINKEEALQRPVAS
VKLQTVHSIPITIYKLEADQRPVAS

SEQ ID NO: 57357 - protein, 25 aa, synthetic construct
  source 1..25: note = Seed: VKLQTVHSIPLTINKEEALQRPVAS
VKLQTVHSIPITIYKLEAEQRPVAS

SEQ ID NO: 57358 - protein, 25 aa, synthetic construct
  source 1..25: note = Seed: VKLQTVHSIPLTINKEEALQRPVAS
VKLQTVHSIPITIYKLEAFQRPVAS

SEQ ID NO: 57359 - protein, 25 aa, synthetic construct
  source 1..25: note = Seed: VKLQTVHSIPLTINKEEALQRPVAS
VKLQTVHSIPITIYKLEAGQRPVAS

SEQ ID NO: 57360 - protein, 25 aa, synthetic construct
  source 1..25: note = Seed: VKLQTVHSIPLTINKEEALQRPVAS
VKLQTVHSIPITIYKLEAIQRPVAS

SEQ ID NO: 57361 - protein, 25 aa, synthetic construct
  source 1..25: note = Seed: VKLQTVHSIPLTINKEEALQRPVAS
VKLQTVHSIPITIYKLEALQRPVAS

SEQ ID NO: 57362 - protein, 25 aa, synthetic construct
  source 1..25: note = Seed: VKLQTVHSIPLTINKEEALQRPVAS
VKLQTVHSIPITIYKLEAMQRPVAS

SEQ ID NO: 57363 - protein, 25 aa, synthetic construct
  source 1..25: note = Seed: VKLQTVHSIPLTINKEEALQRPVAS
VKLQTVHSIPITIYKLEANQRPVAS

SEQ ID NO: 57364 - protein, 25 aa, synthetic construct
  source 1..25: note = Seed: VKLQTVHSIPLTINKEEALQRPVAS
VKLQTVHSIPITIYKLEAQQRPVAS

SEQ ID NO: 57365 - protein, 25 aa, synthetic construct
  source 1..25: note = Seed: VKLQTVHSIPLTINKEEALQRPVAS
VKLQTVHSIPITIYKLEASQRPVAS

SEQ ID NO: 57366 - protein, 25 aa, synthetic construct
  source 1..25: note = Seed: VKLQTVHSIPLTINKEEALQRPVAS
VKLQTVHSIPITIYKLEATQRPVAS

SEQ ID NO: 57367 - protein, 25 aa, synthetic construct
  source 1..25: note = Seed: VKLQTVHSIPLTINKEEALQRPVAS
VKLQTVHSIPITIYKLEAVQRPVAS

SEQ ID NO: 57368 - protein, 25 aa, synthetic construct
  source 1..25: note = Seed: VKLQTVHSIPLTINKEEALQRPVAS
VKLQTVHSIPITIYKLEAYQRPVAS

SEQ ID NO: 57369 - protein, 25 aa, synthetic construct
  source 1..25: note = Seed: VKLQTVHSIPLTINKEEALQRPVAS
VKLQTVHSIPITIYKMEAAQRPVAS

SEQ ID NO: 57370 - protein, 25 aa, synthetic construct
  source 1..25: note = Seed: VKLQTVHSIPLTINKEEALQRPVAS
VKLQTVHSIPITIYKMEAFQRPVAS

SEQ ID NO: 57371 - protein, 25 aa, synthetic construct
  source 1..25: note = Seed: VKLQTVHSIPLTINKEEALQRPVAS
VKLQTVHSIPITIYKMEAIQRPVAS

SEQ ID NO: 57372 - protein, 25 aa, synthetic construct
  source 1..25: note = Seed: VKLQTVHSIPLTINKEEALQRPVAS
VKLQTVHSIPITIYKMEALQRPVAS

SEQ ID NO: 57373 - protein, 25 aa, synthetic construct
  source 1..25: note = Seed: VKLQTVHSIPLTINKEEALQRPVAS
VKLQTVHSIPITIYKMEAMQRPVAS

SEQ ID NO: 57374 - protein, 25 aa, synthetic construct
  source 1..25: note = Seed: VKLQTVHSIPLTINKEEALQRPVAS
VKLQTVHSIPITIYKMEAQQRPVAS

SEQ ID NO: 57375 - protein, 25 aa, synthetic construct
  source 1..25: note = Seed: VKLQTVHSIPLTINKEEALQRPVAS
VKLQTVHSIPITIYKMEARQRPVAS

SEQ ID NO: 57376 - protein, 25 aa, synthetic construct
  source 1..25: note = Seed: VKLQTVHSIPLTINKEEALQRPVAS
VKLQTVHSIPITIYKMEASQRPVAS

SEQ ID NO: 57377 - protein, 25 aa, synthetic construct
  source 1..25: note = Seed: VKLQTVHSIPLTINKEEALQRPVAS
VKLQTVHSIPITIYKMEATQRPVAS

SEQ ID NO: 57378 - protein, 25 aa, synthetic construct
  source 1..25: note = Seed: VKLQTVHSIPLTINKEEALQRPVAS
VKLQTVHSIPITIYKMEAVQRPVAS

SEQ ID NO: 57379 - protein, 25 aa, synthetic construct
  source 1..25: note = Seed: VKLQTVHSIPLTINKEEALQRPVAS
VKLQTVHSIPITIYKMEAYQRPVAS

SEQ ID NO: 57380 - protein, 25 aa, synthetic construct
  source 1..25: note = Seed: VKLQTVHSIPLTINKEEALQRPVAS
VKLQTVHSIPITIYKNEAAQRPVAS

SEQ ID NO: 57381 - protein, 25 aa, synthetic construct
  source 1..25: note = Seed: VKLQTVHSIPLTINKEEALQRPVAS
VKLQTVHSIPITIYKNEAFQRPVAS

SEQ ID NO: 57382 - protein, 25 aa, synthetic construct
  source 1..25: note = Seed: VKLQTVHSIPLTINKEEALQRPVAS
VKLQTVHSIPITIYKNEAIQRPVAS

SEQ ID NO: 57383 - protein, 25 aa, synthetic construct
  source 1..25: note = Seed: VKLQTVHSIPLTINKEEALQRPVAS
VKLQTVHSIPITIYKNEALQRPVAS

SEQ ID NO: 57384 - protein, 25 aa, synthetic construct
  source 1..25: note = Seed: VKLQTVHSIPLTINKEEALQRPVAS
VKLQTVHSIPITIYKNEAMQRPVAS

SEQ ID NO: 57385 - protein, 25 aa, synthetic construct
  source 1..25: note = Seed: VKLQTVHSIPLTINKEEALQRPVAS
VKLQTVHSIPITIYKNEASQRPVAS

SEQ ID NO: 57386 - protein, 25 aa, synthetic construct
  source 1..25: note = Seed: VKLQTVHSIPLTINKEEALQRPVAS
VKLQTVHSIPITIYKNEATQRPVAS

SEQ ID NO: 57387 - protein, 25 aa, synthetic construct
  source 1..25: note = Seed: VKLQTVHSIPLTINKEEALQRPVAS
VKLQTVHSIPITIYKNEAVQRPVAS

SEQ ID NO: 57388 - protein, 25 aa, synthetic construct
  source 1..25: note = Seed: VKLQTVHSIPLTINKEEALQRPVAS
VKLQTVHSIPITIYKNEAYQRPVAS

SEQ ID NO: 57389 - protein, 25 aa, synthetic construct
  source 1..25: note = Seed: VKLQTVHSIPLTINKEEALQRPVAS
VKLQTVHSIPITIYKPEAAQRPVAS

SEQ ID NO: 57390 - protein, 25 aa, synthetic construct
  source 1..25: note = Seed: VKLQTVHSIPLTINKEEALQRPVAS
VKLQTVHSIPITIYKPEAFQRPVAS

SEQ ID NO: 57391 - protein, 25 aa, synthetic construct
  source 1..25: note = Seed: VKLQTVHSIPLTINKEEALQRPVAS
VKLQTVHSIPITIYKPEAIQRPVAS

SEQ ID NO: 57392 - protein, 25 aa, synthetic construct
  source 1..25: note = Seed: VKLQTVHSIPLTINKEEALQRPVAS
VKLQTVHSIPITIYKPEALQRPVAS

SEQ ID NO: 57393 - protein, 25 aa, synthetic construct
  source 1..25: note = Seed: VKLQTVHSIPLTINKEEALQRPVAS
VKLQTVHSIPITIYKPEAMQRPVAS

SEQ ID NO: 57394 - protein, 25 aa, synthetic construct
  source 1..25: note = Seed: VKLQTVHSIPLTINKEEALQRPVAS
VKLQTVHSIPITIYKPEAVQRPVAS

SEQ ID NO: 57395 - protein, 25 aa, synthetic construct
  source 1..25: note = Seed: VKLQTVHSIPLTINKEEALQRPVAS
VKLQTVHSIPITIYKREAAQRPVAS

SEQ ID NO: 57396 - protein, 25 aa, synthetic construct
  source 1..25: note = Seed: VKLQTVHSIPLTINKEEALQRPVAS
VKLQTVHSIPITIYKREAFQRPVAS

SEQ ID NO: 57397 - protein, 25 aa, synthetic construct
  source 1..25: note = Seed: VKLQTVHSIPLTINKEEALQRPVAS
VKLQTVHSIPITIYKREAHQRPVAS

SEQ ID NO: 57398 - protein, 25 aa, synthetic construct
  source 1..25: note = Seed: VKLQTVHSIPLTINKEEALQRPVAS
VKLQTVHSIPITIYKREAIQRPVAS

SEQ ID NO: 57399 - protein, 25 aa, synthetic construct
  source 1..25: note = Seed: VKLQTVHSIPLTINKEEALQRPVAS
VKLQTVHSIPITIYKREALQRPVAS

SEQ ID NO: 57400 - protein, 25 aa, synthetic construct
  source 1..25: note = Seed: VKLQTVHSIPLTINKEEALQRPVAS
VKLQTVHSIPITIYKREAMQRPVAS

SEQ ID NO: 57401 - protein, 25 aa, synthetic construct
  source 1..25: note = Seed: VKLQTVHSIPLTINKEEALQRPVAS
VKLQTVHSIPITIYKREARQRPVAS

SEQ ID NO: 57402 - protein, 25 aa, synthetic construct
  source 1..25: note = Seed: VKLQTVHSIPLTINKEEALQRPVAS
VKLQTVHSIPITIYKREAVQRPVAS

SEQ ID NO: 57403 - protein, 25 aa, synthetic construct
  source 1..25: note = Seed: VKLQTVHSIPLTINKEEALQRPVAS
VKLQTVHSIPITIYKREAYQRPVAS

SEQ ID NO: 57404 - protein, 25 aa, synthetic construct
  source 1..25: note = Seed: VKLQTVHSIPLTINKEEALQRPVAS
VKLQTVHSIPITIYKSEAAQRPVAS

SEQ ID NO: 57405 - protein, 25 aa, synthetic construct
  source 1..25: note = Seed: VKLQTVHSIPLTINKEEALQRPVAS
VKLQTVHSIPITIYKSEAFQRPVAS

SEQ ID NO: 57406 - protein, 25 aa, synthetic construct
  source 1..25: note = Seed: VKLQTVHSIPLTINKEEALQRPVAS
VKLQTVHSIPITIYKSEAIQRPVAS

SEQ ID NO: 57407 - protein, 25 aa, synthetic construct
  source 1..25: note = Seed: VKLQTVHSIPLTINKEEALQRPVAS
VKLQTVHSIPITIYKSEALQRPVAS

SEQ ID NO: 57408 - protein, 25 aa, synthetic construct
  source 1..25: note = Seed: VKLQTVHSIPLTINKEEALQRPVAS
VKLQTVHSIPITIYKSEAMQRPVAS

SEQ ID NO: 57409 - protein, 25 aa, synthetic construct
  source 1..25: note = Seed: VKLQTVHSIPLTINKEEALQRPVAS
VKLQTVHSIPITIYKSEASQRPVAS

SEQ ID NO: 57410 - protein, 25 aa, synthetic construct
  source 1..25: note = Seed: VKLQTVHSIPLTINKEEALQRPVAS
VKLQTVHSIPITIYKSEAVQRPVAS

SEQ ID NO: 57411 - protein, 25 aa, synthetic construct
  source 1..25: note = Seed: VKLQTVHSIPLTINKEEALQRPVAS
VKLQTVHSIPITIYKSEAYQRPVAS

SEQ ID NO: 57412 - protein, 25 aa, synthetic construct
  source 1..25: note = Seed: VKLQTVHSIPLTINKEEALQRPVAS
VKLQTVHSIPITIYKTEAAQRPVAS

SEQ ID NO: 57413 - protein, 25 aa, synthetic construct
  source 1..25: note = Seed: VKLQTVHSIPLTINKEEALQRPVAS
VKLQTVHSIPITIYKTEAFQRPVAS

SEQ ID NO: 57414 - protein, 25 aa, synthetic construct
  source 1..25: note = Seed: VKLQTVHSIPLTINKEEALQRPVAS
VKLQTVHSIPITIYKTEAIQRPVAS

SEQ ID NO: 57415 - protein, 25 aa, synthetic construct
  source 1..25: note = Seed: VKLQTVHSIPLTINKEEALQRPVAS
VKLQTVHSIPITIYKTEALQRPVAS

SEQ ID NO: 57416 - protein, 25 aa, synthetic construct
  source 1..25: note = Seed: VKLQTVHSIPLTINKEEALQRPVAS
VKLQTVHSIPITIYKTEAMQRPVAS

SEQ ID NO: 57417 - protein, 25 aa, synthetic construct
  source 1..25: note = Seed: VKLQTVHSIPLTINKEEALQRPVAS
VKLQTVHSIPITIYKTEASQRPVAS

SEQ ID NO: 57418 - protein, 25 aa, synthetic construct
  source 1..25: note = Seed: VKLQTVHSIPLTINKEEALQRPVAS
VKLQTVHSIPITIYKTEAVQRPVAS

SEQ ID NO: 57419 - protein, 25 aa, synthetic construct
  source 1..25: note = Seed: VKLQTVHSIPLTINKEEALQRPVAS
VKLQTVHSIPITIYKTEAYQRPVAS

SEQ ID NO: 57420 - protein, 25 aa, synthetic construct
  source 1..25: note = Seed: VKLQTVHSIPLTINKEEALQRPVAS
VKLQTVHSIPITIYKVEAAQRPVAS

SEQ ID NO: 57421 - protein, 25 aa, synthetic construct
  source 1..25: note = Seed: VKLQTVHSIPLTINKEEALQRPVAS
VKLQTVHSIPITIYKVEACQRPVAS

SEQ ID NO: 57422 - protein, 25 aa, synthetic construct
  source 1..25: note = Seed: VKLQTVHSIPLTINKEEALQRPVAS
VKLQTVHSIPITIYKVEADQRPVAS

SEQ ID NO: 57423 - protein, 25 aa, synthetic construct
  source 1..25: note = Seed: VKLQTVHSIPLTINKEEALQRPVAS
VKLQTVHSIPITIYKVEAEQRPVAS

SEQ ID NO: 57424 - protein, 25 aa, synthetic construct
  source 1..25: note = Seed: VKLQTVHSIPLTINKEEALQRPVAS
VKLQTVHSIPITIYKVEAFQRPVAS

SEQ ID NO: 57425 - protein, 25 aa, synthetic construct
  source 1..25: note = Seed: VKLQTVHSIPLTINKEEALQRPVAS
VKLQTVHSIPITIYKVEAGQRPVAS

SEQ ID NO: 57426 - protein, 25 aa, synthetic construct
  source 1..25: note = Seed: VKLQTVHSIPLTINKEEALQRPVAS
VKLQTVHSIPITIYKVEAHQRPVAS

SEQ ID NO: 57427 - protein, 25 aa, synthetic construct
  source 1..25: note = Seed: VKLQTVHSIPLTINKEEALQRPVAS
VKLQTVHSIPITIYKVEAIQRPVAS

SEQ ID NO: 57428 - protein, 25 aa, synthetic construct
  source 1..25: note = Seed: VKLQTVHSIPLTINKEEALQRPVAS
VKLQTVHSIPITIYKVEALQRPVAS

SEQ ID NO: 57429 - protein, 25 aa, synthetic construct
  source 1..25: note = Seed: VKLQTVHSIPLTINKEEALQRPVAS
VKLQTVHSIPITIYKVEAMQRPVAS

SEQ ID NO: 57430 - protein, 25 aa, synthetic construct
  source 1..25: note = Seed: VKLQTVHSIPLTINKEEALQRPVAS
VKLQTVHSIPITIYKVEANQRPVAS

SEQ ID NO: 57431 - protein, 25 aa, synthetic construct
  source 1..25: note = Seed: VKLQTVHSIPLTINKEEALQRPVAS
VKLQTVHSIPITIYKVEAQQRPVAS

SEQ ID NO: 57432 - protein, 25 aa, synthetic construct
  source 1..25: note = Seed: VKLQTVHSIPLTINKEEALQRPVAS
VKLQTVHSIPITIYKVEARQRPVAS

SEQ ID NO: 57433 - protein, 25 aa, synthetic construct
  source 1..25: note = Seed: VKLQTVHSIPLTINKEEALQRPVAS
VKLQTVHSIPITIYKVEASQRPVAS

SEQ ID NO: 57434 - protein, 25 aa, synthetic construct
  source 1..25: note = Seed: VKLQTVHSIPLTINKEEALQRPVAS
VKLQTVHSIPITIYKVEATQRPVAS

SEQ ID NO: 57435 - protein, 25 aa, synthetic construct
  source 1..25: note = Seed: VKLQTVHSIPLTINKEEALQRPVAS
VKLQTVHSIPITIYKVEAVQRPVAS

SEQ ID NO: 57436 - protein, 25 aa, synthetic construct
  source 1..25: note = Seed: VKLQTVHSIPLTINKEEALQRPVAS
VKLQTVHSIPITIYKVEAYQRPVAS

SEQ ID NO: 57437 - protein, 25 aa, synthetic construct
  source 1..25: note = Seed: VKLQTVHSIPLTINKEEALQRPVAS
VKLQTVHSIPITIYKWEAFQRPVAS

SEQ ID NO: 57438 - protein, 25 aa, synthetic construct
  source 1..25: note = Seed: VKLQTVHSIPLTINKEEALQRPVAS
VKLQTVHSIPITIYKWEAIQRPVAS

SEQ ID NO: 57439 - protein, 25 aa, synthetic construct
  source 1..25: note = Seed: VKLQTVHSIPLTINKEEALQRPVAS
VKLQTVHSIPITIYKWEALQRPVAS

SEQ ID NO: 57440 - protein, 25 aa, synthetic construct
  source 1..25: note = Seed: VKLQTVHSIPLTINKEEALQRPVAS
VKLQTVHSIPITIYKWEAMQRPVAS

SEQ ID NO: 57441 - protein, 25 aa, synthetic construct
  source 1..25: note = Seed: VKLQTVHSIPLTINKEEALQRPVAS
VKLQTVHSIPITIYKWEAVQRPVAS

SEQ ID NO: 57442 - protein, 25 aa, synthetic construct
  source 1..25: note = Seed: VKLQTVHSIPLTINKEEALQRPVAS
VKLQTVHSIPITIYKYEAFQRPVAS

SEQ ID NO: 57443 - protein, 25 aa, synthetic construct
  source 1..25: note = Seed: VKLQTVHSIPLTINKEEALQRPVAS
VKLQTVHSIPITIYKYEAIQRPVAS

SEQ ID NO: 57444 - protein, 25 aa, synthetic construct
  source 1..25: note = Seed: VKLQTVHSIPLTINKEEALQRPVAS
VKLQTVHSIPITIYKYEALQRPVAS

SEQ ID NO: 57445 - protein, 25 aa, synthetic construct
  source 1..25: note = Seed: VKLQTVHSIPLTINKEEALQRPVAS
VKLQTVHSIPITIYKYEAMQRPVAS

SEQ ID NO: 57446 - protein, 25 aa, synthetic construct
  source 1..25: note = Seed: VKLQTVHSIPLTINKEEALQRPVAS
VKLQTVHSIPITIYKYEARQRPVAS

SEQ ID NO: 57447 - protein, 25 aa, synthetic construct
  source 1..25: note = Seed: VKLQTVHSIPLTINKEEALQRPVAS
VKLQTVHSIPITIYKYEAVQRPVAS

SEQ ID NO: 57448 - protein, 25 aa, synthetic construct
  source 1..25: note = Seed: VKLQTVHSIPLTINKEEALQRPVAS
VKLQTVHSIPITIYKYEAYQRPVAS

SEQ ID NO: 57449 - protein, 25 aa, synthetic construct
  source 1..25: note = Seed: VKLQTVHSIPLTINKEEALQRPVAS
VKLQTVHSIPKTIFKFEAIQRPVAS

SEQ ID NO: 57450 - protein, 25 aa, synthetic construct
  source 1..25: note = Seed: VKLQTVHSIPLTINKEEALQRPVAS
VKLQTVHSIPKTIFKFEAVQRPVAS

SEQ ID NO: 57451 - protein, 25 aa, synthetic construct
  source 1..25: note = Seed: VKLQTVHSIPLTINKEEALQRPVAS
VKLQTVHSIPKTIIKFEAIQRPVAS

SEQ ID NO: 57452 - protein, 25 aa, synthetic construct
  source 1..25: note = Seed: VKLQTVHSIPLTINKEEALQRPVAS
VKLQTVHSIPKTIIKFEALQRPVAS

SEQ ID NO: 57453 - protein, 25 aa, synthetic construct
  source 1..25: note = Seed: VKLQTVHSIPLTINKEEALQRPVAS
VKLQTVHSIPKTILKFEALQRPVAS

SEQ ID NO: 57454 - protein, 25 aa, synthetic construct
  source 1..25: note = Seed: VKLQTVHSIPLTINKEEALQRPVAS
VKLQTVHSIPKTIVKFEALQRPVAS

SEQ ID NO: 57455 - protein, 25 aa, synthetic construct
  source 1..25: note = Seed: VKLQTVHSIPLTINKEEALQRPVAS
VKLQTVHSIPLTIAKAEAAQRPVAS

SEQ ID NO: 57456 - protein, 25 aa, synthetic construct
  source 1..25: note = Seed: VKLQTVHSIPLTINKEEALQRPVAS
VKLQTVHSIPLTIAKAEAIQRPVAS

SEQ ID NO: 57457 - protein, 25 aa, synthetic construct
  source 1..25: note = Seed: VKLQTVHSIPLTINKEEALQRPVAS
VKLQTVHSIPLTIAKAEALQRPVAS

SEQ ID NO: 57458 - protein, 25 aa, synthetic construct
  source 1..25: note = Seed: VKLQTVHSIPLTINKEEALQRPVAS
VKLQTVHSIPLTIAKAEAMQRPVAS

SEQ ID NO: 57459 - protein, 25 aa, synthetic construct
  source 1..25: note = Seed: VKLQTVHSIPLTINKEEALQRPVAS
VKLQTVHSIPLTIAKAEAVQRPVAS

SEQ ID NO: 57460 - protein, 25 aa, synthetic construct
  source 1..25: note = Seed: VKLQTVHSIPLTINKEEALQRPVAS
VKLQTVHSIPLTIAKDEAIQRPVAS

SEQ ID NO: 57461 - protein, 25 aa, synthetic construct
  source 1..25: note = Seed: VKLQTVHSIPLTINKEEALQRPVAS
VKLQTVHSIPLTIAKDEALQRPVAS

SEQ ID NO: 57462 - protein, 25 aa, synthetic construct
  source 1..25: note = Seed: VKLQTVHSIPLTINKEEALQRPVAS
VKLQTVHSIPLTIAKDEAVQRPVAS

SEQ ID NO: 57463 - protein, 25 aa, synthetic construct
  source 1..25: note = Seed: VKLQTVHSIPLTINKEEALQRPVAS
VKLQTVHSIPLTIAKFEAAQRPVAS

SEQ ID NO: 57464 - protein, 25 aa, synthetic construct
  source 1..25: note = Seed: VKLQTVHSIPLTINKEEALQRPVAS
VKLQTVHSIPLTIAKFEACQRPVAS

SEQ ID NO: 57465 - protein, 25 aa, synthetic construct
  source 1..25: note = Seed: VKLQTVHSIPLTINKEEALQRPVAS
VKLQTVHSIPLTIAKFEADQRPVAS

SEQ ID NO: 57466 - protein, 25 aa, synthetic construct
  source 1..25: note = Seed: VKLQTVHSIPLTINKEEALQRPVAS
VKLQTVHSIPLTIAKFEAEQRPVAS

SEQ ID NO: 57467 - protein, 25 aa, synthetic construct
  source 1..25: note = Seed: VKLQTVHSIPLTINKEEALQRPVAS
VKLQTVHSIPLTIAKFEAFQRPVAS

SEQ ID NO: 57468 - protein, 25 aa, synthetic construct
  source 1..25: note = Seed: VKLQTVHSIPLTINKEEALQRPVAS
VKLQTVHSIPLTIAKFEAHQRPVAS

SEQ ID NO: 57469 - protein, 25 aa, synthetic construct
  source 1..25: note = Seed: VKLQTVHSIPLTINKEEALQRPVAS
VKLQTVHSIPLTIAKFEAIQRPVAS

SEQ ID NO: 57470 - protein, 25 aa, synthetic construct
  source 1..25: note = Seed: VKLQTVHSIPLTINKEEALQRPVAS
VKLQTVHSIPLTIAKFEALQRPVAS

SEQ ID NO: 57471 - protein, 25 aa, synthetic construct
  source 1..25: note = Seed: VKLQTVHSIPLTINKEEALQRPVAS
VKLQTVHSIPLTIAKFEAMQRPVAS

SEQ ID NO: 57472 - protein, 25 aa, synthetic construct
  source 1..25: note = Seed: VKLQTVHSIPLTINKEEALQRPVAS
VKLQTVHSIPLTIAKFEANQRPVAS

SEQ ID NO: 57473 - protein, 25 aa, synthetic construct
  source 1..25: note = Seed: VKLQTVHSIPLTINKEEALQRPVAS
VKLQTVHSIPLTIAKFEAQQRPVAS

SEQ ID NO: 57474 - protein, 25 aa, synthetic construct
  source 1..25: note = Seed: VKLQTVHSIPLTINKEEALQRPVAS
VKLQTVHSIPLTIAKFEASQRPVAS

SEQ ID NO: 57475 - protein, 25 aa, synthetic construct
  source 1..25: note = Seed: VKLQTVHSIPLTINKEEALQRPVAS
VKLQTVHSIPLTIAKFEATQRPVAS

SEQ ID NO: 57476 - protein, 25 aa, synthetic construct
  source 1..25: note = Seed: VKLQTVHSIPLTINKEEALQRPVAS
VKLQTVHSIPLTIAKFEAVQRPVAS

SEQ ID NO: 57477 - protein, 25 aa, synthetic construct
  source 1..25: note = Seed: VKLQTVHSIPLTINKEEALQRPVAS
VKLQTVHSIPLTIAKFEAWQRPVAS

SEQ ID NO: 57478 - protein, 25 aa, synthetic construct
  source 1..25: note = Seed: VKLQTVHSIPLTINKEEALQRPVAS
VKLQTVHSIPLTIAKFEAYQRPVAS

SEQ ID NO: 57479 - protein, 25 aa, synthetic construct
  source 1..25: note = Seed: VKLQTVHSIPLTINKEEALQRPVAS
VKLQTVHSIPLTIAKIEAAQRPVAS

SEQ ID NO: 57480 - protein, 25 aa, synthetic construct
  source 1..25: note = Seed: VKLQTVHSIPLTINKEEALQRPVAS
VKLQTVHSIPLTIAKIEAFQRPVAS

SEQ ID NO: 57481 - protein, 25 aa, synthetic construct
  source 1..25: note = Seed: VKLQTVHSIPLTINKEEALQRPVAS
VKLQTVHSIPLTIAKIEAIQRPVAS

SEQ ID NO: 57482 - protein, 25 aa, synthetic construct
  source 1..25: note = Seed: VKLQTVHSIPLTINKEEALQRPVAS
VKLQTVHSIPLTIAKIEALQRPVAS

SEQ ID NO: 57483 - protein, 25 aa, synthetic construct
  source 1..25: note = Seed: VKLQTVHSIPLTINKEEALQRPVAS
VKLQTVHSIPLTIAKIEAMQRPVAS

SEQ ID NO: 57484 - protein, 25 aa, synthetic construct
  source 1..25: note = Seed: VKLQTVHSIPLTINKEEALQRPVAS
VKLQTVHSIPLTIAKIEASQRPVAS

SEQ ID NO: 57485 - protein, 25 aa, synthetic construct
  source 1..25: note = Seed: VKLQTVHSIPLTINKEEALQRPVAS
VKLQTVHSIPLTIAKIEAVQRPVAS

SEQ ID NO: 57486 - protein, 25 aa, synthetic construct
  source 1..25: note = Seed: VKLQTVHSIPLTINKEEALQRPVAS
VKLQTVHSIPLTIAKIEAYQRPVAS

SEQ ID NO: 57487 - protein, 25 aa, synthetic construct
  source 1..25: note = Seed: VKLQTVHSIPLTINKEEALQRPVAS
VKLQTVHSIPLTIAKLEAAQRPVAS

SEQ ID NO: 57488 - protein, 25 aa, synthetic construct
  source 1..25: note = Seed: VKLQTVHSIPLTINKEEALQRPVAS
VKLQTVHSIPLTIAKLEAFQRPVAS

SEQ ID NO: 57489 - protein, 25 aa, synthetic construct
  source 1..25: note = Seed: VKLQTVHSIPLTINKEEALQRPVAS
VKLQTVHSIPLTIAKLEAIQRPVAS

SEQ ID NO: 57490 - protein, 25 aa, synthetic construct
  source 1..25: note = Seed: VKLQTVHSIPLTINKEEALQRPVAS
VKLQTVHSIPLTIAKLEALQRPVAS

SEQ ID NO: 57491 - protein, 25 aa, synthetic construct
  source 1..25: note = Seed: VKLQTVHSIPLTINKEEALQRPVAS
VKLQTVHSIPLTIAKLEAMQRPVAS

SEQ ID NO: 57492 - protein, 25 aa, synthetic construct
  source 1..25: note = Seed: VKLQTVHSIPLTINKEEALQRPVAS
VKLQTVHSIPLTIAKLEAVQRPVAS

SEQ ID NO: 57493 - protein, 25 aa, synthetic construct
  source 1..25: note = Seed: VKLQTVHSIPLTINKEEALQRPVAS
VKLQTVHSIPLTIAKMEAAQRPVAS

SEQ ID NO: 57494 - protein, 25 aa, synthetic construct
  source 1..25: note = Seed: VKLQTVHSIPLTINKEEALQRPVAS
VKLQTVHSIPLTIAKMEAIQRPVAS

SEQ ID NO: 57495 - protein, 25 aa, synthetic construct
  source 1..25: note = Seed: VKLQTVHSIPLTINKEEALQRPVAS
VKLQTVHSIPLTIAKMEAVQRPVAS

SEQ ID NO: 57496 - protein, 25 aa, synthetic construct
  source 1..25: note = Seed: VKLQTVHSIPLTINKEEALQRPVAS
VKLQTVHSIPLTIAKNEAIQRPVAS

SEQ ID NO: 57497 - protein, 25 aa, synthetic construct
  source 1..25: note = Seed: VKLQTVHSIPLTINKEEALQRPVAS
VKLQTVHSIPLTIAKNEAVQRPVAS

SEQ ID NO: 57498 - protein, 25 aa, synthetic construct
  source 1..25: note = Seed: VKLQTVHSIPLTINKEEALQRPVAS
VKLQTVHSIPLTIAKREAFQRPVAS

SEQ ID NO: 57499 - protein, 25 aa, synthetic construct
  source 1..25: note = Seed: VKLQTVHSIPLTINKEEALQRPVAS
VKLQTVHSIPLTIAKREALQRPVAS

SEQ ID NO: 57500 - protein, 25 aa, synthetic construct
  source 1..25: note = Seed: VKLQTVHSIPLTINKEEALQRPVAS
VKLQTVHSIPLTIAKREAYQRPVAS

SEQ ID NO: 57501 - protein, 25 aa, synthetic construct
  source 1..25: note = Seed: VKLQTVHSIPLTINKEEALQRPVAS
VKLQTVHSIPLTIAKVEAAQRPVAS

SEQ ID NO: 57502 - protein, 25 aa, synthetic construct
  source 1..25: note = Seed: VKLQTVHSIPLTINKEEALQRPVAS
VKLQTVHSIPLTIAKVEAFQRPVAS

SEQ ID NO: 57503 - protein, 25 aa, synthetic construct
  source 1..25: note = Seed: VKLQTVHSIPLTINKEEALQRPVAS
VKLQTVHSIPLTIAKVEAIQRPVAS

SEQ ID NO: 57504 - protein, 25 aa, synthetic construct
  source 1..25: note = Seed: VKLQTVHSIPLTINKEEALQRPVAS
VKLQTVHSIPLTIAKVEALQRPVAS

SEQ ID NO: 57505 - protein, 25 aa, synthetic construct
  source 1..25: note = Seed: VKLQTVHSIPLTINKEEALQRPVAS
VKLQTVHSIPLTIAKVEAMQRPVAS

SEQ ID NO: 57506 - protein, 25 aa, synthetic construct
  source 1..25: note = Seed: VKLQTVHSIPLTINKEEALQRPVAS
VKLQTVHSIPLTIAKVEASQRPVAS

SEQ ID NO: 57507 - protein, 25 aa, synthetic construct
  source 1..25: note = Seed: VKLQTVHSIPLTINKEEALQRPVAS
VKLQTVHSIPLTIAKVEAVQRPVAS

SEQ ID NO: 57508 - protein, 25 aa, synthetic construct
  source 1..25: note = Seed: VKLQTVHSIPLTINKEEALQRPVAS
VKLQTVHSIPLTIAKWEAFQRPVAS

SEQ ID NO: 57509 - protein, 25 aa, synthetic construct
  source 1..25: note = Seed: VKLQTVHSIPLTINKEEALQRPVAS
VKLQTVHSIPLTIAKWEAIQRPVAS

SEQ ID NO: 57510 - protein, 25 aa, synthetic construct
  source 1..25: note = Seed: VKLQTVHSIPLTINKEEALQRPVAS
VKLQTVHSIPLTIAKWEALQRPVAS

SEQ ID NO: 57511 - protein, 25 aa, synthetic construct
  source 1..25: note = Seed: VKLQTVHSIPLTINKEEALQRPVAS
VKLQTVHSIPLTIAKWEAVQRPVAS

SEQ ID NO: 57512 - protein, 25 aa, synthetic construct
  source 1..25: note = Seed: VKLQTVHSIPLTINKEEALQRPVAS
VKLQTVHSIPLTIAKYEAFQRPVAS

SEQ ID NO: 57513 - protein, 25 aa, synthetic construct
  source 1..25: note = Seed: VKLQTVHSIPLTINKEEALQRPVAS
VKLQTVHSIPLTIAKYEAIQRPVAS

SEQ ID NO: 57514 - protein, 25 aa, synthetic construct
  source 1..25: note = Seed: VKLQTVHSIPLTINKEEALQRPVAS
VKLQTVHSIPLTIAKYEALQRPVAS

SEQ ID NO: 57515 - protein, 25 aa, synthetic construct
  source 1..25: note = Seed: VKLQTVHSIPLTINKEEALQRPVAS
VKLQTVHSIPLTIAKYEAMQRPVAS

SEQ ID NO: 57516 - protein, 25 aa, synthetic construct
  source 1..25: note = Seed: VKLQTVHSIPLTINKEEALQRPVAS
VKLQTVHSIPLTIAKYEAVQRPVAS

SEQ ID NO: 57517 - protein, 25 aa, synthetic construct
  source 1..25: note = Seed: VKLQTVHSIPLTINKEEALQRPVAS
VKLQTVHSIPLTICKFEAFQRPVAS

SEQ ID NO: 57518 - protein, 25 aa, synthetic construct
  source 1..25: note = Seed: VKLQTVHSIPLTINKEEALQRPVAS
VKLQTVHSIPLTICKFEAIQRPVAS

SEQ ID NO: 57519 - protein, 25 aa, synthetic construct
  source 1..25: note = Seed: VKLQTVHSIPLTINKEEALQRPVAS
VKLQTVHSIPLTICKFEALQRPVAS

SEQ ID NO: 57520 - protein, 25 aa, synthetic construct
  source 1..25: note = Seed: VKLQTVHSIPLTINKEEALQRPVAS
VKLQTVHSIPLTICKFEAMQRPVAS

SEQ ID NO: 57521 - protein, 25 aa, synthetic construct
  source 1..25: note = Seed: VKLQTVHSIPLTINKEEALQRPVAS
VKLQTVHSIPLTICKFEAVQRPVAS

SEQ ID NO: 57522 - protein, 25 aa, synthetic construct
  source 1..25: note = Seed: VKLQTVHSIPLTINKEEALQRPVAS
VKLQTVHSIPLTICKYEAFQRPVAS

SEQ ID NO: 57523 - protein, 25 aa, synthetic construct
  source 1..25: note = Seed: VKLQTVHSIPLTINKEEALQRPVAS
VKLQTVHSIPLTIDKFEAFQRPVAS

SEQ ID NO: 57524 - protein, 25 aa, synthetic construct
  source 1..25: note = Seed: VKLQTVHSIPLTINKEEALQRPVAS
VKLQTVHSIPLTIDKFEAIQRPVAS

SEQ ID NO: 57525 - protein, 25 aa, synthetic construct
  source 1..25: note = Seed: VKLQTVHSIPLTINKEEALQRPVAS
VKLQTVHSIPLTIDKFEALQRPVAS

SEQ ID NO: 57526 - protein, 25 aa, synthetic construct
  source 1..25: note = Seed: VKLQTVHSIPLTINKEEALQRPVAS
VKLQTVHSIPLTIDKFEAMQRPVAS

SEQ ID NO: 57527 - protein, 25 aa, synthetic construct
  source 1..25: note = Seed: VKLQTVHSIPLTINKEEALQRPVAS
VKLQTVHSIPLTIDKFEAVQRPVAS

SEQ ID NO: 57528 - protein, 25 aa, synthetic construct
  source 1..25: note = Seed: VKLQTVHSIPLTINKEEALQRPVAS
VKLQTVHSIPLTIEKFEAAQRPVAS

SEQ ID NO: 57529 - protein, 25 aa, synthetic construct
  source 1..25: note = Seed: VKLQTVHSIPLTINKEEALQRPVAS
VKLQTVHSIPLTIEKFEADQRPVAS

SEQ ID NO: 57530 - protein, 25 aa, synthetic construct
  source 1..25: note = Seed: VKLQTVHSIPLTINKEEALQRPVAS
VKLQTVHSIPLTIEKFEAEQRPVAS

SEQ ID NO: 57531 - protein, 25 aa, synthetic construct
  source 1..25: note = Seed: VKLQTVHSIPLTINKEEALQRPVAS
VKLQTVHSIPLTIEKFEAFQRPVAS

SEQ ID NO: 57532 - protein, 25 aa, synthetic construct
  source 1..25: note = Seed: VKLQTVHSIPLTINKEEALQRPVAS
VKLQTVHSIPLTIEKFEAIQRPVAS

SEQ ID NO: 57533 - protein, 25 aa, synthetic construct
  source 1..25: note = Seed: VKLQTVHSIPLTINKEEALQRPVAS
VKLQTVHSIPLTIEKFEALQRPVAS

SEQ ID NO: 57534 - protein, 25 aa, synthetic construct
  source 1..25: note = Seed: VKLQTVHSIPLTINKEEALQRPVAS
VKLQTVHSIPLTIEKFEAMQRPVAS

SEQ ID NO: 57535 - protein, 25 aa, synthetic construct
  source 1..25: note = Seed: VKLQTVHSIPLTINKEEALQRPVAS
VKLQTVHSIPLTIEKFEANQRPVAS

SEQ ID NO: 57536 - protein, 25 aa, synthetic construct
  source 1..25: note = Seed: VKLQTVHSIPLTINKEEALQRPVAS
VKLQTVHSIPLTIEKFEASQRPVAS

SEQ ID NO: 57537 - protein, 25 aa, synthetic construct
  source 1..25: note = Seed: VKLQTVHSIPLTINKEEALQRPVAS
VKLQTVHSIPLTIEKFEATQRPVAS

SEQ ID NO: 57538 - protein, 25 aa, synthetic construct
  source 1..25: note = Seed: VKLQTVHSIPLTINKEEALQRPVAS
VKLQTVHSIPLTIEKFEAVQRPVAS

SEQ ID NO: 57539 - protein, 25 aa, synthetic construct
  source 1..25: note = Seed: VKLQTVHSIPLTINKEEALQRPVAS
VKLQTVHSIPLTIEKFEAWQRPVAS

SEQ ID NO: 57540 - protein, 25 aa, synthetic construct
  source 1..25: note = Seed: VKLQTVHSIPLTINKEEALQRPVAS
VKLQTVHSIPLTIEKFEAYQRPVAS

SEQ ID NO: 57541 - protein, 25 aa, synthetic construct
  source 1..25: note = Seed: VKLQTVHSIPLTINKEEALQRPVAS
VKLQTVHSIPLTIEKIEAFQRPVAS

SEQ ID NO: 57542 - protein, 25 aa, synthetic construct
  source 1..25: note = Seed: VKLQTVHSIPLTINKEEALQRPVAS
VKLQTVHSIPLTIEKIEAIQRPVAS

SEQ ID NO: 57543 - protein, 25 aa, synthetic construct
  source 1..25: note = Seed: VKLQTVHSIPLTINKEEALQRPVAS
VKLQTVHSIPLTIEKIEALQRPVAS

SEQ ID NO: 57544 - protein, 25 aa, synthetic construct
  source 1..25: note = Seed: VKLQTVHSIPLTINKEEALQRPVAS
VKLQTVHSIPLTIEKIEAVQRPVAS

SEQ ID NO: 57545 - protein, 25 aa, synthetic construct
  source 1..25: note = Seed: VKLQTVHSIPLTINKEEALQRPVAS
VKLQTVHSIPLTIEKLEAFQRPVAS

SEQ ID NO: 57546 - protein, 25 aa, synthetic construct
  source 1..25: note = Seed: VKLQTVHSIPLTINKEEALQRPVAS
VKLQTVHSIPLTIEKLEAIQRPVAS

SEQ ID NO: 57547 - protein, 25 aa, synthetic construct
  source 1..25: note = Seed: VKLQTVHSIPLTINKEEALQRPVAS
VKLQTVHSIPLTIEKLEALQRPVAS

SEQ ID NO: 57548 - protein, 25 aa, synthetic construct
  source 1..25: note = Seed: VKLQTVHSIPLTINKEEALQRPVAS
VKLQTVHSIPLTIEKLEAMQRPVAS

SEQ ID NO: 57549 - protein, 25 aa, synthetic construct
  source 1..25: note = Seed: VKLQTVHSIPLTINKEEALQRPVAS
VKLQTVHSIPLTIEKLEAVQRPVAS

SEQ ID NO: 57550 - protein, 25 aa, synthetic construct
  source 1..25: note = Seed: VKLQTVHSIPLTINKEEALQRPVAS
VKLQTVHSIPLTIEKMEAFQRPVAS

SEQ ID NO: 57551 - protein, 25 aa, synthetic construct
  source 1..25: note = Seed: VKLQTVHSIPLTINKEEALQRPVAS
VKLQTVHSIPLTIEKWEAFQRPVAS

SEQ ID NO: 57552 - protein, 25 aa, synthetic construct
  source 1..25: note = Seed: VKLQTVHSIPLTINKEEALQRPVAS
VKLQTVHSIPLTIEKWEAIQRPVAS

SEQ ID NO: 57553 - protein, 25 aa, synthetic construct
  source 1..25: note = Seed: VKLQTVHSIPLTINKEEALQRPVAS
VKLQTVHSIPLTIEKWEALQRPVAS

SEQ ID NO: 57554 - protein, 25 aa, synthetic construct
  source 1..25: note = Seed: VKLQTVHSIPLTINKEEALQRPVAS
VKLQTVHSIPLTIEKWEAVQRPVAS

SEQ ID NO: 57555 - protein, 25 aa, synthetic construct
  source 1..25: note = Seed: VKLQTVHSIPLTINKEEALQRPVAS
VKLQTVHSIPLTIEKYEAFQRPVAS

SEQ ID NO: 57556 - protein, 25 aa, synthetic construct
  source 1..25: note = Seed: VKLQTVHSIPLTINKEEALQRPVAS
VKLQTVHSIPLTIEKYEAIQRPVAS

SEQ ID NO: 57557 - protein, 25 aa, synthetic construct
  source 1..25: note = Seed: VKLQTVHSIPLTINKEEALQRPVAS
VKLQTVHSIPLTIEKYEALQRPVAS

SEQ ID NO: 57558 - protein, 25 aa, synthetic construct
  source 1..25: note = Seed: VKLQTVHSIPLTINKEEALQRPVAS
VKLQTVHSIPLTIEKYEAVQRPVAS

SEQ ID NO: 57559 - protein, 25 aa, synthetic construct
  source 1..25: note = Seed: VKLQTVHSIPLTINKEEALQRPVAS
VKLQTVHSIPLTIFKAEAAQRPVAS

SEQ ID NO: 57560 - protein, 25 aa, synthetic construct
  source 1..25: note = Seed: VKLQTVHSIPLTINKEEALQRPVAS
VKLQTVHSIPLTIFKAEACQRPVAS

SEQ ID NO: 57561 - protein, 25 aa, synthetic construct
  source 1..25: note = Seed: VKLQTVHSIPLTINKEEALQRPVAS
VKLQTVHSIPLTIFKAEAFQRPVAS

SEQ ID NO: 57562 - protein, 25 aa, synthetic construct
  source 1..25: note = Seed: VKLQTVHSIPLTINKEEALQRPVAS
VKLQTVHSIPLTIFKAEAGQRPVAS

SEQ ID NO: 57563 - protein, 25 aa, synthetic construct
  source 1..25: note = Seed: VKLQTVHSIPLTINKEEALQRPVAS
VKLQTVHSIPLTIFKAEAIQRPVAS

SEQ ID NO: 57564 - protein, 25 aa, synthetic construct
  source 1..25: note = Seed: VKLQTVHSIPLTINKEEALQRPVAS
VKLQTVHSIPLTIFKAEALQRPVAS

SEQ ID NO: 57565 - protein, 25 aa, synthetic construct
  source 1..25: note = Seed: VKLQTVHSIPLTINKEEALQRPVAS
VKLQTVHSIPLTIFKAEAMQRPVAS

SEQ ID NO: 57566 - protein, 25 aa, synthetic construct
  source 1..25: note = Seed: VKLQTVHSIPLTINKEEALQRPVAS
VKLQTVHSIPLTIFKAEAQQRPVAS

SEQ ID NO: 57567 - protein, 25 aa, synthetic construct
  source 1..25: note = Seed: VKLQTVHSIPLTINKEEALQRPVAS
VKLQTVHSIPLTIFKAEASQRPVAS

SEQ ID NO: 57568 - protein, 25 aa, synthetic construct
  source 1..25: note = Seed: VKLQTVHSIPLTINKEEALQRPVAS
VKLQTVHSIPLTIFKAEATQRPVAS

SEQ ID NO: 57569 - protein, 25 aa, synthetic construct
  source 1..25: note = Seed: VKLQTVHSIPLTINKEEALQRPVAS
VKLQTVHSIPLTIFKAEAVQRPVAS

SEQ ID NO: 57570 - protein, 25 aa, synthetic construct
  source 1..25: note = Seed: VKLQTVHSIPLTINKEEALQRPVAS
VKLQTVHSIPLTIFKAEAWQRPVAS

SEQ ID NO: 57571 - protein, 25 aa, synthetic construct
  source 1..25: note = Seed: VKLQTVHSIPLTINKEEALQRPVAS
VKLQTVHSIPLTIFKAEAYQRPVAS

SEQ ID NO: 57572 - protein, 25 aa, synthetic construct
  source 1..25: note = Seed: VKLQTVHSIPLTINKEEALQRPVAS
VKLQTVHSIPLTIFKDEAAQRPVAS

SEQ ID NO: 57573 - protein, 25 aa, synthetic construct
  source 1..25: note = Seed: VKLQTVHSIPLTINKEEALQRPVAS
VKLQTVHSIPLTIFKDEACQRPVAS

SEQ ID NO: 57574 - protein, 25 aa, synthetic construct
  source 1..25: note = Seed: VKLQTVHSIPLTINKEEALQRPVAS
VKLQTVHSIPLTIFKDEAFQRPVAS

SEQ ID NO: 57575 - protein, 25 aa, synthetic construct
  source 1..25: note = Seed: VKLQTVHSIPLTINKEEALQRPVAS
VKLQTVHSIPLTIFKDEAGQRPVAS

SEQ ID NO: 57576 - protein, 25 aa, synthetic construct
  source 1..25: note = Seed: VKLQTVHSIPLTINKEEALQRPVAS
VKLQTVHSIPLTIFKDEAIQRPVAS

SEQ ID NO: 57577 - protein, 25 aa, synthetic construct
  source 1..25: note = Seed: VKLQTVHSIPLTINKEEALQRPVAS
VKLQTVHSIPLTIFKDEALQRPVAS

SEQ ID NO: 57578 - protein, 25 aa, synthetic construct
  source 1..25: note = Seed: VKLQTVHSIPLTINKEEALQRPVAS
VKLQTVHSIPLTIFKDEAMQRPVAS

SEQ ID NO: 57579 - protein, 25 aa, synthetic construct
  source 1..25: note = Seed: VKLQTVHSIPLTINKEEALQRPVAS
VKLQTVHSIPLTIFKDEAQQRPVAS

SEQ ID NO: 57580 - protein, 25 aa, synthetic construct
  source 1..25: note = Seed: VKLQTVHSIPLTINKEEALQRPVAS
VKLQTVHSIPLTIFKDEASQRPVAS

SEQ ID NO: 57581 - protein, 25 aa, synthetic construct
  source 1..25: note = Seed: VKLQTVHSIPLTINKEEALQRPVAS
VKLQTVHSIPLTIFKDEATQRPVAS

SEQ ID NO: 57582 - protein, 25 aa, synthetic construct
  source 1..25: note = Seed: VKLQTVHSIPLTINKEEALQRPVAS
VKLQTVHSIPLTIFKDEAVQRPVAS

SEQ ID NO: 57583 - protein, 25 aa, synthetic construct
  source 1..25: note = Seed: VKLQTVHSIPLTINKEEALQRPVAS
VKLQTVHSIPLTIFKDEAYQRPVAS

SEQ ID NO: 57584 - protein, 25 aa, synthetic construct
  source 1..25: note = Seed: VKLQTVHSIPLTINKEEALQRPVAS
VKLQTVHSIPLTIFKEEAFQRPVAS

SEQ ID NO: 57585 - protein, 25 aa, synthetic construct
  source 1..25: note = Seed: VKLQTVHSIPLTINKEEALQRPVAS
VKLQTVHSIPLTIFKEEALQRPVAS

SEQ ID NO: 57586 - protein, 25 aa, synthetic construct
  source 1..25: note = Seed: VKLQTVHSIPLTINKEEALQRPVAS
VKLQTVHSIPLTIFKFEAAQRPVAS

SEQ ID NO: 57587 - protein, 25 aa, synthetic construct
  source 1..25: note = Seed: VKLQTVHSIPLTINKEEALQRPVAS
VKLQTVHSIPLTIFKFEACQRPVAS

SEQ ID NO: 57588 - protein, 25 aa, synthetic construct
  source 1..25: note = Seed: VKLQTVHSIPLTINKEEALQRPVAS
VKLQTVHSIPLTIFKFEADQRPVAS

SEQ ID NO: 57589 - protein, 25 aa, synthetic construct
  source 1..25: note = Seed: VKLQTVHSIPLTINKEEALQRPVAS
VKLQTVHSIPLTIFKFEAEQRPVAS

SEQ ID NO: 57590 - protein, 25 aa, synthetic construct
  source 1..25: note = Seed: VKLQTVHSIPLTINKEEALQRPVAS
VKLQTVHSIPLTIFKFEAFQRPVAS

SEQ ID NO: 57591 - protein, 25 aa, synthetic construct
  source 1..25: note = Seed: VKLQTVHSIPLTINKEEALQRPVAS
VKLQTVHSIPLTIFKFEAGQRPVAS

SEQ ID NO: 57592 - protein, 25 aa, synthetic construct
  source 1..25: note = Seed: VKLQTVHSIPLTINKEEALQRPVAS
VKLQTVHSIPLTIFKFEAHQRPVAS

SEQ ID NO: 57593 - protein, 25 aa, synthetic construct
  source 1..25: note = Seed: VKLQTVHSIPLTINKEEALQRPVAS
VKLQTVHSIPLTIFKFEAIQRPVAS

SEQ ID NO: 57594 - protein, 25 aa, synthetic construct
  source 1..25: note = Seed: VKLQTVHSIPLTINKEEALQRPVAS
VKLQTVHSIPLTIFKFEAKQRPVAS

SEQ ID NO: 57595 - protein, 25 aa, synthetic construct
  source 1..25: note = Seed: VKLQTVHSIPLTINKEEALQRPVAS
VKLQTVHSIPLTIFKFEALQRPVAS

SEQ ID NO: 57596 - protein, 25 aa, synthetic construct
  source 1..25: note = Seed: VKLQTVHSIPLTINKEEALQRPVAS
VKLQTVHSIPLTIFKFEAMQRPVAS

SEQ ID NO: 57597 - protein, 25 aa, synthetic construct
  source 1..25: note = Seed: VKLQTVHSIPLTINKEEALQRPVAS
VKLQTVHSIPLTIFKFEANQRPVAS

SEQ ID NO: 57598 - protein, 25 aa, synthetic construct
  source 1..25: note = Seed: VKLQTVHSIPLTINKEEALQRPVAS
VKLQTVHSIPLTIFKFEAPQRPVAS

SEQ ID NO: 57599 - protein, 25 aa, synthetic construct
  source 1..25: note = Seed: VKLQTVHSIPLTINKEEALQRPVAS
VKLQTVHSIPLTIFKFEAQQRPVAS

SEQ ID NO: 57600 - protein, 25 aa, synthetic construct
  source 1..25: note = Seed: VKLQTVHSIPLTINKEEALQRPVAS
VKLQTVHSIPLTIFKFEARQRPVAS

SEQ ID NO: 57601 - protein, 25 aa, synthetic construct
  source 1..25: note = Seed: VKLQTVHSIPLTINKEEALQRPVAS
VKLQTVHSIPLTIFKFEASQRPVAS

SEQ ID NO: 57602 - protein, 25 aa, synthetic construct
  source 1..25: note = Seed: VKLQTVHSIPLTINKEEALQRPVAS
VKLQTVHSIPLTIFKFEATQRPVAS

SEQ ID NO: 57603 - protein, 25 aa, synthetic construct
  source 1..25: note = Seed: VKLQTVHSIPLTINKEEALQRPVAS
VKLQTVHSIPLTIFKFEAVQRPVAS

SEQ ID NO: 57604 - protein, 25 aa, synthetic construct
  source 1..25: note = Seed: VKLQTVHSIPLTINKEEALQRPVAS
VKLQTVHSIPLTIFKFEAWQRPVAS

SEQ ID NO: 57605 - protein, 25 aa, synthetic construct
  source 1..25: note = Seed: VKLQTVHSIPLTINKEEALQRPVAS
VKLQTVHSIPLTIFKFEAYQRPVAS

SEQ ID NO: 57606 - protein, 25 aa, synthetic construct
  source 1..25: note = Seed: VKLQTVHSIPLTINKEEALQRPVAS
VKLQTVHSIPLTIFKGEAAQRPVAS

SEQ ID NO: 57607 - protein, 25 aa, synthetic construct
  source 1..25: note = Seed: VKLQTVHSIPLTINKEEALQRPVAS
VKLQTVHSIPLTIFKGEAFQRPVAS

SEQ ID NO: 57608 - protein, 25 aa, synthetic construct
  source 1..25: note = Seed: VKLQTVHSIPLTINKEEALQRPVAS
VKLQTVHSIPLTIFKGEAIQRPVAS

SEQ ID NO: 57609 - protein, 25 aa, synthetic construct
  source 1..25: note = Seed: VKLQTVHSIPLTINKEEALQRPVAS
VKLQTVHSIPLTIFKGEALQRPVAS

SEQ ID NO: 57610 - protein, 25 aa, synthetic construct
  source 1..25: note = Seed: VKLQTVHSIPLTINKEEALQRPVAS
VKLQTVHSIPLTIFKGEAVQRPVAS

SEQ ID NO: 57611 - protein, 25 aa, synthetic construct
  source 1..25: note = Seed: VKLQTVHSIPLTINKEEALQRPVAS
VKLQTVHSIPLTIFKHEAFQRPVAS

SEQ ID NO: 57612 - protein, 25 aa, synthetic construct
  source 1..25: note = Seed: VKLQTVHSIPLTINKEEALQRPVAS
VKLQTVHSIPLTIFKHEAIQRPVAS

SEQ ID NO: 57613 - protein, 25 aa, synthetic construct
  source 1..25: note = Seed: VKLQTVHSIPLTINKEEALQRPVAS
VKLQTVHSIPLTIFKHEALQRPVAS

SEQ ID NO: 57614 - protein, 25 aa, synthetic construct
  source 1..25: note = Seed: VKLQTVHSIPLTINKEEALQRPVAS
VKLQTVHSIPLTIFKHEAMQRPVAS

SEQ ID NO: 57615 - protein, 25 aa, synthetic construct
  source 1..25: note = Seed: VKLQTVHSIPLTINKEEALQRPVAS
VKLQTVHSIPLTIFKHEAVQRPVAS

SEQ ID NO: 57616 - protein, 25 aa, synthetic construct
  source 1..25: note = Seed: VKLQTVHSIPLTINKEEALQRPVAS
VKLQTVHSIPLTIFKHEAYQRPVAS

SEQ ID NO: 57617 - protein, 25 aa, synthetic construct
  source 1..25: note = Seed: VKLQTVHSIPLTINKEEALQRPVAS
VKLQTVHSIPLTIFKIEAAQRPVAS

SEQ ID NO: 57618 - protein, 25 aa, synthetic construct
  source 1..25: note = Seed: VKLQTVHSIPLTINKEEALQRPVAS
VKLQTVHSIPLTIFKIEACQRPVAS

SEQ ID NO: 57619 - protein, 25 aa, synthetic construct
  source 1..25: note = Seed: VKLQTVHSIPLTINKEEALQRPVAS
VKLQTVHSIPLTIFKIEADQRPVAS

SEQ ID NO: 57620 - protein, 25 aa, synthetic construct
  source 1..25: note = Seed: VKLQTVHSIPLTINKEEALQRPVAS
VKLQTVHSIPLTIFKIEAEQRPVAS

SEQ ID NO: 57621 - protein, 25 aa, synthetic construct
  source 1..25: note = Seed: VKLQTVHSIPLTINKEEALQRPVAS
VKLQTVHSIPLTIFKIEAFQRPVAS

SEQ ID NO: 57622 - protein, 25 aa, synthetic construct
  source 1..25: note = Seed: VKLQTVHSIPLTINKEEALQRPVAS
VKLQTVHSIPLTIFKIEAGQRPVAS

SEQ ID NO: 57623 - protein, 25 aa, synthetic construct
  source 1..25: note = Seed: VKLQTVHSIPLTINKEEALQRPVAS
VKLQTVHSIPLTIFKIEAHQRPVAS

SEQ ID NO: 57624 - protein, 25 aa, synthetic construct
  source 1..25: note = Seed: VKLQTVHSIPLTINKEEALQRPVAS
VKLQTVHSIPLTIFKIEAIQRPVAS

SEQ ID NO: 57625 - protein, 25 aa, synthetic construct
  source 1..25: note = Seed: VKLQTVHSIPLTINKEEALQRPVAS
VKLQTVHSIPLTIFKIEAKQRPVAS

SEQ ID NO: 57626 - protein, 25 aa, synthetic construct
  source 1..25: note = Seed: VKLQTVHSIPLTINKEEALQRPVAS
VKLQTVHSIPLTIFKIEALQRPVAS

SEQ ID NO: 57627 - protein, 25 aa, synthetic construct
  source 1..25: note = Seed: VKLQTVHSIPLTINKEEALQRPVAS
VKLQTVHSIPLTIFKIEAMQRPVAS

SEQ ID NO: 57628 - protein, 25 aa, synthetic construct
  source 1..25: note = Seed: VKLQTVHSIPLTINKEEALQRPVAS
VKLQTVHSIPLTIFKIEANQRPVAS

SEQ ID NO: 57629 - protein, 25 aa, synthetic construct
  source 1..25: note = Seed: VKLQTVHSIPLTINKEEALQRPVAS
VKLQTVHSIPLTIFKIEAPQRPVAS

SEQ ID NO: 57630 - protein, 25 aa, synthetic construct
  source 1..25: note = Seed: VKLQTVHSIPLTINKEEALQRPVAS
VKLQTVHSIPLTIFKIEAQQRPVAS

SEQ ID NO: 57631 - protein, 25 aa, synthetic construct
  source 1..25: note = Seed: VKLQTVHSIPLTINKEEALQRPVAS
VKLQTVHSIPLTIFKIEARQRPVAS

SEQ ID NO: 57632 - protein, 25 aa, synthetic construct
  source 1..25: note = Seed: VKLQTVHSIPLTINKEEALQRPVAS
VKLQTVHSIPLTIFKIEASQRPVAS

SEQ ID NO: 57633 - protein, 25 aa, synthetic construct
  source 1..25: note = Seed: VKLQTVHSIPLTINKEEALQRPVAS
VKLQTVHSIPLTIFKIEATQRPVAS

SEQ ID NO: 57634 - protein, 25 aa, synthetic construct
  source 1..25: note = Seed: VKLQTVHSIPLTINKEEALQRPVAS
VKLQTVHSIPLTIFKIEAVQRPVAS

SEQ ID NO: 57635 - protein, 25 aa, synthetic construct
  source 1..25: note = Seed: VKLQTVHSIPLTINKEEALQRPVAS
VKLQTVHSIPLTIFKIEAWQRPVAS

SEQ ID NO: 57636 - protein, 25 aa, synthetic construct
  source 1..25: note = Seed: VKLQTVHSIPLTINKEEALQRPVAS
VKLQTVHSIPLTIFKIEAYQRPVAS

SEQ ID NO: 57637 - protein, 25 aa, synthetic construct
  source 1..25: note = Seed: VKLQTVHSIPLTINKEEALQRPVAS
VKLQTVHSIPLTIFKKEAFQRPVAS

SEQ ID NO: 57638 - protein, 25 aa, synthetic construct
  source 1..25: note = Seed: VKLQTVHSIPLTINKEEALQRPVAS
VKLQTVHSIPLTIFKKEAIQRPVAS

SEQ ID NO: 57639 - protein, 25 aa, synthetic construct
  source 1..25: note = Seed: VKLQTVHSIPLTINKEEALQRPVAS
VKLQTVHSIPLTIFKKEALQRPVAS

SEQ ID NO: 57640 - protein, 25 aa, synthetic construct
  source 1..25: note = Seed: VKLQTVHSIPLTINKEEALQRPVAS
VKLQTVHSIPLTIFKKEAMQRPVAS

SEQ ID NO: 57641 - protein, 25 aa, synthetic construct
  source 1..25: note = Seed: VKLQTVHSIPLTINKEEALQRPVAS
VKLQTVHSIPLTIFKKEARQRPVAS

SEQ ID NO: 57642 - protein, 25 aa, synthetic construct
  source 1..25: note = Seed: VKLQTVHSIPLTINKEEALQRPVAS
VKLQTVHSIPLTIFKKEAVQRPVAS

SEQ ID NO: 57643 - protein, 25 aa, synthetic construct
  source 1..25: note = Seed: VKLQTVHSIPLTINKEEALQRPVAS
VKLQTVHSIPLTIFKKEAYQRPVAS

SEQ ID NO: 57644 - protein, 25 aa, synthetic construct
  source 1..25: note = Seed: VKLQTVHSIPLTINKEEALQRPVAS
VKLQTVHSIPLTIFKLEAAQRPVAS

SEQ ID NO: 57645 - protein, 25 aa, synthetic construct
  source 1..25: note = Seed: VKLQTVHSIPLTINKEEALQRPVAS
VKLQTVHSIPLTIFKLEADQRPVAS

SEQ ID NO: 57646 - protein, 25 aa, synthetic construct
  source 1..25: note = Seed: VKLQTVHSIPLTINKEEALQRPVAS
VKLQTVHSIPLTIFKLEAEQRPVAS

SEQ ID NO: 57647 - protein, 25 aa, synthetic construct
  source 1..25: note = Seed: VKLQTVHSIPLTINKEEALQRPVAS
VKLQTVHSIPLTIFKLEAFQRPVAS

SEQ ID NO: 57648 - protein, 25 aa, synthetic construct
  source 1..25: note = Seed: VKLQTVHSIPLTINKEEALQRPVAS
VKLQTVHSIPLTIFKLEAGQRPVAS

SEQ ID NO: 57649 - protein, 25 aa, synthetic construct
  source 1..25: note = Seed: VKLQTVHSIPLTINKEEALQRPVAS
VKLQTVHSIPLTIFKLEAHQRPVAS

SEQ ID NO: 57650 - protein, 25 aa, synthetic construct
  source 1..25: note = Seed: VKLQTVHSIPLTINKEEALQRPVAS
VKLQTVHSIPLTIFKLEAIQRPVAS

SEQ ID NO: 57651 - protein, 25 aa, synthetic construct
  source 1..25: note = Seed: VKLQTVHSIPLTINKEEALQRPVAS
VKLQTVHSIPLTIFKLEAKQRPVAS

SEQ ID NO: 57652 - protein, 25 aa, synthetic construct
  source 1..25: note = Seed: VKLQTVHSIPLTINKEEALQRPVAS
VKLQTVHSIPLTIFKLEALQRPVAS

SEQ ID NO: 57653 - protein, 25 aa, synthetic construct
  source 1..25: note = Seed: VKLQTVHSIPLTINKEEALQRPVAS
VKLQTVHSIPLTIFKLEAMQRPVAS

SEQ ID NO: 57654 - protein, 25 aa, synthetic construct
  source 1..25: note = Seed: VKLQTVHSIPLTINKEEALQRPVAS
VKLQTVHSIPLTIFKLEANQRPVAS

SEQ ID NO: 57655 - protein, 25 aa, synthetic construct
  source 1..25: note = Seed: VKLQTVHSIPLTINKEEALQRPVAS
VKLQTVHSIPLTIFKLEAPQRPVAS

SEQ ID NO: 57656 - protein, 25 aa, synthetic construct
  source 1..25: note = Seed: VKLQTVHSIPLTINKEEALQRPVAS
VKLQTVHSIPLTIFKLEAQQRPVAS

SEQ ID NO: 57657 - protein, 25 aa, synthetic construct
  source 1..25: note = Seed: VKLQTVHSIPLTINKEEALQRPVAS
VKLQTVHSIPLTIFKLEARQRPVAS

SEQ ID NO: 57658 - protein, 25 aa, synthetic construct
  source 1..25: note = Seed: VKLQTVHSIPLTINKEEALQRPVAS
VKLQTVHSIPLTIFKLEASQRPVAS

SEQ ID NO: 57659 - protein, 25 aa, synthetic construct
  source 1..25: note = Seed: VKLQTVHSIPLTINKEEALQRPVAS
VKLQTVHSIPLTIFKLEATQRPVAS

SEQ ID NO: 57660 - protein, 25 aa, synthetic construct
  source 1..25: note = Seed: VKLQTVHSIPLTINKEEALQRPVAS
VKLQTVHSIPLTIFKLEAVQRPVAS

SEQ ID NO: 57661 - protein, 25 aa, synthetic construct
  source 1..25: note = Seed: VKLQTVHSIPLTINKEEALQRPVAS
VKLQTVHSIPLTIFKLEAWQRPVAS

SEQ ID NO: 57662 - protein, 25 aa, synthetic construct
  source 1..25: note = Seed: VKLQTVHSIPLTINKEEALQRPVAS
VKLQTVHSIPLTIFKLEAYQRPVAS

SEQ ID NO: 57663 - protein, 25 aa, synthetic construct
  source 1..25: note = Seed: VKLQTVHSIPLTINKEEALQRPVAS
VKLQTVHSIPLTIFKMEAAQRPVAS

SEQ ID NO: 57664 - protein, 25 aa, synthetic construct
  source 1..25: note = Seed: VKLQTVHSIPLTINKEEALQRPVAS
VKLQTVHSIPLTIFKMEADQRPVAS

SEQ ID NO: 57665 - protein, 25 aa, synthetic construct
  source 1..25: note = Seed: VKLQTVHSIPLTINKEEALQRPVAS
VKLQTVHSIPLTIFKMEAEQRPVAS

SEQ ID NO: 57666 - protein, 25 aa, synthetic construct
  source 1..25: note = Seed: VKLQTVHSIPLTINKEEALQRPVAS
VKLQTVHSIPLTIFKMEAFQRPVAS

SEQ ID NO: 57667 - protein, 25 aa, synthetic construct
  source 1..25: note = Seed: VKLQTVHSIPLTINKEEALQRPVAS
VKLQTVHSIPLTIFKMEAGQRPVAS

SEQ ID NO: 57668 - protein, 25 aa, synthetic construct
  source 1..25: note = Seed: VKLQTVHSIPLTINKEEALQRPVAS
VKLQTVHSIPLTIFKMEAHQRPVAS

SEQ ID NO: 57669 - protein, 25 aa, synthetic construct
  source 1..25: note = Seed: VKLQTVHSIPLTINKEEALQRPVAS
VKLQTVHSIPLTIFKMEAIQRPVAS

SEQ ID NO: 57670 - protein, 25 aa, synthetic construct
  source 1..25: note = Seed: VKLQTVHSIPLTINKEEALQRPVAS
VKLQTVHSIPLTIFKMEALQRPVAS

SEQ ID NO: 57671 - protein, 25 aa, synthetic construct
  source 1..25: note = Seed: VKLQTVHSIPLTINKEEALQRPVAS
VKLQTVHSIPLTIFKMEAMQRPVAS

SEQ ID NO: 57672 - protein, 25 aa, synthetic construct
  source 1..25: note = Seed: VKLQTVHSIPLTINKEEALQRPVAS
VKLQTVHSIPLTIFKMEANQRPVAS

SEQ ID NO: 57673 - protein, 25 aa, synthetic construct
  source 1..25: note = Seed: VKLQTVHSIPLTINKEEALQRPVAS
VKLQTVHSIPLTIFKMEAQQRPVAS

SEQ ID NO: 57674 - protein, 25 aa, synthetic construct
  source 1..25: note = Seed: VKLQTVHSIPLTINKEEALQRPVAS
VKLQTVHSIPLTIFKMEARQRPVAS

SEQ ID NO: 57675 - protein, 25 aa, synthetic construct
  source 1..25: note = Seed: VKLQTVHSIPLTINKEEALQRPVAS
VKLQTVHSIPLTIFKMEASQRPVAS

SEQ ID NO: 57676 - protein, 25 aa, synthetic construct
  source 1..25: note = Seed: VKLQTVHSIPLTINKEEALQRPVAS
VKLQTVHSIPLTIFKMEATQRPVAS

SEQ ID NO: 57677 - protein, 25 aa, synthetic construct
  source 1..25: note = Seed: VKLQTVHSIPLTINKEEALQRPVAS
VKLQTVHSIPLTIFKMEAVQRPVAS

SEQ ID NO: 57678 - protein, 25 aa, synthetic construct
  source 1..25: note = Seed: VKLQTVHSIPLTINKEEALQRPVAS
VKLQTVHSIPLTIFKMEAYQRPVAS

SEQ ID NO: 57679 - protein, 25 aa, synthetic construct
  source 1..25: note = Seed: VKLQTVHSIPLTINKEEALQRPVAS
VKLQTVHSIPLTIFKNEAAQRPVAS

SEQ ID NO: 57680 - protein, 25 aa, synthetic construct
  source 1..25: note = Seed: VKLQTVHSIPLTINKEEALQRPVAS
VKLQTVHSIPLTIFKNEAFQRPVAS

SEQ ID NO: 57681 - protein, 25 aa, synthetic construct
  source 1..25: note = Seed: VKLQTVHSIPLTINKEEALQRPVAS
VKLQTVHSIPLTIFKNEAIQRPVAS

SEQ ID NO: 57682 - protein, 25 aa, synthetic construct
  source 1..25: note = Seed: VKLQTVHSIPLTINKEEALQRPVAS
VKLQTVHSIPLTIFKNEALQRPVAS

SEQ ID NO: 57683 - protein, 25 aa, synthetic construct
  source 1..25: note = Seed: VKLQTVHSIPLTINKEEALQRPVAS
VKLQTVHSIPLTIFKNEAMQRPVAS

SEQ ID NO: 57684 - protein, 25 aa, synthetic construct
  source 1..25: note = Seed: VKLQTVHSIPLTINKEEALQRPVAS
VKLQTVHSIPLTIFKNEASQRPVAS

SEQ ID NO: 57685 - protein, 25 aa, synthetic construct
  source 1..25: note = Seed: VKLQTVHSIPLTINKEEALQRPVAS
VKLQTVHSIPLTIFKNEATQRPVAS

SEQ ID NO: 57686 - protein, 25 aa, synthetic construct
  source 1..25: note = Seed: VKLQTVHSIPLTINKEEALQRPVAS
VKLQTVHSIPLTIFKNEAVQRPVAS

SEQ ID NO: 57687 - protein, 25 aa, synthetic construct
  source 1..25: note = Seed: VKLQTVHSIPLTINKEEALQRPVAS
VKLQTVHSIPLTIFKNEAYQRPVAS

SEQ ID NO: 57688 - protein, 25 aa, synthetic construct
  source 1..25: note = Seed: VKLQTVHSIPLTINKEEALQRPVAS
VKLQTVHSIPLTIFKPEAAQRPVAS

SEQ ID NO: 57689 - protein, 25 aa, synthetic construct
  source 1..25: note = Seed: VKLQTVHSIPLTINKEEALQRPVAS
VKLQTVHSIPLTIFKPEAFQRPVAS

SEQ ID NO: 57690 - protein, 25 aa, synthetic construct
  source 1..25: note = Seed: VKLQTVHSIPLTINKEEALQRPVAS
VKLQTVHSIPLTIFKPEAIQRPVAS

SEQ ID NO: 57691 - protein, 25 aa, synthetic construct
  source 1..25: note = Seed: VKLQTVHSIPLTINKEEALQRPVAS
VKLQTVHSIPLTIFKPEALQRPVAS

SEQ ID NO: 57692 - protein, 25 aa, synthetic construct
  source 1..25: note = Seed: VKLQTVHSIPLTINKEEALQRPVAS
VKLQTVHSIPLTIFKPEAMQRPVAS

SEQ ID NO: 57693 - protein, 25 aa, synthetic construct
  source 1..25: note = Seed: VKLQTVHSIPLTINKEEALQRPVAS
VKLQTVHSIPLTIFKPEAVQRPVAS

SEQ ID NO: 57694 - protein, 25 aa, synthetic construct
  source 1..25: note = Seed: VKLQTVHSIPLTINKEEALQRPVAS
VKLQTVHSIPLTIFKQEAFQRPVAS

SEQ ID NO: 57695 - protein, 25 aa, synthetic construct
  source 1..25: note = Seed: VKLQTVHSIPLTINKEEALQRPVAS
VKLQTVHSIPLTIFKQEAIQRPVAS

SEQ ID NO: 57696 - protein, 25 aa, synthetic construct
  source 1..25: note = Seed: VKLQTVHSIPLTINKEEALQRPVAS
VKLQTVHSIPLTIFKQEALQRPVAS

SEQ ID NO: 57697 - protein, 25 aa, synthetic construct
  source 1..25: note = Seed: VKLQTVHSIPLTINKEEALQRPVAS
VKLQTVHSIPLTIFKREAAQRPVAS

SEQ ID NO: 57698 - protein, 25 aa, synthetic construct
  source 1..25: note = Seed: VKLQTVHSIPLTINKEEALQRPVAS
VKLQTVHSIPLTIFKREAFQRPVAS

SEQ ID NO: 57699 - protein, 25 aa, synthetic construct
  source 1..25: note = Seed: VKLQTVHSIPLTINKEEALQRPVAS
VKLQTVHSIPLTIFKREAHQRPVAS

SEQ ID NO: 57700 - protein, 25 aa, synthetic construct
  source 1..25: note = Seed: VKLQTVHSIPLTINKEEALQRPVAS
VKLQTVHSIPLTIFKREAIQRPVAS

SEQ ID NO: 57701 - protein, 25 aa, synthetic construct
  source 1..25: note = Seed: VKLQTVHSIPLTINKEEALQRPVAS
VKLQTVHSIPLTIFKREAKQRPVAS

SEQ ID NO: 57702 - protein, 25 aa, synthetic construct
  source 1..25: note = Seed: VKLQTVHSIPLTINKEEALQRPVAS
VKLQTVHSIPLTIFKREALQRPVAS

SEQ ID NO: 57703 - protein, 25 aa, synthetic construct
  source 1..25: note = Seed: VKLQTVHSIPLTINKEEALQRPVAS
VKLQTVHSIPLTIFKREAMQRPVAS

SEQ ID NO: 57704 - protein, 25 aa, synthetic construct
  source 1..25: note = Seed: VKLQTVHSIPLTINKEEALQRPVAS
VKLQTVHSIPLTIFKREARQRPVAS

SEQ ID NO: 57705 - protein, 25 aa, synthetic construct
  source 1..25: note = Seed: VKLQTVHSIPLTINKEEALQRPVAS
VKLQTVHSIPLTIFKREAVQRPVAS

SEQ ID NO: 57706 - protein, 25 aa, synthetic construct
  source 1..25: note = Seed: VKLQTVHSIPLTINKEEALQRPVAS
VKLQTVHSIPLTIFKREAYQRPVAS

SEQ ID NO: 57707 - protein, 25 aa, synthetic construct
  source 1..25: note = Seed: VKLQTVHSIPLTINKEEALQRPVAS
VKLQTVHSIPLTIFKSEAAQRPVAS

SEQ ID NO: 57708 - protein, 25 aa, synthetic construct
  source 1..25: note = Seed: VKLQTVHSIPLTINKEEALQRPVAS
VKLQTVHSIPLTIFKSEAFQRPVAS

SEQ ID NO: 57709 - protein, 25 aa, synthetic construct
  source 1..25: note = Seed: VKLQTVHSIPLTINKEEALQRPVAS
VKLQTVHSIPLTIFKSEAIQRPVAS

SEQ ID NO: 57710 - protein, 25 aa, synthetic construct
  source 1..25: note = Seed: VKLQTVHSIPLTINKEEALQRPVAS
VKLQTVHSIPLTIFKSEALQRPVAS

SEQ ID NO: 57711 - protein, 25 aa, synthetic construct
  source 1..25: note = Seed: VKLQTVHSIPLTINKEEALQRPVAS
VKLQTVHSIPLTIFKSEAMQRPVAS

SEQ ID NO: 57712 - protein, 25 aa, synthetic construct
  source 1..25: note = Seed: VKLQTVHSIPLTINKEEALQRPVAS
VKLQTVHSIPLTIFKSEASQRPVAS

SEQ ID NO: 57713 - protein, 25 aa, synthetic construct
  source 1..25: note = Seed: VKLQTVHSIPLTINKEEALQRPVAS
VKLQTVHSIPLTIFKSEAWQRPVAS

SEQ ID NO: 57714 - protein, 25 aa, synthetic construct
  source 1..25: note = Seed: VKLQTVHSIPLTINKEEALQRPVAS
VKLQTVHSIPLTIFKSEAYQRPVAS

SEQ ID NO: 57715 - protein, 25 aa, synthetic construct
  source 1..25: note = Seed: VKLQTVHSIPLTINKEEALQRPVAS
VKLQTVHSIPLTIFKTEAAQRPVAS

SEQ ID NO: 57716 - protein, 25 aa, synthetic construct
  source 1..25: note = Seed: VKLQTVHSIPLTINKEEALQRPVAS
VKLQTVHSIPLTIFKTEAFQRPVAS

SEQ ID NO: 57717 - protein, 25 aa, synthetic construct
  source 1..25: note = Seed: VKLQTVHSIPLTINKEEALQRPVAS
VKLQTVHSIPLTIFKTEAIQRPVAS

SEQ ID NO: 57718 - protein, 25 aa, synthetic construct
  source 1..25: note = Seed: VKLQTVHSIPLTINKEEALQRPVAS
VKLQTVHSIPLTIFKTEALQRPVAS

SEQ ID NO: 57719 - protein, 25 aa, synthetic construct
  source 1..25: note = Seed: VKLQTVHSIPLTINKEEALQRPVAS
VKLQTVHSIPLTIFKTEAMQRPVAS

SEQ ID NO: 57720 - protein, 25 aa, synthetic construct
  source 1..25: note = Seed: VKLQTVHSIPLTINKEEALQRPVAS
VKLQTVHSIPLTIFKTEASQRPVAS

SEQ ID NO: 57721 - protein, 25 aa, synthetic construct
  source 1..25: note = Seed: VKLQTVHSIPLTINKEEALQRPVAS
VKLQTVHSIPLTIFKTEAVQRPVAS

SEQ ID NO: 57722 - protein, 25 aa, synthetic construct
  source 1..25: note = Seed: VKLQTVHSIPLTINKEEALQRPVAS
VKLQTVHSIPLTIFKTEAWQRPVAS

SEQ ID NO: 57723 - protein, 25 aa, synthetic construct
  source 1..25: note = Seed: VKLQTVHSIPLTINKEEALQRPVAS
VKLQTVHSIPLTIFKTEAYQRPVAS

SEQ ID NO: 57724 - protein, 25 aa, synthetic construct
  source 1..25: note = Seed: VKLQTVHSIPLTINKEEALQRPVAS
VKLQTVHSIPLTIFKVEAAQRPVAS

SEQ ID NO: 57725 - protein, 25 aa, synthetic construct
  source 1..25: note = Seed: VKLQTVHSIPLTINKEEALQRPVAS
VKLQTVHSIPLTIFKVEACQRPVAS

SEQ ID NO: 57726 - protein, 25 aa, synthetic construct
  source 1..25: note = Seed: VKLQTVHSIPLTINKEEALQRPVAS
VKLQTVHSIPLTIFKVEADQRPVAS

SEQ ID NO: 57727 - protein, 25 aa, synthetic construct
  source 1..25: note = Seed: VKLQTVHSIPLTINKEEALQRPVAS
VKLQTVHSIPLTIFKVEAEQRPVAS

SEQ ID NO: 57728 - protein, 25 aa, synthetic construct
  source 1..25: note = Seed: VKLQTVHSIPLTINKEEALQRPVAS
VKLQTVHSIPLTIFKVEAFQRPVAS

SEQ ID NO: 57729 - protein, 25 aa, synthetic construct
  source 1..25: note = Seed: VKLQTVHSIPLTINKEEALQRPVAS
VKLQTVHSIPLTIFKVEAGQRPVAS

SEQ ID NO: 57730 - protein, 25 aa, synthetic construct
  source 1..25: note = Seed: VKLQTVHSIPLTINKEEALQRPVAS
VKLQTVHSIPLTIFKVEAHQRPVAS

SEQ ID NO: 57731 - protein, 25 aa, synthetic construct
  source 1..25: note = Seed: VKLQTVHSIPLTINKEEALQRPVAS
VKLQTVHSIPLTIFKVEAIQRPVAS

SEQ ID NO: 57732 - protein, 25 aa, synthetic construct
  source 1..25: note = Seed: VKLQTVHSIPLTINKEEALQRPVAS
VKLQTVHSIPLTIFKVEALQRPVAS

SEQ ID NO: 57733 - protein, 25 aa, synthetic construct
  source 1..25: note = Seed: VKLQTVHSIPLTINKEEALQRPVAS
VKLQTVHSIPLTIFKVEAMQRPVAS

SEQ ID NO: 57734 - protein, 25 aa, synthetic construct
  source 1..25: note = Seed: VKLQTVHSIPLTINKEEALQRPVAS
VKLQTVHSIPLTIFKVEANQRPVAS

SEQ ID NO: 57735 - protein, 25 aa, synthetic construct
  source 1..25: note = Seed: VKLQTVHSIPLTINKEEALQRPVAS
VKLQTVHSIPLTIFKVEAPQRPVAS

SEQ ID NO: 57736 - protein, 25 aa, synthetic construct
  source 1..25: note = Seed: VKLQTVHSIPLTINKEEALQRPVAS
VKLQTVHSIPLTIFKVEAQQRPVAS

SEQ ID NO: 57737 - protein, 25 aa, synthetic construct
  source 1..25: note = Seed: VKLQTVHSIPLTINKEEALQRPVAS
VKLQTVHSIPLTIFKVEARQRPVAS

SEQ ID NO: 57738 - protein, 25 aa, synthetic construct
  source 1..25: note = Seed: VKLQTVHSIPLTINKEEALQRPVAS
VKLQTVHSIPLTIFKVEASQRPVAS

SEQ ID NO: 57739 - protein, 25 aa, synthetic construct
  source 1..25: note = Seed: VKLQTVHSIPLTINKEEALQRPVAS
VKLQTVHSIPLTIFKVEATQRPVAS

SEQ ID NO: 57740 - protein, 25 aa, synthetic construct
  source 1..25: note = Seed: VKLQTVHSIPLTINKEEALQRPVAS
VKLQTVHSIPLTIFKVEAVQRPVAS

SEQ ID NO: 57741 - protein, 25 aa, synthetic construct
  source 1..25: note = Seed: VKLQTVHSIPLTINKEEALQRPVAS
VKLQTVHSIPLTIFKVEAWQRPVAS

SEQ ID NO: 57742 - protein, 25 aa, synthetic construct
  source 1..25: note = Seed: VKLQTVHSIPLTINKEEALQRPVAS
VKLQTVHSIPLTIFKVEAYQRPVAS

SEQ ID NO: 57743 - protein, 25 aa, synthetic construct
  source 1..25: note = Seed: VKLQTVHSIPLTINKEEALQRPVAS
VKLQTVHSIPLTIFKWEAAQRPVAS

SEQ ID NO: 57744 - protein, 25 aa, synthetic construct
  source 1..25: note = Seed: VKLQTVHSIPLTINKEEALQRPVAS
VKLQTVHSIPLTIFKWEAEQRPVAS

SEQ ID NO: 57745 - protein, 25 aa, synthetic construct
  source 1..25: note = Seed: VKLQTVHSIPLTINKEEALQRPVAS
VKLQTVHSIPLTIFKWEAFQRPVAS

SEQ ID NO: 57746 - protein, 25 aa, synthetic construct
  source 1..25: note = Seed: VKLQTVHSIPLTINKEEALQRPVAS
VKLQTVHSIPLTIFKWEAHQRPVAS

SEQ ID NO: 57747 - protein, 25 aa, synthetic construct
  source 1..25: note = Seed: VKLQTVHSIPLTINKEEALQRPVAS
VKLQTVHSIPLTIFKWEAIQRPVAS

SEQ ID NO: 57748 - protein, 25 aa, synthetic construct
  source 1..25: note = Seed: VKLQTVHSIPLTINKEEALQRPVAS
VKLQTVHSIPLTIFKWEALQRPVAS

SEQ ID NO: 57749 - protein, 25 aa, synthetic construct
  source 1..25: note = Seed: VKLQTVHSIPLTINKEEALQRPVAS
VKLQTVHSIPLTIFKWEAMQRPVAS

SEQ ID NO: 57750 - protein, 25 aa, synthetic construct
  source 1..25: note = Seed: VKLQTVHSIPLTINKEEALQRPVAS
VKLQTVHSIPLTIFKWEANQRPVAS

SEQ ID NO: 57751 - protein, 25 aa, synthetic construct
  source 1..25: note = Seed: VKLQTVHSIPLTINKEEALQRPVAS
VKLQTVHSIPLTIFKWEAQQRPVAS

SEQ ID NO: 57752 - protein, 25 aa, synthetic construct
  source 1..25: note = Seed: VKLQTVHSIPLTINKEEALQRPVAS
VKLQTVHSIPLTIFKWEASQRPVAS

SEQ ID NO: 57753 - protein, 25 aa, synthetic construct
  source 1..25: note = Seed: VKLQTVHSIPLTINKEEALQRPVAS
VKLQTVHSIPLTIFKWEATQRPVAS

SEQ ID NO: 57754 - protein, 25 aa, synthetic construct
  source 1..25: note = Seed: VKLQTVHSIPLTINKEEALQRPVAS
VKLQTVHSIPLTIFKWEAVQRPVAS

SEQ ID NO: 57755 - protein, 25 aa, synthetic construct
  source 1..25: note = Seed: VKLQTVHSIPLTINKEEALQRPVAS
VKLQTVHSIPLTIFKWEAWQRPVAS

SEQ ID NO: 57756 - protein, 25 aa, synthetic construct
  source 1..25: note = Seed: VKLQTVHSIPLTINKEEALQRPVAS
VKLQTVHSIPLTIFKWEAYQRPVAS

SEQ ID NO: 57757 - protein, 25 aa, synthetic construct
  source 1..25: note = Seed: VKLQTVHSIPLTINKEEALQRPVAS
VKLQTVHSIPLTIFKYEAAQRPVAS

SEQ ID NO: 57758 - protein, 25 aa, synthetic construct
  source 1..25: note = Seed: VKLQTVHSIPLTINKEEALQRPVAS
VKLQTVHSIPLTIFKYEACQRPVAS

SEQ ID NO: 57759 - protein, 25 aa, synthetic construct
  source 1..25: note = Seed: VKLQTVHSIPLTINKEEALQRPVAS
VKLQTVHSIPLTIFKYEADQRPVAS

SEQ ID NO: 57760 - protein, 25 aa, synthetic construct
  source 1..25: note = Seed: VKLQTVHSIPLTINKEEALQRPVAS
VKLQTVHSIPLTIFKYEAEQRPVAS

SEQ ID NO: 57761 - protein, 25 aa, synthetic construct
  source 1..25: note = Seed: VKLQTVHSIPLTINKEEALQRPVAS
VKLQTVHSIPLTIFKYEAFQRPVAS

SEQ ID NO: 57762 - protein, 25 aa, synthetic construct
  source 1..25: note = Seed: VKLQTVHSIPLTINKEEALQRPVAS
VKLQTVHSIPLTIFKYEAHQRPVAS

SEQ ID NO: 57763 - protein, 25 aa, synthetic construct
  source 1..25: note = Seed: VKLQTVHSIPLTINKEEALQRPVAS
VKLQTVHSIPLTIFKYEAIQRPVAS

SEQ ID NO: 57764 - protein, 25 aa, synthetic construct
  source 1..25: note = Seed: VKLQTVHSIPLTINKEEALQRPVAS
VKLQTVHSIPLTIFKYEAKQRPVAS

SEQ ID NO: 57765 - protein, 25 aa, synthetic construct
  source 1..25: note = Seed: VKLQTVHSIPLTINKEEALQRPVAS
VKLQTVHSIPLTIFKYEALQRPVAS

SEQ ID NO: 57766 - protein, 25 aa, synthetic construct
  source 1..25: note = Seed: VKLQTVHSIPLTINKEEALQRPVAS
VKLQTVHSIPLTIFKYEAMQRPVAS

SEQ ID NO: 57767 - protein, 25 aa, synthetic construct
  source 1..25: note = Seed: VKLQTVHSIPLTINKEEALQRPVAS
VKLQTVHSIPLTIFKYEANQRPVAS

SEQ ID NO: 57768 - protein, 25 aa, synthetic construct
  source 1..25: note = Seed: VKLQTVHSIPLTINKEEALQRPVAS
VKLQTVHSIPLTIFKYEAPQRPVAS

SEQ ID NO: 57769 - protein, 25 aa, synthetic construct
  source 1..25: note = Seed: VKLQTVHSIPLTINKEEALQRPVAS
VKLQTVHSIPLTIFKYEAQQRPVAS

SEQ ID NO: 57770 - protein, 25 aa, synthetic construct
  source 1..25: note = Seed: VKLQTVHSIPLTINKEEALQRPVAS
VKLQTVHSIPLTIFKYEARQRPVAS

SEQ ID NO: 57771 - protein, 25 aa, synthetic construct
  source 1..25: note = Seed: VKLQTVHSIPLTINKEEALQRPVAS
VKLQTVHSIPLTIFKYEASQRPVAS

SEQ ID NO: 57772 - protein, 25 aa, synthetic construct
  source 1..25: note = Seed: VKLQTVHSIPLTINKEEALQRPVAS
VKLQTVHSIPLTIFKYEATQRPVAS

SEQ ID NO: 57773 - protein, 25 aa, synthetic construct
  source 1..25: note = Seed: VKLQTVHSIPLTINKEEALQRPVAS
VKLQTVHSIPLTIFKYEAVQRPVAS

SEQ ID NO: 57774 - protein, 25 aa, synthetic construct
  source 1..25: note = Seed: VKLQTVHSIPLTINKEEALQRPVAS
VKLQTVHSIPLTIFKYEAWQRPVAS

SEQ ID NO: 57775 - protein, 25 aa, synthetic construct
  source 1..25: note = Seed: VKLQTVHSIPLTINKEEALQRPVAS
VKLQTVHSIPLTIFKYEAYQRPVAS

SEQ ID NO: 57776 - protein, 25 aa, synthetic construct
  source 1..25: note = Seed: VKLQTVHSIPLTINKEEALQRPVAS
VKLQTVHSIPLTIGKFEAFQRPVAS

SEQ ID NO: 57777 - protein, 25 aa, synthetic construct
  source 1..25: note = Seed: VKLQTVHSIPLTINKEEALQRPVAS
VKLQTVHSIPLTIGKFEAIQRPVAS

SEQ ID NO: 57778 - protein, 25 aa, synthetic construct
  source 1..25: note = Seed: VKLQTVHSIPLTINKEEALQRPVAS
VKLQTVHSIPLTIGKFEALQRPVAS

SEQ ID NO: 57779 - protein, 25 aa, synthetic construct
  source 1..25: note = Seed: VKLQTVHSIPLTINKEEALQRPVAS
VKLQTVHSIPLTIGKFEAVQRPVAS

SEQ ID NO: 57780 - protein, 25 aa, synthetic construct
  source 1..25: note = Seed: VKLQTVHSIPLTINKEEALQRPVAS
VKLQTVHSIPLTIHKFEAAQRPVAS

SEQ ID NO: 57781 - protein, 25 aa, synthetic construct
  source 1..25: note = Seed: VKLQTVHSIPLTINKEEALQRPVAS
VKLQTVHSIPLTIHKFEACQRPVAS

SEQ ID NO: 57782 - protein, 25 aa, synthetic construct
  source 1..25: note = Seed: VKLQTVHSIPLTINKEEALQRPVAS
VKLQTVHSIPLTIHKFEADQRPVAS

SEQ ID NO: 57783 - protein, 25 aa, synthetic construct
  source 1..25: note = Seed: VKLQTVHSIPLTINKEEALQRPVAS
VKLQTVHSIPLTIHKFEAEQRPVAS

SEQ ID NO: 57784 - protein, 25 aa, synthetic construct
  source 1..25: note = Seed: VKLQTVHSIPLTINKEEALQRPVAS
VKLQTVHSIPLTIHKFEAFQRPVAS

SEQ ID NO: 57785 - protein, 25 aa, synthetic construct
  source 1..25: note = Seed: VKLQTVHSIPLTINKEEALQRPVAS
VKLQTVHSIPLTIHKFEAHQRPVAS

SEQ ID NO: 57786 - protein, 25 aa, synthetic construct
  source 1..25: note = Seed: VKLQTVHSIPLTINKEEALQRPVAS
VKLQTVHSIPLTIHKFEAIQRPVAS

SEQ ID NO: 57787 - protein, 25 aa, synthetic construct
  source 1..25: note = Seed: VKLQTVHSIPLTINKEEALQRPVAS
VKLQTVHSIPLTIHKFEALQRPVAS

SEQ ID NO: 57788 - protein, 25 aa, synthetic construct
  source 1..25: note = Seed: VKLQTVHSIPLTINKEEALQRPVAS
VKLQTVHSIPLTIHKFEAMQRPVAS

SEQ ID NO: 57789 - protein, 25 aa, synthetic construct
  source 1..25: note = Seed: VKLQTVHSIPLTINKEEALQRPVAS
VKLQTVHSIPLTIHKFEANQRPVAS

SEQ ID NO: 57790 - protein, 25 aa, synthetic construct
  source 1..25: note = Seed: VKLQTVHSIPLTINKEEALQRPVAS
VKLQTVHSIPLTIHKFEAQQRPVAS

SEQ ID NO: 57791 - protein, 25 aa, synthetic construct
  source 1..25: note = Seed: VKLQTVHSIPLTINKEEALQRPVAS
VKLQTVHSIPLTIHKFEASQRPVAS

SEQ ID NO: 57792 - protein, 25 aa, synthetic construct
  source 1..25: note = Seed: VKLQTVHSIPLTINKEEALQRPVAS
VKLQTVHSIPLTIHKFEATQRPVAS

SEQ ID NO: 57793 - protein, 25 aa, synthetic construct
  source 1..25: note = Seed: VKLQTVHSIPLTINKEEALQRPVAS
VKLQTVHSIPLTIHKFEAVQRPVAS

SEQ ID NO: 57794 - protein, 25 aa, synthetic construct
  source 1..25: note = Seed: VKLQTVHSIPLTINKEEALQRPVAS
VKLQTVHSIPLTIHKFEAWQRPVAS

SEQ ID NO: 57795 - protein, 25 aa, synthetic construct
  source 1..25: note = Seed: VKLQTVHSIPLTINKEEALQRPVAS
VKLQTVHSIPLTIHKFEAYQRPVAS

SEQ ID NO: 57796 - protein, 25 aa, synthetic construct
  source 1..25: note = Seed: VKLQTVHSIPLTINKEEALQRPVAS
VKLQTVHSIPLTIHKIEAFQRPVAS

SEQ ID NO: 57797 - protein, 25 aa, synthetic construct
  source 1..25: note = Seed: VKLQTVHSIPLTINKEEALQRPVAS
VKLQTVHSIPLTIHKIEAIQRPVAS

SEQ ID NO: 57798 - protein, 25 aa, synthetic construct
  source 1..25: note = Seed: VKLQTVHSIPLTINKEEALQRPVAS
VKLQTVHSIPLTIHKIEALQRPVAS

SEQ ID NO: 57799 - protein, 25 aa, synthetic construct
  source 1..25: note = Seed: VKLQTVHSIPLTINKEEALQRPVAS
VKLQTVHSIPLTIHKIEAMQRPVAS

SEQ ID NO: 57800 - protein, 25 aa, synthetic construct
  source 1..25: note = Seed: VKLQTVHSIPLTINKEEALQRPVAS
VKLQTVHSIPLTIHKIEARQRPVAS

SEQ ID NO: 57801 - protein, 25 aa, synthetic construct
  source 1..25: note = Seed: VKLQTVHSIPLTINKEEALQRPVAS
VKLQTVHSIPLTIHKIEAVQRPVAS

SEQ ID NO: 57802 - protein, 25 aa, synthetic construct
  source 1..25: note = Seed: VKLQTVHSIPLTINKEEALQRPVAS
VKLQTVHSIPLTIHKIEAYQRPVAS

SEQ ID NO: 57803 - protein, 25 aa, synthetic construct
  source 1..25: note = Seed: VKLQTVHSIPLTINKEEALQRPVAS
VKLQTVHSIPLTIHKLEAFQRPVAS

SEQ ID NO: 57804 - protein, 25 aa, synthetic construct
  source 1..25: note = Seed: VKLQTVHSIPLTINKEEALQRPVAS
VKLQTVHSIPLTIHKLEAIQRPVAS

SEQ ID NO: 57805 - protein, 25 aa, synthetic construct
  source 1..25: note = Seed: VKLQTVHSIPLTINKEEALQRPVAS
VKLQTVHSIPLTIHKLEALQRPVAS

SEQ ID NO: 57806 - protein, 25 aa, synthetic construct
  source 1..25: note = Seed: VKLQTVHSIPLTINKEEALQRPVAS
VKLQTVHSIPLTIHKLEAMQRPVAS

SEQ ID NO: 57807 - protein, 25 aa, synthetic construct
  source 1..25: note = Seed: VKLQTVHSIPLTINKEEALQRPVAS
VKLQTVHSIPLTIHKLEAVQRPVAS

SEQ ID NO: 57808 - protein, 25 aa, synthetic construct
  source 1..25: note = Seed: VKLQTVHSIPLTINKEEALQRPVAS
VKLQTVHSIPLTIHKMEAIQRPVAS

SEQ ID NO: 57809 - protein, 25 aa, synthetic construct
  source 1..25: note = Seed: VKLQTVHSIPLTINKEEALQRPVAS
VKLQTVHSIPLTIHKMEALQRPVAS

SEQ ID NO: 57810 - protein, 25 aa, synthetic construct
  source 1..25: note = Seed: VKLQTVHSIPLTINKEEALQRPVAS
VKLQTVHSIPLTIHKNEAIQRPVAS

SEQ ID NO: 57811 - protein, 25 aa, synthetic construct
  source 1..25: note = Seed: VKLQTVHSIPLTINKEEALQRPVAS
VKLQTVHSIPLTIHKNEAVQRPVAS

SEQ ID NO: 57812 - protein, 25 aa, synthetic construct
  source 1..25: note = Seed: VKLQTVHSIPLTINKEEALQRPVAS
VKLQTVHSIPLTIHKREAFQRPVAS

SEQ ID NO: 57813 - protein, 25 aa, synthetic construct
  source 1..25: note = Seed: VKLQTVHSIPLTINKEEALQRPVAS
VKLQTVHSIPLTIHKREALQRPVAS

SEQ ID NO: 57814 - protein, 25 aa, synthetic construct
  source 1..25: note = Seed: VKLQTVHSIPLTINKEEALQRPVAS
VKLQTVHSIPLTIHKREAYQRPVAS

SEQ ID NO: 57815 - protein, 25 aa, synthetic construct
  source 1..25: note = Seed: VKLQTVHSIPLTINKEEALQRPVAS
VKLQTVHSIPLTIHKVEAFQRPVAS

SEQ ID NO: 57816 - protein, 25 aa, synthetic construct
  source 1..25: note = Seed: VKLQTVHSIPLTINKEEALQRPVAS
VKLQTVHSIPLTIHKVEALQRPVAS

SEQ ID NO: 57817 - protein, 25 aa, synthetic construct
  source 1..25: note = Seed: VKLQTVHSIPLTINKEEALQRPVAS
VKLQTVHSIPLTIHKWEAFQRPVAS

SEQ ID NO: 57818 - protein, 25 aa, synthetic construct
  source 1..25: note = Seed: VKLQTVHSIPLTINKEEALQRPVAS
VKLQTVHSIPLTIHKWEAIQRPVAS

SEQ ID NO: 57819 - protein, 25 aa, synthetic construct
  source 1..25: note = Seed: VKLQTVHSIPLTINKEEALQRPVAS
VKLQTVHSIPLTIHKWEALQRPVAS

SEQ ID NO: 57820 - protein, 25 aa, synthetic construct
  source 1..25: note = Seed: VKLQTVHSIPLTINKEEALQRPVAS
VKLQTVHSIPLTIHKWEAVQRPVAS

SEQ ID NO: 57821 - protein, 25 aa, synthetic construct
  source 1..25: note = Seed: VKLQTVHSIPLTINKEEALQRPVAS
VKLQTVHSIPLTIHKYEAFQRPVAS

SEQ ID NO: 57822 - protein, 25 aa, synthetic construct
  source 1..25: note = Seed: VKLQTVHSIPLTINKEEALQRPVAS
VKLQTVHSIPLTIHKYEAIQRPVAS

SEQ ID NO: 57823 - protein, 25 aa, synthetic construct
  source 1..25: note = Seed: VKLQTVHSIPLTINKEEALQRPVAS
VKLQTVHSIPLTIHKYEALQRPVAS

SEQ ID NO: 57824 - protein, 25 aa, synthetic construct
  source 1..25: note = Seed: VKLQTVHSIPLTINKEEALQRPVAS
VKLQTVHSIPLTIHKYEAMQRPVAS

SEQ ID NO: 57825 - protein, 25 aa, synthetic construct
  source 1..25: note = Seed: VKLQTVHSIPLTINKEEALQRPVAS
VKLQTVHSIPLTIHKYEAVQRPVAS

SEQ ID NO: 57826 - protein, 25 aa, synthetic construct
  source 1..25: note = Seed: VKLQTVHSIPLTINKEEALQRPVAS
VKLQTVHSIPLTIIKAEAAQRPVAS

SEQ ID NO: 57827 - protein, 25 aa, synthetic construct
  source 1..25: note = Seed: VKLQTVHSIPLTINKEEALQRPVAS
VKLQTVHSIPLTIIKAEAFQRPVAS

SEQ ID NO: 57828 - protein, 25 aa, synthetic construct
  source 1..25: note = Seed: VKLQTVHSIPLTINKEEALQRPVAS
VKLQTVHSIPLTIIKAEAIQRPVAS

SEQ ID NO: 57829 - protein, 25 aa, synthetic construct
  source 1..25: note = Seed: VKLQTVHSIPLTINKEEALQRPVAS
VKLQTVHSIPLTIIKAEALQRPVAS

SEQ ID NO: 57830 - protein, 25 aa, synthetic construct
  source 1..25: note = Seed: VKLQTVHSIPLTINKEEALQRPVAS
VKLQTVHSIPLTIIKAEAMQRPVAS

SEQ ID NO: 57831 - protein, 25 aa, synthetic construct
  source 1..25: note = Seed: VKLQTVHSIPLTINKEEALQRPVAS
VKLQTVHSIPLTIIKAEARQRPVAS

SEQ ID NO: 57832 - protein, 25 aa, synthetic construct
  source 1..25: note = Seed: VKLQTVHSIPLTINKEEALQRPVAS
VKLQTVHSIPLTIIKAEASQRPVAS

SEQ ID NO: 57833 - protein, 25 aa, synthetic construct
  source 1..25: note = Seed: VKLQTVHSIPLTINKEEALQRPVAS
VKLQTVHSIPLTIIKAEAVQRPVAS

SEQ ID NO: 57834 - protein, 25 aa, synthetic construct
  source 1..25: note = Seed: VKLQTVHSIPLTINKEEALQRPVAS
VKLQTVHSIPLTIIKAEAYQRPVAS

SEQ ID NO: 57835 - protein, 25 aa, synthetic construct
  source 1..25: note = Seed: VKLQTVHSIPLTINKEEALQRPVAS
VKLQTVHSIPLTIIKDEAAQRPVAS

SEQ ID NO: 57836 - protein, 25 aa, synthetic construct
  source 1..25: note = Seed: VKLQTVHSIPLTINKEEALQRPVAS
VKLQTVHSIPLTIIKDEAFQRPVAS

SEQ ID NO: 57837 - protein, 25 aa, synthetic construct
  source 1..25: note = Seed: VKLQTVHSIPLTINKEEALQRPVAS
VKLQTVHSIPLTIIKDEAIQRPVAS

SEQ ID NO: 57838 - protein, 25 aa, synthetic construct
  source 1..25: note = Seed: VKLQTVHSIPLTINKEEALQRPVAS
VKLQTVHSIPLTIIKDEALQRPVAS

SEQ ID NO: 57839 - protein, 25 aa, synthetic construct
  source 1..25: note = Seed: VKLQTVHSIPLTINKEEALQRPVAS
VKLQTVHSIPLTIIKDEAMQRPVAS

SEQ ID NO: 57840 - protein, 25 aa, synthetic construct
  source 1..25: note = Seed: VKLQTVHSIPLTINKEEALQRPVAS
VKLQTVHSIPLTIIKDEAVQRPVAS

SEQ ID NO: 57841 - protein, 25 aa, synthetic construct
  source 1..25: note = Seed: VKLQTVHSIPLTINKEEALQRPVAS
VKLQTVHSIPLTIIKFEAAQRPVAS

SEQ ID NO: 57842 - protein, 25 aa, synthetic construct
  source 1..25: note = Seed: VKLQTVHSIPLTINKEEALQRPVAS
VKLQTVHSIPLTIIKFEACQRPVAS

SEQ ID NO: 57843 - protein, 25 aa, synthetic construct
  source 1..25: note = Seed: VKLQTVHSIPLTINKEEALQRPVAS
VKLQTVHSIPLTIIKFEADQRPVAS

SEQ ID NO: 57844 - protein, 25 aa, synthetic construct
  source 1..25: note = Seed: VKLQTVHSIPLTINKEEALQRPVAS
VKLQTVHSIPLTIIKFEAEQRPVAS

SEQ ID NO: 57845 - protein, 25 aa, synthetic construct
  source 1..25: note = Seed: VKLQTVHSIPLTINKEEALQRPVAS
VKLQTVHSIPLTIIKFEAFQRPVAS

SEQ ID NO: 57846 - protein, 25 aa, synthetic construct
  source 1..25: note = Seed: VKLQTVHSIPLTINKEEALQRPVAS
VKLQTVHSIPLTIIKFEAGQRPVAS

SEQ ID NO: 57847 - protein, 25 aa, synthetic construct
  source 1..25: note = Seed: VKLQTVHSIPLTINKEEALQRPVAS
VKLQTVHSIPLTIIKFEAHQRPVAS

SEQ ID NO: 57848 - protein, 25 aa, synthetic construct
  source 1..25: note = Seed: VKLQTVHSIPLTINKEEALQRPVAS
VKLQTVHSIPLTIIKFEAIQRPVAS

SEQ ID NO: 57849 - protein, 25 aa, synthetic construct
  source 1..25: note = Seed: VKLQTVHSIPLTINKEEALQRPVAS
VKLQTVHSIPLTIIKFEAKQRPVAS

SEQ ID NO: 57850 - protein, 25 aa, synthetic construct
  source 1..25: note = Seed: VKLQTVHSIPLTINKEEALQRPVAS
VKLQTVHSIPLTIIKFEALQRPVAS

SEQ ID NO: 57851 - protein, 25 aa, synthetic construct
  source 1..25: note = Seed: VKLQTVHSIPLTINKEEALQRPVAS
VKLQTVHSIPLTIIKFEAMQRPVAS

SEQ ID NO: 57852 - protein, 25 aa, synthetic construct
  source 1..25: note = Seed: VKLQTVHSIPLTINKEEALQRPVAS
VKLQTVHSIPLTIIKFEANQRPVAS

SEQ ID NO: 57853 - protein, 25 aa, synthetic construct
  source 1..25: note = Seed: VKLQTVHSIPLTINKEEALQRPVAS
VKLQTVHSIPLTIIKFEAPQRPVAS

SEQ ID NO: 57854 - protein, 25 aa, synthetic construct
  source 1..25: note = Seed: VKLQTVHSIPLTINKEEALQRPVAS
VKLQTVHSIPLTIIKFEAQQRPVAS

SEQ ID NO: 57855 - protein, 25 aa, synthetic construct
  source 1..25: note = Seed: VKLQTVHSIPLTINKEEALQRPVAS
VKLQTVHSIPLTIIKFEARQRPVAS

SEQ ID NO: 57856 - protein, 25 aa, synthetic construct
  source 1..25: note = Seed: VKLQTVHSIPLTINKEEALQRPVAS
VKLQTVHSIPLTIIKFEASQRPVAS

SEQ ID NO: 57857 - protein, 25 aa, synthetic construct
  source 1..25: note = Seed: VKLQTVHSIPLTINKEEALQRPVAS
VKLQTVHSIPLTIIKFEATQRPVAS

SEQ ID NO: 57858 - protein, 25 aa, synthetic construct
  source 1..25: note = Seed: VKLQTVHSIPLTINKEEALQRPVAS
VKLQTVHSIPLTIIKFEAVQRPVAS

SEQ ID NO: 57859 - protein, 25 aa, synthetic construct
  source 1..25: note = Seed: VKLQTVHSIPLTINKEEALQRPVAS
VKLQTVHSIPLTIIKFEAWQRPVAS

SEQ ID NO: 57860 - protein, 25 aa, synthetic construct
  source 1..25: note = Seed: VKLQTVHSIPLTINKEEALQRPVAS
VKLQTVHSIPLTIIKFEAYQRPVAS

SEQ ID NO: 57861 - protein, 25 aa, synthetic construct
  source 1..25: note = Seed: VKLQTVHSIPLTINKEEALQRPVAS
VKLQTVHSIPLTIIKGEAVQRPVAS

SEQ ID NO: 57862 - protein, 25 aa, synthetic construct
  source 1..25: note = Seed: VKLQTVHSIPLTINKEEALQRPVAS
VKLQTVHSIPLTIIKHEAFQRPVAS

SEQ ID NO: 57863 - protein, 25 aa, synthetic construct
  source 1..25: note = Seed: VKLQTVHSIPLTINKEEALQRPVAS
VKLQTVHSIPLTIIKHEAIQRPVAS

SEQ ID NO: 57864 - protein, 25 aa, synthetic construct
  source 1..25: note = Seed: VKLQTVHSIPLTINKEEALQRPVAS
VKLQTVHSIPLTIIKHEALQRPVAS

SEQ ID NO: 57865 - protein, 25 aa, synthetic construct
  source 1..25: note = Seed: VKLQTVHSIPLTINKEEALQRPVAS
VKLQTVHSIPLTIIKHEAMQRPVAS

SEQ ID NO: 57866 - protein, 25 aa, synthetic construct
  source 1..25: note = Seed: VKLQTVHSIPLTINKEEALQRPVAS
VKLQTVHSIPLTIIKHEARQRPVAS

SEQ ID NO: 57867 - protein, 25 aa, synthetic construct
  source 1..25: note = Seed: VKLQTVHSIPLTINKEEALQRPVAS
VKLQTVHSIPLTIIKHEAVQRPVAS

SEQ ID NO: 57868 - protein, 25 aa, synthetic construct
  source 1..25: note = Seed: VKLQTVHSIPLTINKEEALQRPVAS
VKLQTVHSIPLTIIKHEAYQRPVAS

SEQ ID NO: 57869 - protein, 25 aa, synthetic construct
  source 1..25: note = Seed: VKLQTVHSIPLTINKEEALQRPVAS
VKLQTVHSIPLTIIKIEAAQRPVAS

SEQ ID NO: 57870 - protein, 25 aa, synthetic construct
  source 1..25: note = Seed: VKLQTVHSIPLTINKEEALQRPVAS
VKLQTVHSIPLTIIKIEADQRPVAS

SEQ ID NO: 57871 - protein, 25 aa, synthetic construct
  source 1..25: note = Seed: VKLQTVHSIPLTINKEEALQRPVAS
VKLQTVHSIPLTIIKIEAEQRPVAS

SEQ ID NO: 57872 - protein, 25 aa, synthetic construct
  source 1..25: note = Seed: VKLQTVHSIPLTINKEEALQRPVAS
VKLQTVHSIPLTIIKIEAFQRPVAS

SEQ ID NO: 57873 - protein, 25 aa, synthetic construct
  source 1..25: note = Seed: VKLQTVHSIPLTINKEEALQRPVAS
VKLQTVHSIPLTIIKIEAGQRPVAS

SEQ ID NO: 57874 - protein, 25 aa, synthetic construct
  source 1..25: note = Seed: VKLQTVHSIPLTINKEEALQRPVAS
VKLQTVHSIPLTIIKIEAIQRPVAS

SEQ ID NO: 57875 - protein, 25 aa, synthetic construct
  source 1..25: note = Seed: VKLQTVHSIPLTINKEEALQRPVAS
VKLQTVHSIPLTIIKIEALQRPVAS

SEQ ID NO: 57876 - protein, 25 aa, synthetic construct
  source 1..25: note = Seed: VKLQTVHSIPLTINKEEALQRPVAS
VKLQTVHSIPLTIIKIEAMQRPVAS

SEQ ID NO: 57877 - protein, 25 aa, synthetic construct
  source 1..25: note = Seed: VKLQTVHSIPLTINKEEALQRPVAS
VKLQTVHSIPLTIIKIEANQRPVAS

SEQ ID NO: 57878 - protein, 25 aa, synthetic construct
  source 1..25: note = Seed: VKLQTVHSIPLTINKEEALQRPVAS
VKLQTVHSIPLTIIKIEAQQRPVAS

SEQ ID NO: 57879 - protein, 25 aa, synthetic construct
  source 1..25: note = Seed: VKLQTVHSIPLTINKEEALQRPVAS
VKLQTVHSIPLTIIKIEARQRPVAS

SEQ ID NO: 57880 - protein, 25 aa, synthetic construct
  source 1..25: note = Seed: VKLQTVHSIPLTINKEEALQRPVAS
VKLQTVHSIPLTIIKIEASQRPVAS

SEQ ID NO: 57881 - protein, 25 aa, synthetic construct
  source 1..25: note = Seed: VKLQTVHSIPLTINKEEALQRPVAS
VKLQTVHSIPLTIIKIEATQRPVAS

SEQ ID NO: 57882 - protein, 25 aa, synthetic construct
  source 1..25: note = Seed: VKLQTVHSIPLTINKEEALQRPVAS
VKLQTVHSIPLTIIKIEAVQRPVAS

SEQ ID NO: 57883 - protein, 25 aa, synthetic construct
  source 1..25: note = Seed: VKLQTVHSIPLTINKEEALQRPVAS
VKLQTVHSIPLTIIKIEAWQRPVAS

SEQ ID NO: 57884 - protein, 25 aa, synthetic construct
  source 1..25: note = Seed: VKLQTVHSIPLTINKEEALQRPVAS
VKLQTVHSIPLTIIKIEAYQRPVAS

SEQ ID NO: 57885 - protein, 25 aa, synthetic construct
  source 1..25: note = Seed: VKLQTVHSIPLTINKEEALQRPVAS
VKLQTVHSIPLTIIKKEAFQRPVAS

SEQ ID NO: 57886 - protein, 25 aa, synthetic construct
  source 1..25: note = Seed: VKLQTVHSIPLTINKEEALQRPVAS
VKLQTVHSIPLTIIKKEAIQRPVAS

SEQ ID NO: 57887 - protein, 25 aa, synthetic construct
  source 1..25: note = Seed: VKLQTVHSIPLTINKEEALQRPVAS
VKLQTVHSIPLTIIKKEALQRPVAS

SEQ ID NO: 57888 - protein, 25 aa, synthetic construct
  source 1..25: note = Seed: VKLQTVHSIPLTINKEEALQRPVAS
VKLQTVHSIPLTIIKKEAMQRPVAS

SEQ ID NO: 57889 - protein, 25 aa, synthetic construct
  source 1..25: note = Seed: VKLQTVHSIPLTINKEEALQRPVAS
VKLQTVHSIPLTIIKKEARQRPVAS

SEQ ID NO: 57890 - protein, 25 aa, synthetic construct
  source 1..25: note = Seed: VKLQTVHSIPLTINKEEALQRPVAS
VKLQTVHSIPLTIIKKEAVQRPVAS

SEQ ID NO: 57891 - protein, 25 aa, synthetic construct
  source 1..25: note = Seed: VKLQTVHSIPLTINKEEALQRPVAS
VKLQTVHSIPLTIIKKEAYQRPVAS

SEQ ID NO: 57892 - protein, 25 aa, synthetic construct
  source 1..25: note = Seed: VKLQTVHSIPLTINKEEALQRPVAS
VKLQTVHSIPLTIIKLEAAQRPVAS

SEQ ID NO: 57893 - protein, 25 aa, synthetic construct
  source 1..25: note = Seed: VKLQTVHSIPLTINKEEALQRPVAS
VKLQTVHSIPLTIIKLEACQRPVAS

SEQ ID NO: 57894 - protein, 25 aa, synthetic construct
  source 1..25: note = Seed: VKLQTVHSIPLTINKEEALQRPVAS
VKLQTVHSIPLTIIKLEADQRPVAS

SEQ ID NO: 57895 - protein, 25 aa, synthetic construct
  source 1..25: note = Seed: VKLQTVHSIPLTINKEEALQRPVAS
VKLQTVHSIPLTIIKLEAEQRPVAS

SEQ ID NO: 57896 - protein, 25 aa, synthetic construct
  source 1..25: note = Seed: VKLQTVHSIPLTINKEEALQRPVAS
VKLQTVHSIPLTIIKLEAFQRPVAS

SEQ ID NO: 57897 - protein, 25 aa, synthetic construct
  source 1..25: note = Seed: VKLQTVHSIPLTINKEEALQRPVAS
VKLQTVHSIPLTIIKLEAGQRPVAS

SEQ ID NO: 57898 - protein, 25 aa, synthetic construct
  source 1..25: note = Seed: VKLQTVHSIPLTINKEEALQRPVAS
VKLQTVHSIPLTIIKLEAHQRPVAS

SEQ ID NO: 57899 - protein, 25 aa, synthetic construct
  source 1..25: note = Seed: VKLQTVHSIPLTINKEEALQRPVAS
VKLQTVHSIPLTIIKLEAIQRPVAS

SEQ ID NO: 57900 - protein, 25 aa, synthetic construct
  source 1..25: note = Seed: VKLQTVHSIPLTINKEEALQRPVAS
VKLQTVHSIPLTIIKLEAKQRPVAS

SEQ ID NO: 57901 - protein, 25 aa, synthetic construct
  source 1..25: note = Seed: VKLQTVHSIPLTINKEEALQRPVAS
VKLQTVHSIPLTIIKLEALQRPVAS

SEQ ID NO: 57902 - protein, 25 aa, synthetic construct
  source 1..25: note = Seed: VKLQTVHSIPLTINKEEALQRPVAS
VKLQTVHSIPLTIIKLEAMQRPVAS

SEQ ID NO: 57903 - protein, 25 aa, synthetic construct
  source 1..25: note = Seed: VKLQTVHSIPLTINKEEALQRPVAS
VKLQTVHSIPLTIIKLEANQRPVAS

SEQ ID NO: 57904 - protein, 25 aa, synthetic construct
  source 1..25: note = Seed: VKLQTVHSIPLTINKEEALQRPVAS
VKLQTVHSIPLTIIKLEAPQRPVAS

SEQ ID NO: 57905 - protein, 25 aa, synthetic construct
  source 1..25: note = Seed: VKLQTVHSIPLTINKEEALQRPVAS
VKLQTVHSIPLTIIKLEAQQRPVAS

SEQ ID NO: 57906 - protein, 25 aa, synthetic construct
  source 1..25: note = Seed: VKLQTVHSIPLTINKEEALQRPVAS
VKLQTVHSIPLTIIKLEARQRPVAS

SEQ ID NO: 57907 - protein, 25 aa, synthetic construct
  source 1..25: note = Seed: VKLQTVHSIPLTINKEEALQRPVAS
VKLQTVHSIPLTIIKLEASQRPVAS

SEQ ID NO: 57908 - protein, 25 aa, synthetic construct
  source 1..25: note = Seed: VKLQTVHSIPLTINKEEALQRPVAS
VKLQTVHSIPLTIIKLEATQRPVAS

SEQ ID NO: 57909 - protein, 25 aa, synthetic construct
  source 1..25: note = Seed: VKLQTVHSIPLTINKEEALQRPVAS
VKLQTVHSIPLTIIKLEAVQRPVAS

SEQ ID NO: 57910 - protein, 25 aa, synthetic construct
  source 1..25: note = Seed: VKLQTVHSIPLTINKEEALQRPVAS
VKLQTVHSIPLTIIKLEAWQRPVAS

SEQ ID NO: 57911 - protein, 25 aa, synthetic construct
  source 1..25: note = Seed: VKLQTVHSIPLTINKEEALQRPVAS
VKLQTVHSIPLTIIKLEAYQRPVAS

SEQ ID NO: 57912 - protein, 25 aa, synthetic construct
  source 1..25: note = Seed: VKLQTVHSIPLTINKEEALQRPVAS
VKLQTVHSIPLTIIKMEAAQRPVAS

SEQ ID NO: 57913 - protein, 25 aa, synthetic construct
  source 1..25: note = Seed: VKLQTVHSIPLTINKEEALQRPVAS
VKLQTVHSIPLTIIKMEADQRPVAS

SEQ ID NO: 57914 - protein, 25 aa, synthetic construct
  source 1..25: note = Seed: VKLQTVHSIPLTINKEEALQRPVAS
VKLQTVHSIPLTIIKMEAEQRPVAS

SEQ ID NO: 57915 - protein, 25 aa, synthetic construct
  source 1..25: note = Seed: VKLQTVHSIPLTINKEEALQRPVAS
VKLQTVHSIPLTIIKMEAFQRPVAS

SEQ ID NO: 57916 - protein, 25 aa, synthetic construct
  source 1..25: note = Seed: VKLQTVHSIPLTINKEEALQRPVAS
VKLQTVHSIPLTIIKMEAIQRPVAS

SEQ ID NO: 57917 - protein, 25 aa, synthetic construct
  source 1..25: note = Seed: VKLQTVHSIPLTINKEEALQRPVAS
VKLQTVHSIPLTIIKMEALQRPVAS

SEQ ID NO: 57918 - protein, 25 aa, synthetic construct
  source 1..25: note = Seed: VKLQTVHSIPLTINKEEALQRPVAS
VKLQTVHSIPLTIIKMEAMQRPVAS

SEQ ID NO: 57919 - protein, 25 aa, synthetic construct
  source 1..25: note = Seed: VKLQTVHSIPLTINKEEALQRPVAS
VKLQTVHSIPLTIIKMEANQRPVAS

SEQ ID NO: 57920 - protein, 25 aa, synthetic construct
  source 1..25: note = Seed: VKLQTVHSIPLTINKEEALQRPVAS
VKLQTVHSIPLTIIKMEAQQRPVAS

SEQ ID NO: 57921 - protein, 25 aa, synthetic construct
  source 1..25: note = Seed: VKLQTVHSIPLTINKEEALQRPVAS
VKLQTVHSIPLTIIKMEARQRPVAS

SEQ ID NO: 57922 - protein, 25 aa, synthetic construct
  source 1..25: note = Seed: VKLQTVHSIPLTINKEEALQRPVAS
VKLQTVHSIPLTIIKMEASQRPVAS

SEQ ID NO: 57923 - protein, 25 aa, synthetic construct
  source 1..25: note = Seed: VKLQTVHSIPLTINKEEALQRPVAS
VKLQTVHSIPLTIIKMEATQRPVAS

SEQ ID NO: 57924 - protein, 25 aa, synthetic construct
  source 1..25: note = Seed: VKLQTVHSIPLTINKEEALQRPVAS
VKLQTVHSIPLTIIKMEAVQRPVAS

SEQ ID NO: 57925 - protein, 25 aa, synthetic construct
  source 1..25: note = Seed: VKLQTVHSIPLTINKEEALQRPVAS
VKLQTVHSIPLTIIKMEAYQRPVAS

SEQ ID NO: 57926 - protein, 25 aa, synthetic construct
  source 1..25: note = Seed: VKLQTVHSIPLTINKEEALQRPVAS
VKLQTVHSIPLTIIKNEAAQRPVAS

SEQ ID NO: 57927 - protein, 25 aa, synthetic construct
  source 1..25: note = Seed: VKLQTVHSIPLTINKEEALQRPVAS
VKLQTVHSIPLTIIKNEAIQRPVAS

SEQ ID NO: 57928 - protein, 25 aa, synthetic construct
  source 1..25: note = Seed: VKLQTVHSIPLTINKEEALQRPVAS
VKLQTVHSIPLTIIKNEALQRPVAS

SEQ ID NO: 57929 - protein, 25 aa, synthetic construct
  source 1..25: note = Seed: VKLQTVHSIPLTINKEEALQRPVAS
VKLQTVHSIPLTIIKNEAVQRPVAS

SEQ ID NO: 57930 - protein, 25 aa, synthetic construct
  source 1..25: note = Seed: VKLQTVHSIPLTINKEEALQRPVAS
VKLQTVHSIPLTIIKNEAYQRPVAS

SEQ ID NO: 57931 - protein, 25 aa, synthetic construct
  source 1..25: note = Seed: VKLQTVHSIPLTINKEEALQRPVAS
VKLQTVHSIPLTIIKPEAIQRPVAS

SEQ ID NO: 57932 - protein, 25 aa, synthetic construct
  source 1..25: note = Seed: VKLQTVHSIPLTINKEEALQRPVAS
VKLQTVHSIPLTIIKPEALQRPVAS

SEQ ID NO: 57933 - protein, 25 aa, synthetic construct
  source 1..25: note = Seed: VKLQTVHSIPLTINKEEALQRPVAS
VKLQTVHSIPLTIIKPEAVQRPVAS

SEQ ID NO: 57934 - protein, 25 aa, synthetic construct
  source 1..25: note = Seed: VKLQTVHSIPLTINKEEALQRPVAS
VKLQTVHSIPLTIIKQEAFQRPVAS

SEQ ID NO: 57935 - protein, 25 aa, synthetic construct
  source 1..25: note = Seed: VKLQTVHSIPLTINKEEALQRPVAS
VKLQTVHSIPLTIIKQEALQRPVAS

SEQ ID NO: 57936 - protein, 25 aa, synthetic construct
  source 1..25: note = Seed: VKLQTVHSIPLTINKEEALQRPVAS
VKLQTVHSIPLTIIKREAAQRPVAS

SEQ ID NO: 57937 - protein, 25 aa, synthetic construct
  source 1..25: note = Seed: VKLQTVHSIPLTINKEEALQRPVAS
VKLQTVHSIPLTIIKREAFQRPVAS

SEQ ID NO: 57938 - protein, 25 aa, synthetic construct
  source 1..25: note = Seed: VKLQTVHSIPLTINKEEALQRPVAS
VKLQTVHSIPLTIIKREAHQRPVAS

SEQ ID NO: 57939 - protein, 25 aa, synthetic construct
  source 1..25: note = Seed: VKLQTVHSIPLTINKEEALQRPVAS
VKLQTVHSIPLTIIKREAIQRPVAS

SEQ ID NO: 57940 - protein, 25 aa, synthetic construct
  source 1..25: note = Seed: VKLQTVHSIPLTINKEEALQRPVAS
VKLQTVHSIPLTIIKREAKQRPVAS

SEQ ID NO: 57941 - protein, 25 aa, synthetic construct
  source 1..25: note = Seed: VKLQTVHSIPLTINKEEALQRPVAS
VKLQTVHSIPLTIIKREALQRPVAS

SEQ ID NO: 57942 - protein, 25 aa, synthetic construct
  source 1..25: note = Seed: VKLQTVHSIPLTINKEEALQRPVAS
VKLQTVHSIPLTIIKREAMQRPVAS

SEQ ID NO: 57943 - protein, 25 aa, synthetic construct
  source 1..25: note = Seed: VKLQTVHSIPLTINKEEALQRPVAS
VKLQTVHSIPLTIIKREARQRPVAS

SEQ ID NO: 57944 - protein, 25 aa, synthetic construct
  source 1..25: note = Seed: VKLQTVHSIPLTINKEEALQRPVAS
VKLQTVHSIPLTIIKREAVQRPVAS

SEQ ID NO: 57945 - protein, 25 aa, synthetic construct
  source 1..25: note = Seed: VKLQTVHSIPLTINKEEALQRPVAS
VKLQTVHSIPLTIIKREAYQRPVAS

SEQ ID NO: 57946 - protein, 25 aa, synthetic construct
  source 1..25: note = Seed: VKLQTVHSIPLTINKEEALQRPVAS
VKLQTVHSIPLTIIKSEAAQRPVAS

SEQ ID NO: 57947 - protein, 25 aa, synthetic construct
  source 1..25: note = Seed: VKLQTVHSIPLTINKEEALQRPVAS
VKLQTVHSIPLTIIKSEAIQRPVAS

SEQ ID NO: 57948 - protein, 25 aa, synthetic construct
  source 1..25: note = Seed: VKLQTVHSIPLTINKEEALQRPVAS
VKLQTVHSIPLTIIKSEALQRPVAS

SEQ ID NO: 57949 - protein, 25 aa, synthetic construct
  source 1..25: note = Seed: VKLQTVHSIPLTINKEEALQRPVAS
VKLQTVHSIPLTIIKSEARQRPVAS

SEQ ID NO: 57950 - protein, 25 aa, synthetic construct
  source 1..25: note = Seed: VKLQTVHSIPLTINKEEALQRPVAS
VKLQTVHSIPLTIIKSEAVQRPVAS

SEQ ID NO: 57951 - protein, 25 aa, synthetic construct
  source 1..25: note = Seed: VKLQTVHSIPLTINKEEALQRPVAS
VKLQTVHSIPLTIIKSEAYQRPVAS

SEQ ID NO: 57952 - protein, 25 aa, synthetic construct
  source 1..25: note = Seed: VKLQTVHSIPLTINKEEALQRPVAS
VKLQTVHSIPLTIIKTEAAQRPVAS

SEQ ID NO: 57953 - protein, 25 aa, synthetic construct
  source 1..25: note = Seed: VKLQTVHSIPLTINKEEALQRPVAS
VKLQTVHSIPLTIIKTEAIQRPVAS

SEQ ID NO: 57954 - protein, 25 aa, synthetic construct
  source 1..25: note = Seed: VKLQTVHSIPLTINKEEALQRPVAS
VKLQTVHSIPLTIIKTEALQRPVAS

SEQ ID NO: 57955 - protein, 25 aa, synthetic construct
  source 1..25: note = Seed: VKLQTVHSIPLTINKEEALQRPVAS
VKLQTVHSIPLTIIKTEAVQRPVAS

SEQ ID NO: 57956 - protein, 25 aa, synthetic construct
  source 1..25: note = Seed: VKLQTVHSIPLTINKEEALQRPVAS
VKLQTVHSIPLTIIKVEAAQRPVAS

SEQ ID NO: 57957 - protein, 25 aa, synthetic construct
  source 1..25: note = Seed: VKLQTVHSIPLTINKEEALQRPVAS
VKLQTVHSIPLTIIKVEADQRPVAS

SEQ ID NO: 57958 - protein, 25 aa, synthetic construct
  source 1..25: note = Seed: VKLQTVHSIPLTINKEEALQRPVAS
VKLQTVHSIPLTIIKVEAEQRPVAS

SEQ ID NO: 57959 - protein, 25 aa, synthetic construct
  source 1..25: note = Seed: VKLQTVHSIPLTINKEEALQRPVAS
VKLQTVHSIPLTIIKVEAFQRPVAS

SEQ ID NO: 57960 - protein, 25 aa, synthetic construct
  source 1..25: note = Seed: VKLQTVHSIPLTINKEEALQRPVAS
VKLQTVHSIPLTIIKVEAIQRPVAS

SEQ ID NO: 57961 - protein, 25 aa, synthetic construct
  source 1..25: note = Seed: VKLQTVHSIPLTINKEEALQRPVAS
VKLQTVHSIPLTIIKVEALQRPVAS

SEQ ID NO: 57962 - protein, 25 aa, synthetic construct
  source 1..25: note = Seed: VKLQTVHSIPLTINKEEALQRPVAS
VKLQTVHSIPLTIIKVEAMQRPVAS

SEQ ID NO: 57963 - protein, 25 aa, synthetic construct
  source 1..25: note = Seed: VKLQTVHSIPLTINKEEALQRPVAS
VKLQTVHSIPLTIIKVEANQRPVAS

SEQ ID NO: 57964 - protein, 25 aa, synthetic construct
  source 1..25: note = Seed: VKLQTVHSIPLTINKEEALQRPVAS
VKLQTVHSIPLTIIKVEAQQRPVAS

SEQ ID NO: 57965 - protein, 25 aa, synthetic construct
  source 1..25: note = Seed: VKLQTVHSIPLTINKEEALQRPVAS
VKLQTVHSIPLTIIKVEARQRPVAS

SEQ ID NO: 57966 - protein, 25 aa, synthetic construct
  source 1..25: note = Seed: VKLQTVHSIPLTINKEEALQRPVAS
VKLQTVHSIPLTIIKVEASQRPVAS

SEQ ID NO: 57967 - protein, 25 aa, synthetic construct
  source 1..25: note = Seed: VKLQTVHSIPLTINKEEALQRPVAS
VKLQTVHSIPLTIIKVEATQRPVAS

SEQ ID NO: 57968 - protein, 25 aa, synthetic construct
  source 1..25: note = Seed: VKLQTVHSIPLTINKEEALQRPVAS
VKLQTVHSIPLTIIKVEAVQRPVAS

SEQ ID NO: 57969 - protein, 25 aa, synthetic construct
  source 1..25: note = Seed: VKLQTVHSIPLTINKEEALQRPVAS
VKLQTVHSIPLTIIKVEAYQRPVAS

SEQ ID NO: 57970 - protein, 25 aa, synthetic construct
  source 1..25: note = Seed: VKLQTVHSIPLTINKEEALQRPVAS
VKLQTVHSIPLTIIKWEAAQRPVAS

SEQ ID NO: 57971 - protein, 25 aa, synthetic construct
  source 1..25: note = Seed: VKLQTVHSIPLTINKEEALQRPVAS
VKLQTVHSIPLTIIKWEACQRPVAS

SEQ ID NO: 57972 - protein, 25 aa, synthetic construct
  source 1..25: note = Seed: VKLQTVHSIPLTINKEEALQRPVAS
VKLQTVHSIPLTIIKWEADQRPVAS

SEQ ID NO: 57973 - protein, 25 aa, synthetic construct
  source 1..25: note = Seed: VKLQTVHSIPLTINKEEALQRPVAS
VKLQTVHSIPLTIIKWEAEQRPVAS

SEQ ID NO: 57974 - protein, 25 aa, synthetic construct
  source 1..25: note = Seed: VKLQTVHSIPLTINKEEALQRPVAS
VKLQTVHSIPLTIIKWEAFQRPVAS

SEQ ID NO: 57975 - protein, 25 aa, synthetic construct
  source 1..25: note = Seed: VKLQTVHSIPLTINKEEALQRPVAS
VKLQTVHSIPLTIIKWEAHQRPVAS

SEQ ID NO: 57976 - protein, 25 aa, synthetic construct
  source 1..25: note = Seed: VKLQTVHSIPLTINKEEALQRPVAS
VKLQTVHSIPLTIIKWEAIQRPVAS

SEQ ID NO: 57977 - protein, 25 aa, synthetic construct
  source 1..25: note = Seed: VKLQTVHSIPLTINKEEALQRPVAS
VKLQTVHSIPLTIIKWEAKQRPVAS

SEQ ID NO: 57978 - protein, 25 aa, synthetic construct
  source 1..25: note = Seed: VKLQTVHSIPLTINKEEALQRPVAS
VKLQTVHSIPLTIIKWEALQRPVAS

SEQ ID NO: 57979 - protein, 25 aa, synthetic construct
  source 1..25: note = Seed: VKLQTVHSIPLTINKEEALQRPVAS
VKLQTVHSIPLTIIKWEAMQRPVAS

SEQ ID NO: 57980 - protein, 25 aa, synthetic construct
  source 1..25: note = Seed: VKLQTVHSIPLTINKEEALQRPVAS
VKLQTVHSIPLTIIKWEANQRPVAS

SEQ ID NO: 57981 - protein, 25 aa, synthetic construct
  source 1..25: note = Seed: VKLQTVHSIPLTINKEEALQRPVAS
VKLQTVHSIPLTIIKWEAPQRPVAS

SEQ ID NO: 57982 - protein, 25 aa, synthetic construct
  source 1..25: note = Seed: VKLQTVHSIPLTINKEEALQRPVAS
VKLQTVHSIPLTIIKWEAQQRPVAS

SEQ ID NO: 57983 - protein, 25 aa, synthetic construct
  source 1..25: note = Seed: VKLQTVHSIPLTINKEEALQRPVAS
VKLQTVHSIPLTIIKWEARQRPVAS

SEQ ID NO: 57984 - protein, 25 aa, synthetic construct
  source 1..25: note = Seed: VKLQTVHSIPLTINKEEALQRPVAS
VKLQTVHSIPLTIIKWEASQRPVAS

SEQ ID NO: 57985 - protein, 25 aa, synthetic construct
  source 1..25: note = Seed: VKLQTVHSIPLTINKEEALQRPVAS
VKLQTVHSIPLTIIKWEATQRPVAS

SEQ ID NO: 57986 - protein, 25 aa, synthetic construct
  source 1..25: note = Seed: VKLQTVHSIPLTINKEEALQRPVAS
VKLQTVHSIPLTIIKWEAVQRPVAS

SEQ ID NO: 57987 - protein, 25 aa, synthetic construct
  source 1..25: note = Seed: VKLQTVHSIPLTINKEEALQRPVAS
VKLQTVHSIPLTIIKWEAYQRPVAS

SEQ ID NO: 57988 - protein, 25 aa, synthetic construct
  source 1..25: note = Seed: VKLQTVHSIPLTINKEEALQRPVAS
VKLQTVHSIPLTIIKYEAAQRPVAS

SEQ ID NO: 57989 - protein, 25 aa, synthetic construct
  source 1..25: note = Seed: VKLQTVHSIPLTINKEEALQRPVAS
VKLQTVHSIPLTIIKYEACQRPVAS

SEQ ID NO: 57990 - protein, 25 aa, synthetic construct
  source 1..25: note = Seed: VKLQTVHSIPLTINKEEALQRPVAS
VKLQTVHSIPLTIIKYEADQRPVAS

SEQ ID NO: 57991 - protein, 25 aa, synthetic construct
  source 1..25: note = Seed: VKLQTVHSIPLTINKEEALQRPVAS
VKLQTVHSIPLTIIKYEAEQRPVAS

SEQ ID NO: 57992 - protein, 25 aa, synthetic construct
  source 1..25: note = Seed: VKLQTVHSIPLTINKEEALQRPVAS
VKLQTVHSIPLTIIKYEAFQRPVAS

SEQ ID NO: 57993 - protein, 25 aa, synthetic construct
  source 1..25: note = Seed: VKLQTVHSIPLTINKEEALQRPVAS
VKLQTVHSIPLTIIKYEAGQRPVAS

SEQ ID NO: 57994 - protein, 25 aa, synthetic construct
  source 1..25: note = Seed: VKLQTVHSIPLTINKEEALQRPVAS
VKLQTVHSIPLTIIKYEAHQRPVAS

SEQ ID NO: 57995 - protein, 25 aa, synthetic construct
  source 1..25: note = Seed: VKLQTVHSIPLTINKEEALQRPVAS
VKLQTVHSIPLTIIKYEAIQRPVAS

SEQ ID NO: 57996 - protein, 25 aa, synthetic construct
  source 1..25: note = Seed: VKLQTVHSIPLTINKEEALQRPVAS
VKLQTVHSIPLTIIKYEAKQRPVAS

SEQ ID NO: 57997 - protein, 25 aa, synthetic construct
  source 1..25: note = Seed: VKLQTVHSIPLTINKEEALQRPVAS
VKLQTVHSIPLTIIKYEALQRPVAS

SEQ ID NO: 57998 - protein, 25 aa, synthetic construct
  source 1..25: note = Seed: VKLQTVHSIPLTINKEEALQRPVAS
VKLQTVHSIPLTIIKYEAMQRPVAS

SEQ ID NO: 57999 - protein, 25 aa, synthetic construct
  source 1..25: note = Seed: VKLQTVHSIPLTINKEEALQRPVAS
VKLQTVHSIPLTIIKYEANQRPVAS

SEQ ID NO: 58000 - protein, 25 aa, synthetic construct
  source 1..25: note = Seed: VKLQTVHSIPLTINKEEALQRPVAS
VKLQTVHSIPLTIIKYEAPQRPVAS

SEQ ID NO: 58001 - protein, 25 aa, synthetic construct
  source 1..25: note = Seed: VKLQTVHSIPLTINKEEALQRPVAS
VKLQTVHSIPLTIIKYEAQQRPVAS

SEQ ID NO: 58002 - protein, 25 aa, synthetic construct
  source 1..25: note = Seed: VKLQTVHSIPLTINKEEALQRPVAS
VKLQTVHSIPLTIIKYEARQRPVAS

SEQ ID NO: 58003 - protein, 25 aa, synthetic construct
  source 1..25: note = Seed: VKLQTVHSIPLTINKEEALQRPVAS
VKLQTVHSIPLTIIKYEASQRPVAS

SEQ ID NO: 58004 - protein, 25 aa, synthetic construct
  source 1..25: note = Seed: VKLQTVHSIPLTINKEEALQRPVAS
VKLQTVHSIPLTIIKYEATQRPVAS

SEQ ID NO: 58005 - protein, 25 aa, synthetic construct
  source 1..25: note = Seed: VKLQTVHSIPLTINKEEALQRPVAS
VKLQTVHSIPLTIIKYEAVQRPVAS

SEQ ID NO: 58006 - protein, 25 aa, synthetic construct
  source 1..25: note = Seed: VKLQTVHSIPLTINKEEALQRPVAS
VKLQTVHSIPLTIIKYEAWQRPVAS

SEQ ID NO: 58007 - protein, 25 aa, synthetic construct
  source 1..25: note = Seed: VKLQTVHSIPLTINKEEALQRPVAS
VKLQTVHSIPLTIIKYEAYQRPVAS

SEQ ID NO: 58008 - protein, 25 aa, synthetic construct
  source 1..25: note = Seed: VKLQTVHSIPLTINKEEALQRPVAS
VKLQTVHSIPLTIKKFEAAQRPVAS

SEQ ID NO: 58009 - protein, 25 aa, synthetic construct
  source 1..25: note = Seed: VKLQTVHSIPLTINKEEALQRPVAS
VKLQTVHSIPLTIKKFEAFQRPVAS

SEQ ID NO: 58010 - protein, 25 aa, synthetic construct
  source 1..25: note = Seed: VKLQTVHSIPLTINKEEALQRPVAS
VKLQTVHSIPLTIKKFEAIQRPVAS

SEQ ID NO: 58011 - protein, 25 aa, synthetic construct
  source 1..25: note = Seed: VKLQTVHSIPLTINKEEALQRPVAS
VKLQTVHSIPLTIKKFEALQRPVAS

SEQ ID NO: 58012 - protein, 25 aa, synthetic construct
  source 1..25: note = Seed: VKLQTVHSIPLTINKEEALQRPVAS
VKLQTVHSIPLTIKKFEAMQRPVAS

SEQ ID NO: 58013 - protein, 25 aa, synthetic construct
  source 1..25: note = Seed: VKLQTVHSIPLTINKEEALQRPVAS
VKLQTVHSIPLTIKKFEAVQRPVAS

SEQ ID NO: 58014 - protein, 25 aa, synthetic construct
  source 1..25: note = Seed: VKLQTVHSIPLTINKEEALQRPVAS
VKLQTVHSIPLTIKKFEAYQRPVAS

SEQ ID NO: 58015 - protein, 25 aa, synthetic construct
  source 1..25: note = Seed: VKLQTVHSIPLTINKEEALQRPVAS
VKLQTVHSIPLTIKKREAFQRPVAS

SEQ ID NO: 58016 - protein, 25 aa, synthetic construct
  source 1..25: note = Seed: VKLQTVHSIPLTINKEEALQRPVAS
VKLQTVHSIPLTIKKREALQRPVAS

SEQ ID NO: 58017 - protein, 25 aa, synthetic construct
  source 1..25: note = Seed: VKLQTVHSIPLTINKEEALQRPVAS
VKLQTVHSIPLTILKAEAAQRPVAS

SEQ ID NO: 58018 - protein, 25 aa, synthetic construct
  source 1..25: note = Seed: VKLQTVHSIPLTINKEEALQRPVAS
VKLQTVHSIPLTILKAEAFQRPVAS

SEQ ID NO: 58019 - protein, 25 aa, synthetic construct
  source 1..25: note = Seed: VKLQTVHSIPLTINKEEALQRPVAS
VKLQTVHSIPLTILKAEAIQRPVAS

SEQ ID NO: 58020 - protein, 25 aa, synthetic construct
  source 1..25: note = Seed: VKLQTVHSIPLTINKEEALQRPVAS
VKLQTVHSIPLTILKAEALQRPVAS

SEQ ID NO: 58021 - protein, 25 aa, synthetic construct
  source 1..25: note = Seed: VKLQTVHSIPLTINKEEALQRPVAS
VKLQTVHSIPLTILKAEAMQRPVAS

SEQ ID NO: 58022 - protein, 25 aa, synthetic construct
  source 1..25: note = Seed: VKLQTVHSIPLTINKEEALQRPVAS
VKLQTVHSIPLTILKAEASQRPVAS

SEQ ID NO: 58023 - protein, 25 aa, synthetic construct
  source 1..25: note = Seed: VKLQTVHSIPLTINKEEALQRPVAS
VKLQTVHSIPLTILKAEAVQRPVAS

SEQ ID NO: 58024 - protein, 25 aa, synthetic construct
  source 1..25: note = Seed: VKLQTVHSIPLTINKEEALQRPVAS
VKLQTVHSIPLTILKAEAYQRPVAS

SEQ ID NO: 58025 - protein, 25 aa, synthetic construct
  source 1..25: note = Seed: VKLQTVHSIPLTINKEEALQRPVAS
VKLQTVHSIPLTILKDEAAQRPVAS

SEQ ID NO: 58026 - protein, 25 aa, synthetic construct
  source 1..25: note = Seed: VKLQTVHSIPLTINKEEALQRPVAS
VKLQTVHSIPLTILKDEAIQRPVAS

SEQ ID NO: 58027 - protein, 25 aa, synthetic construct
  source 1..25: note = Seed: VKLQTVHSIPLTINKEEALQRPVAS
VKLQTVHSIPLTILKDEALQRPVAS

SEQ ID NO: 58028 - protein, 25 aa, synthetic construct
  source 1..25: note = Seed: VKLQTVHSIPLTINKEEALQRPVAS
VKLQTVHSIPLTILKDEAVQRPVAS

SEQ ID NO: 58029 - protein, 25 aa, synthetic construct
  source 1..25: note = Seed: VKLQTVHSIPLTINKEEALQRPVAS
VKLQTVHSIPLTILKEEAFQRPVAS

SEQ ID NO: 58030 - protein, 25 aa, synthetic construct
  source 1..25: note = Seed: VKLQTVHSIPLTINKEEALQRPVAS
VKLQTVHSIPLTILKFEAAQRPVAS

SEQ ID NO: 58031 - protein, 25 aa, synthetic construct
  source 1..25: note = Seed: VKLQTVHSIPLTINKEEALQRPVAS
VKLQTVHSIPLTILKFEACQRPVAS

SEQ ID NO: 58032 - protein, 25 aa, synthetic construct
  source 1..25: note = Seed: VKLQTVHSIPLTINKEEALQRPVAS
VKLQTVHSIPLTILKFEADQRPVAS

SEQ ID NO: 58033 - protein, 25 aa, synthetic construct
  source 1..25: note = Seed: VKLQTVHSIPLTINKEEALQRPVAS
VKLQTVHSIPLTILKFEAEQRPVAS

SEQ ID NO: 58034 - protein, 25 aa, synthetic construct
  source 1..25: note = Seed: VKLQTVHSIPLTINKEEALQRPVAS
VKLQTVHSIPLTILKFEAFQRPVAS

SEQ ID NO: 58035 - protein, 25 aa, synthetic construct
  source 1..25: note = Seed: VKLQTVHSIPLTINKEEALQRPVAS
VKLQTVHSIPLTILKFEAGQRPVAS

SEQ ID NO: 58036 - protein, 25 aa, synthetic construct
  source 1..25: note = Seed: VKLQTVHSIPLTINKEEALQRPVAS
VKLQTVHSIPLTILKFEAHQRPVAS

SEQ ID NO: 58037 - protein, 25 aa, synthetic construct
  source 1..25: note = Seed: VKLQTVHSIPLTINKEEALQRPVAS
VKLQTVHSIPLTILKFEAIQRPVAS

SEQ ID NO: 58038 - protein, 25 aa, synthetic construct
  source 1..25: note = Seed: VKLQTVHSIPLTINKEEALQRPVAS
VKLQTVHSIPLTILKFEAKQRPVAS

SEQ ID NO: 58039 - protein, 25 aa, synthetic construct
  source 1..25: note = Seed: VKLQTVHSIPLTINKEEALQRPVAS
VKLQTVHSIPLTILKFEALQRPVAS

SEQ ID NO: 58040 - protein, 25 aa, synthetic construct
  source 1..25: note = Seed: VKLQTVHSIPLTINKEEALQRPVAS
VKLQTVHSIPLTILKFEAMQRPVAS

SEQ ID NO: 58041 - protein, 25 aa, synthetic construct
  source 1..25: note = Seed: VKLQTVHSIPLTINKEEALQRPVAS
VKLQTVHSIPLTILKFEANQRPVAS

SEQ ID NO: 58042 - protein, 25 aa, synthetic construct
  source 1..25: note = Seed: VKLQTVHSIPLTINKEEALQRPVAS
VKLQTVHSIPLTILKFEAPQRPVAS

SEQ ID NO: 58043 - protein, 25 aa, synthetic construct
  source 1..25: note = Seed: VKLQTVHSIPLTINKEEALQRPVAS
VKLQTVHSIPLTILKFEAQQRPVAS

SEQ ID NO: 58044 - protein, 25 aa, synthetic construct
  source 1..25: note = Seed: VKLQTVHSIPLTINKEEALQRPVAS
VKLQTVHSIPLTILKFEARQRPVAS

SEQ ID NO: 58045 - protein, 25 aa, synthetic construct
  source 1..25: note = Seed: VKLQTVHSIPLTINKEEALQRPVAS
VKLQTVHSIPLTILKFEASQRPVAS

SEQ ID NO: 58046 - protein, 25 aa, synthetic construct
  source 1..25: note = Seed: VKLQTVHSIPLTINKEEALQRPVAS
VKLQTVHSIPLTILKFEATQRPVAS

SEQ ID NO: 58047 - protein, 25 aa, synthetic construct
  source 1..25: note = Seed: VKLQTVHSIPLTINKEEALQRPVAS
VKLQTVHSIPLTILKFEAVQRPVAS

SEQ ID NO: 58048 - protein, 25 aa, synthetic construct
  source 1..25: note = Seed: VKLQTVHSIPLTINKEEALQRPVAS
VKLQTVHSIPLTILKFEAWQRPVAS

SEQ ID NO: 58049 - protein, 25 aa, synthetic construct
  source 1..25: note = Seed: VKLQTVHSIPLTINKEEALQRPVAS
VKLQTVHSIPLTILKFEAYQRPVAS

SEQ ID NO: 58050 - protein, 25 aa, synthetic construct
  source 1..25: note = Seed: VKLQTVHSIPLTINKEEALQRPVAS
VKLQTVHSIPLTILKGEAFQRPVAS

SEQ ID NO: 58051 - protein, 25 aa, synthetic construct
  source 1..25: note = Seed: VKLQTVHSIPLTINKEEALQRPVAS
VKLQTVHSIPLTILKHEAFQRPVAS

SEQ ID NO: 58052 - protein, 25 aa, synthetic construct
  source 1..25: note = Seed: VKLQTVHSIPLTINKEEALQRPVAS
VKLQTVHSIPLTILKHEAIQRPVAS

SEQ ID NO: 58053 - protein, 25 aa, synthetic construct
  source 1..25: note = Seed: VKLQTVHSIPLTINKEEALQRPVAS
VKLQTVHSIPLTILKHEALQRPVAS

SEQ ID NO: 58054 - protein, 25 aa, synthetic construct
  source 1..25: note = Seed: VKLQTVHSIPLTINKEEALQRPVAS
VKLQTVHSIPLTILKHEAVQRPVAS

SEQ ID NO: 58055 - protein, 25 aa, synthetic construct
  source 1..25: note = Seed: VKLQTVHSIPLTINKEEALQRPVAS
VKLQTVHSIPLTILKHEAYQRPVAS

SEQ ID NO: 58056 - protein, 25 aa, synthetic construct
  source 1..25: note = Seed: VKLQTVHSIPLTINKEEALQRPVAS
VKLQTVHSIPLTILKIEAAQRPVAS

SEQ ID NO: 58057 - protein, 25 aa, synthetic construct
  source 1..25: note = Seed: VKLQTVHSIPLTINKEEALQRPVAS
VKLQTVHSIPLTILKIEADQRPVAS

SEQ ID NO: 58058 - protein, 25 aa, synthetic construct
  source 1..25: note = Seed: VKLQTVHSIPLTINKEEALQRPVAS
VKLQTVHSIPLTILKIEAEQRPVAS

SEQ ID NO: 58059 - protein, 25 aa, synthetic construct
  source 1..25: note = Seed: VKLQTVHSIPLTINKEEALQRPVAS
VKLQTVHSIPLTILKIEAFQRPVAS

SEQ ID NO: 58060 - protein, 25 aa, synthetic construct
  source 1..25: note = Seed: VKLQTVHSIPLTINKEEALQRPVAS
VKLQTVHSIPLTILKIEAHQRPVAS

SEQ ID NO: 58061 - protein, 25 aa, synthetic construct
  source 1..25: note = Seed: VKLQTVHSIPLTINKEEALQRPVAS
VKLQTVHSIPLTILKIEAIQRPVAS

SEQ ID NO: 58062 - protein, 25 aa, synthetic construct
  source 1..25: note = Seed: VKLQTVHSIPLTINKEEALQRPVAS
VKLQTVHSIPLTILKIEAKQRPVAS

SEQ ID NO: 58063 - protein, 25 aa, synthetic construct
  source 1..25: note = Seed: VKLQTVHSIPLTINKEEALQRPVAS
VKLQTVHSIPLTILKIEALQRPVAS

SEQ ID NO: 58064 - protein, 25 aa, synthetic construct
  source 1..25: note = Seed: VKLQTVHSIPLTINKEEALQRPVAS
VKLQTVHSIPLTILKIEAMQRPVAS

SEQ ID NO: 58065 - protein, 25 aa, synthetic construct
  source 1..25: note = Seed: VKLQTVHSIPLTINKEEALQRPVAS
VKLQTVHSIPLTILKIEANQRPVAS

SEQ ID NO: 58066 - protein, 25 aa, synthetic construct
  source 1..25: note = Seed: VKLQTVHSIPLTINKEEALQRPVAS
VKLQTVHSIPLTILKIEAQQRPVAS

SEQ ID NO: 58067 - protein, 25 aa, synthetic construct
  source 1..25: note = Seed: VKLQTVHSIPLTINKEEALQRPVAS
VKLQTVHSIPLTILKIEARQRPVAS

SEQ ID NO: 58068 - protein, 25 aa, synthetic construct
  source 1..25: note = Seed: VKLQTVHSIPLTINKEEALQRPVAS
VKLQTVHSIPLTILKIEASQRPVAS

SEQ ID NO: 58069 - protein, 25 aa, synthetic construct
  source 1..25: note = Seed: VKLQTVHSIPLTINKEEALQRPVAS
VKLQTVHSIPLTILKIEATQRPVAS

SEQ ID NO: 58070 - protein, 25 aa, synthetic construct
  source 1..25: note = Seed: VKLQTVHSIPLTINKEEALQRPVAS
VKLQTVHSIPLTILKIEAVQRPVAS

SEQ ID NO: 58071 - protein, 25 aa, synthetic construct
  source 1..25: note = Seed: VKLQTVHSIPLTINKEEALQRPVAS
VKLQTVHSIPLTILKIEAYQRPVAS

SEQ ID NO: 58072 - protein, 25 aa, synthetic construct
  source 1..25: note = Seed: VKLQTVHSIPLTINKEEALQRPVAS
VKLQTVHSIPLTILKKEAFQRPVAS

SEQ ID NO: 58073 - protein, 25 aa, synthetic construct
  source 1..25: note = Seed: VKLQTVHSIPLTINKEEALQRPVAS
VKLQTVHSIPLTILKKEAIQRPVAS

SEQ ID NO: 58074 - protein, 25 aa, synthetic construct
  source 1..25: note = Seed: VKLQTVHSIPLTINKEEALQRPVAS
VKLQTVHSIPLTILKKEALQRPVAS

SEQ ID NO: 58075 - protein, 25 aa, synthetic construct
  source 1..25: note = Seed: VKLQTVHSIPLTINKEEALQRPVAS
VKLQTVHSIPLTILKKEAVQRPVAS

SEQ ID NO: 58076 - protein, 25 aa, synthetic construct
  source 1..25: note = Seed: VKLQTVHSIPLTINKEEALQRPVAS
VKLQTVHSIPLTILKLEAAQRPVAS

SEQ ID NO: 58077 - protein, 25 aa, synthetic construct
  source 1..25: note = Seed: VKLQTVHSIPLTINKEEALQRPVAS
VKLQTVHSIPLTILKLEADQRPVAS

SEQ ID NO: 58078 - protein, 25 aa, synthetic construct
  source 1..25: note = Seed: VKLQTVHSIPLTINKEEALQRPVAS
VKLQTVHSIPLTILKLEAEQRPVAS

SEQ ID NO: 58079 - protein, 25 aa, synthetic construct
  source 1..25: note = Seed: VKLQTVHSIPLTINKEEALQRPVAS
VKLQTVHSIPLTILKLEAFQRPVAS

SEQ ID NO: 58080 - protein, 25 aa, synthetic construct
  source 1..25: note = Seed: VKLQTVHSIPLTINKEEALQRPVAS
VKLQTVHSIPLTILKLEAHQRPVAS

SEQ ID NO: 58081 - protein, 25 aa, synthetic construct
  source 1..25: note = Seed: VKLQTVHSIPLTINKEEALQRPVAS
VKLQTVHSIPLTILKLEAIQRPVAS

SEQ ID NO: 58082 - protein, 25 aa, synthetic construct
  source 1..25: note = Seed: VKLQTVHSIPLTINKEEALQRPVAS
VKLQTVHSIPLTILKLEAKQRPVAS

SEQ ID NO: 58083 - protein, 25 aa, synthetic construct
  source 1..25: note = Seed: VKLQTVHSIPLTINKEEALQRPVAS
VKLQTVHSIPLTILKLEALQRPVAS

SEQ ID NO: 58084 - protein, 25 aa, synthetic construct
  source 1..25: note = Seed: VKLQTVHSIPLTINKEEALQRPVAS
VKLQTVHSIPLTILKLEAMQRPVAS

SEQ ID NO: 58085 - protein, 25 aa, synthetic construct
  source 1..25: note = Seed: VKLQTVHSIPLTINKEEALQRPVAS
VKLQTVHSIPLTILKLEANQRPVAS

SEQ ID NO: 58086 - protein, 25 aa, synthetic construct
  source 1..25: note = Seed: VKLQTVHSIPLTINKEEALQRPVAS
VKLQTVHSIPLTILKLEAPQRPVAS

SEQ ID NO: 58087 - protein, 25 aa, synthetic construct
  source 1..25: note = Seed: VKLQTVHSIPLTINKEEALQRPVAS
VKLQTVHSIPLTILKLEAQQRPVAS

SEQ ID NO: 58088 - protein, 25 aa, synthetic construct
  source 1..25: note = Seed: VKLQTVHSIPLTINKEEALQRPVAS
VKLQTVHSIPLTILKLEARQRPVAS

SEQ ID NO: 58089 - protein, 25 aa, synthetic construct
  source 1..25: note = Seed: VKLQTVHSIPLTINKEEALQRPVAS
VKLQTVHSIPLTILKLEASQRPVAS

SEQ ID NO: 58090 - protein, 25 aa, synthetic construct
  source 1..25: note = Seed: VKLQTVHSIPLTINKEEALQRPVAS
VKLQTVHSIPLTILKLEATQRPVAS

SEQ ID NO: 58091 - protein, 25 aa, synthetic construct
  source 1..25: note = Seed: VKLQTVHSIPLTINKEEALQRPVAS
VKLQTVHSIPLTILKLEAVQRPVAS

SEQ ID NO: 58092 - protein, 25 aa, synthetic construct
  source 1..25: note = Seed: VKLQTVHSIPLTINKEEALQRPVAS
VKLQTVHSIPLTILKLEAWQRPVAS

SEQ ID NO: 58093 - protein, 25 aa, synthetic construct
  source 1..25: note = Seed: VKLQTVHSIPLTINKEEALQRPVAS
VKLQTVHSIPLTILKLEAYQRPVAS

SEQ ID NO: 58094 - protein, 25 aa, synthetic construct
  source 1..25: note = Seed: VKLQTVHSIPLTINKEEALQRPVAS
VKLQTVHSIPLTILKMEAAQRPVAS

SEQ ID NO: 58095 - protein, 25 aa, synthetic construct
  source 1..25: note = Seed: VKLQTVHSIPLTINKEEALQRPVAS
VKLQTVHSIPLTILKMEAFQRPVAS

SEQ ID NO: 58096 - protein, 25 aa, synthetic construct
  source 1..25: note = Seed: VKLQTVHSIPLTINKEEALQRPVAS
VKLQTVHSIPLTILKMEAIQRPVAS

SEQ ID NO: 58097 - protein, 25 aa, synthetic construct
  source 1..25: note = Seed: VKLQTVHSIPLTINKEEALQRPVAS
VKLQTVHSIPLTILKMEALQRPVAS

SEQ ID NO: 58098 - protein, 25 aa, synthetic construct
  source 1..25: note = Seed: VKLQTVHSIPLTINKEEALQRPVAS
VKLQTVHSIPLTILKMEAMQRPVAS

SEQ ID NO: 58099 - protein, 25 aa, synthetic construct
  source 1..25: note = Seed: VKLQTVHSIPLTINKEEALQRPVAS
VKLQTVHSIPLTILKMEANQRPVAS

SEQ ID NO: 58100 - protein, 25 aa, synthetic construct
  source 1..25: note = Seed: VKLQTVHSIPLTINKEEALQRPVAS
VKLQTVHSIPLTILKMEASQRPVAS

SEQ ID NO: 58101 - protein, 25 aa, synthetic construct
  source 1..25: note = Seed: VKLQTVHSIPLTINKEEALQRPVAS
VKLQTVHSIPLTILKMEATQRPVAS

SEQ ID NO: 58102 - protein, 25 aa, synthetic construct
  source 1..25: note = Seed: VKLQTVHSIPLTINKEEALQRPVAS
VKLQTVHSIPLTILKMEAVQRPVAS

SEQ ID NO: 58103 - protein, 25 aa, synthetic construct
  source 1..25: note = Seed: VKLQTVHSIPLTINKEEALQRPVAS
VKLQTVHSIPLTILKMEAYQRPVAS

SEQ ID NO: 58104 - protein, 25 aa, synthetic construct
  source 1..25: note = Seed: VKLQTVHSIPLTINKEEALQRPVAS
VKLQTVHSIPLTILKNEAAQRPVAS

SEQ ID NO: 58105 - protein, 25 aa, synthetic construct
  source 1..25: note = Seed: VKLQTVHSIPLTINKEEALQRPVAS
VKLQTVHSIPLTILKNEAFQRPVAS

SEQ ID NO: 58106 - protein, 25 aa, synthetic construct
  source 1..25: note = Seed: VKLQTVHSIPLTINKEEALQRPVAS
VKLQTVHSIPLTILKNEAIQRPVAS

SEQ ID NO: 58107 - protein, 25 aa, synthetic construct
  source 1..25: note = Seed: VKLQTVHSIPLTINKEEALQRPVAS
VKLQTVHSIPLTILKNEALQRPVAS

SEQ ID NO: 58108 - protein, 25 aa, synthetic construct
  source 1..25: note = Seed: VKLQTVHSIPLTINKEEALQRPVAS
VKLQTVHSIPLTILKNEAVQRPVAS

SEQ ID NO: 58109 - protein, 25 aa, synthetic construct
  source 1..25: note = Seed: VKLQTVHSIPLTINKEEALQRPVAS
VKLQTVHSIPLTILKPEAFQRPVAS

SEQ ID NO: 58110 - protein, 25 aa, synthetic construct
  source 1..25: note = Seed: VKLQTVHSIPLTINKEEALQRPVAS
VKLQTVHSIPLTILKQEALQRPVAS

SEQ ID NO: 58111 - protein, 25 aa, synthetic construct
  source 1..25: note = Seed: VKLQTVHSIPLTINKEEALQRPVAS
VKLQTVHSIPLTILKREAFQRPVAS

SEQ ID NO: 58112 - protein, 25 aa, synthetic construct
  source 1..25: note = Seed: VKLQTVHSIPLTINKEEALQRPVAS
VKLQTVHSIPLTILKREAIQRPVAS

SEQ ID NO: 58113 - protein, 25 aa, synthetic construct
  source 1..25: note = Seed: VKLQTVHSIPLTINKEEALQRPVAS
VKLQTVHSIPLTILKREALQRPVAS

SEQ ID NO: 58114 - protein, 25 aa, synthetic construct
  source 1..25: note = Seed: VKLQTVHSIPLTINKEEALQRPVAS
VKLQTVHSIPLTILKREAMQRPVAS

SEQ ID NO: 58115 - protein, 25 aa, synthetic construct
  source 1..25: note = Seed: VKLQTVHSIPLTINKEEALQRPVAS
VKLQTVHSIPLTILKREARQRPVAS

SEQ ID NO: 58116 - protein, 25 aa, synthetic construct
  source 1..25: note = Seed: VKLQTVHSIPLTINKEEALQRPVAS
VKLQTVHSIPLTILKREAVQRPVAS

SEQ ID NO: 58117 - protein, 25 aa, synthetic construct
  source 1..25: note = Seed: VKLQTVHSIPLTINKEEALQRPVAS
VKLQTVHSIPLTILKREAYQRPVAS

SEQ ID NO: 58118 - protein, 25 aa, synthetic construct
  source 1..25: note = Seed: VKLQTVHSIPLTINKEEALQRPVAS
VKLQTVHSIPLTILKSEAFQRPVAS

SEQ ID NO: 58119 - protein, 25 aa, synthetic construct
  source 1..25: note = Seed: VKLQTVHSIPLTINKEEALQRPVAS
VKLQTVHSIPLTILKSEAIQRPVAS

SEQ ID NO: 58120 - protein, 25 aa, synthetic construct
  source 1..25: note = Seed: VKLQTVHSIPLTINKEEALQRPVAS
VKLQTVHSIPLTILKSEALQRPVAS

SEQ ID NO: 58121 - protein, 25 aa, synthetic construct
  source 1..25: note = Seed: VKLQTVHSIPLTINKEEALQRPVAS
VKLQTVHSIPLTILKSEAVQRPVAS

SEQ ID NO: 58122 - protein, 25 aa, synthetic construct
  source 1..25: note = Seed: VKLQTVHSIPLTINKEEALQRPVAS
VKLQTVHSIPLTILKTEAFQRPVAS

SEQ ID NO: 58123 - protein, 25 aa, synthetic construct
  source 1..25: note = Seed: VKLQTVHSIPLTINKEEALQRPVAS
VKLQTVHSIPLTILKTEAIQRPVAS

SEQ ID NO: 58124 - protein, 25 aa, synthetic construct
  source 1..25: note = Seed: VKLQTVHSIPLTINKEEALQRPVAS
VKLQTVHSIPLTILKTEALQRPVAS

SEQ ID NO: 58125 - protein, 25 aa, synthetic construct
  source 1..25: note = Seed: VKLQTVHSIPLTINKEEALQRPVAS
VKLQTVHSIPLTILKTEAVQRPVAS

SEQ ID NO: 58126 - protein, 25 aa, synthetic construct
  source 1..25: note = Seed: VKLQTVHSIPLTINKEEALQRPVAS
VKLQTVHSIPLTILKVEAAQRPVAS

SEQ ID NO: 58127 - protein, 25 aa, synthetic construct
  source 1..25: note = Seed: VKLQTVHSIPLTINKEEALQRPVAS
VKLQTVHSIPLTILKVEADQRPVAS

SEQ ID NO: 58128 - protein, 25 aa, synthetic construct
  source 1..25: note = Seed: VKLQTVHSIPLTINKEEALQRPVAS
VKLQTVHSIPLTILKVEAFQRPVAS

SEQ ID NO: 58129 - protein, 25 aa, synthetic construct
  source 1..25: note = Seed: VKLQTVHSIPLTINKEEALQRPVAS
VKLQTVHSIPLTILKVEAIQRPVAS

SEQ ID NO: 58130 - protein, 25 aa, synthetic construct
  source 1..25: note = Seed: VKLQTVHSIPLTINKEEALQRPVAS
VKLQTVHSIPLTILKVEALQRPVAS

SEQ ID NO: 58131 - protein, 25 aa, synthetic construct
  source 1..25: note = Seed: VKLQTVHSIPLTINKEEALQRPVAS
VKLQTVHSIPLTILKVEAMQRPVAS

SEQ ID NO: 58132 - protein, 25 aa, synthetic construct
  source 1..25: note = Seed: VKLQTVHSIPLTINKEEALQRPVAS
VKLQTVHSIPLTILKVEANQRPVAS

SEQ ID NO: 58133 - protein, 25 aa, synthetic construct
  source 1..25: note = Seed: VKLQTVHSIPLTINKEEALQRPVAS
VKLQTVHSIPLTILKVEARQRPVAS

SEQ ID NO: 58134 - protein, 25 aa, synthetic construct
  source 1..25: note = Seed: VKLQTVHSIPLTINKEEALQRPVAS
VKLQTVHSIPLTILKVEASQRPVAS

SEQ ID NO: 58135 - protein, 25 aa, synthetic construct
  source 1..25: note = Seed: VKLQTVHSIPLTINKEEALQRPVAS
VKLQTVHSIPLTILKVEATQRPVAS

SEQ ID NO: 58136 - protein, 25 aa, synthetic construct
  source 1..25: note = Seed: VKLQTVHSIPLTINKEEALQRPVAS
VKLQTVHSIPLTILKVEAVQRPVAS

SEQ ID NO: 58137 - protein, 25 aa, synthetic construct
  source 1..25: note = Seed: VKLQTVHSIPLTINKEEALQRPVAS
VKLQTVHSIPLTILKVEAYQRPVAS

SEQ ID NO: 58138 - protein, 25 aa, synthetic construct
  source 1..25: note = Seed: VKLQTVHSIPLTINKEEALQRPVAS
VKLQTVHSIPLTILKWEAAQRPVAS

SEQ ID NO: 58139 - protein, 25 aa, synthetic construct
  source 1..25: note = Seed: VKLQTVHSIPLTINKEEALQRPVAS
VKLQTVHSIPLTILKWEAEQRPVAS

SEQ ID NO: 58140 - protein, 25 aa, synthetic construct
  source 1..25: note = Seed: VKLQTVHSIPLTINKEEALQRPVAS
VKLQTVHSIPLTILKWEAFQRPVAS

SEQ ID NO: 58141 - protein, 25 aa, synthetic construct
  source 1..25: note = Seed: VKLQTVHSIPLTINKEEALQRPVAS
VKLQTVHSIPLTILKWEAIQRPVAS

SEQ ID NO: 58142 - protein, 25 aa, synthetic construct
  source 1..25: note = Seed: VKLQTVHSIPLTINKEEALQRPVAS
VKLQTVHSIPLTILKWEALQRPVAS

SEQ ID NO: 58143 - protein, 25 aa, synthetic construct
  source 1..25: note = Seed: VKLQTVHSIPLTINKEEALQRPVAS
VKLQTVHSIPLTILKWEAMQRPVAS

SEQ ID NO: 58144 - protein, 25 aa, synthetic construct
  source 1..25: note = Seed: VKLQTVHSIPLTINKEEALQRPVAS
VKLQTVHSIPLTILKWEANQRPVAS

SEQ ID NO: 58145 - protein, 25 aa, synthetic construct
  source 1..25: note = Seed: VKLQTVHSIPLTINKEEALQRPVAS
VKLQTVHSIPLTILKWEASQRPVAS

SEQ ID NO: 58146 - protein, 25 aa, synthetic construct
  source 1..25: note = Seed: VKLQTVHSIPLTINKEEALQRPVAS
VKLQTVHSIPLTILKWEATQRPVAS

SEQ ID NO: 58147 - protein, 25 aa, synthetic construct
  source 1..25: note = Seed: VKLQTVHSIPLTINKEEALQRPVAS
VKLQTVHSIPLTILKWEAVQRPVAS

SEQ ID NO: 58148 - protein, 25 aa, synthetic construct
  source 1..25: note = Seed: VKLQTVHSIPLTINKEEALQRPVAS
VKLQTVHSIPLTILKWEAYQRPVAS

SEQ ID NO: 58149 - protein, 25 aa, synthetic construct
  source 1..25: note = Seed: VKLQTVHSIPLTINKEEALQRPVAS
VKLQTVHSIPLTILKYEAAQRPVAS

SEQ ID NO: 58150 - protein, 25 aa, synthetic construct
  source 1..25: note = Seed: VKLQTVHSIPLTINKEEALQRPVAS
VKLQTVHSIPLTILKYEACQRPVAS

SEQ ID NO: 58151 - protein, 25 aa, synthetic construct
  source 1..25: note = Seed: VKLQTVHSIPLTINKEEALQRPVAS
VKLQTVHSIPLTILKYEADQRPVAS

SEQ ID NO: 58152 - protein, 25 aa, synthetic construct
  source 1..25: note = Seed: VKLQTVHSIPLTINKEEALQRPVAS
VKLQTVHSIPLTILKYEAEQRPVAS

SEQ ID NO: 58153 - protein, 25 aa, synthetic construct
  source 1..25: note = Seed: VKLQTVHSIPLTINKEEALQRPVAS
VKLQTVHSIPLTILKYEAFQRPVAS

SEQ ID NO: 58154 - protein, 25 aa, synthetic construct
  source 1..25: note = Seed: VKLQTVHSIPLTINKEEALQRPVAS
VKLQTVHSIPLTILKYEAGQRPVAS

SEQ ID NO: 58155 - protein, 25 aa, synthetic construct
  source 1..25: note = Seed: VKLQTVHSIPLTINKEEALQRPVAS
VKLQTVHSIPLTILKYEAHQRPVAS

SEQ ID NO: 58156 - protein, 25 aa, synthetic construct
  source 1..25: note = Seed: VKLQTVHSIPLTINKEEALQRPVAS
VKLQTVHSIPLTILKYEAIQRPVAS

SEQ ID NO: 58157 - protein, 25 aa, synthetic construct
  source 1..25: note = Seed: VKLQTVHSIPLTINKEEALQRPVAS
VKLQTVHSIPLTILKYEALQRPVAS

SEQ ID NO: 58158 - protein, 25 aa, synthetic construct
  source 1..25: note = Seed: VKLQTVHSIPLTINKEEALQRPVAS
VKLQTVHSIPLTILKYEAMQRPVAS

SEQ ID NO: 58159 - protein, 25 aa, synthetic construct
  source 1..25: note = Seed: VKLQTVHSIPLTINKEEALQRPVAS
VKLQTVHSIPLTILKYEANQRPVAS

SEQ ID NO: 58160 - protein, 25 aa, synthetic construct
  source 1..25: note = Seed: VKLQTVHSIPLTINKEEALQRPVAS
VKLQTVHSIPLTILKYEAPQRPVAS

SEQ ID NO: 58161 - protein, 25 aa, synthetic construct
  source 1..25: note = Seed: VKLQTVHSIPLTINKEEALQRPVAS
VKLQTVHSIPLTILKYEAQQRPVAS

SEQ ID NO: 58162 - protein, 25 aa, synthetic construct
  source 1..25: note = Seed: VKLQTVHSIPLTINKEEALQRPVAS
VKLQTVHSIPLTILKYEARQRPVAS

SEQ ID NO: 58163 - protein, 25 aa, synthetic construct
  source 1..25: note = Seed: VKLQTVHSIPLTINKEEALQRPVAS
VKLQTVHSIPLTILKYEASQRPVAS

SEQ ID NO: 58164 - protein, 25 aa, synthetic construct
  source 1..25: note = Seed: VKLQTVHSIPLTINKEEALQRPVAS
VKLQTVHSIPLTILKYEATQRPVAS

SEQ ID NO: 58165 - protein, 25 aa, synthetic construct
  source 1..25: note = Seed: VKLQTVHSIPLTINKEEALQRPVAS
VKLQTVHSIPLTILKYEAVQRPVAS

SEQ ID NO: 58166 - protein, 25 aa, synthetic construct
  source 1..25: note = Seed: VKLQTVHSIPLTINKEEALQRPVAS
VKLQTVHSIPLTILKYEAWQRPVAS

SEQ ID NO: 58167 - protein, 25 aa, synthetic construct
  source 1..25: note = Seed: VKLQTVHSIPLTINKEEALQRPVAS
VKLQTVHSIPLTILKYEAYQRPVAS

SEQ ID NO: 58168 - protein, 25 aa, synthetic construct
  source 1..25: note = Seed: VKLQTVHSIPLTINKEEALQRPVAS
VKLQTVHSIPLTIMKAEAAQRPVAS

SEQ ID NO: 58169 - protein, 25 aa, synthetic construct
  source 1..25: note = Seed: VKLQTVHSIPLTINKEEALQRPVAS
VKLQTVHSIPLTIMKAEAFQRPVAS

SEQ ID NO: 58170 - protein, 25 aa, synthetic construct
  source 1..25: note = Seed: VKLQTVHSIPLTINKEEALQRPVAS
VKLQTVHSIPLTIMKAEAIQRPVAS

SEQ ID NO: 58171 - protein, 25 aa, synthetic construct
  source 1..25: note = Seed: VKLQTVHSIPLTINKEEALQRPVAS
VKLQTVHSIPLTIMKAEALQRPVAS

SEQ ID NO: 58172 - protein, 25 aa, synthetic construct
  source 1..25: note = Seed: VKLQTVHSIPLTINKEEALQRPVAS
VKLQTVHSIPLTIMKAEAMQRPVAS

SEQ ID NO: 58173 - protein, 25 aa, synthetic construct
  source 1..25: note = Seed: VKLQTVHSIPLTINKEEALQRPVAS
VKLQTVHSIPLTIMKAEASQRPVAS

SEQ ID NO: 58174 - protein, 25 aa, synthetic construct
  source 1..25: note = Seed: VKLQTVHSIPLTINKEEALQRPVAS
VKLQTVHSIPLTIMKAEAVQRPVAS

SEQ ID NO: 58175 - protein, 25 aa, synthetic construct
  source 1..25: note = Seed: VKLQTVHSIPLTINKEEALQRPVAS
VKLQTVHSIPLTIMKAEAYQRPVAS

SEQ ID NO: 58176 - protein, 25 aa, synthetic construct
  source 1..25: note = Seed: VKLQTVHSIPLTINKEEALQRPVAS
VKLQTVHSIPLTIMKDEAAQRPVAS

SEQ ID NO: 58177 - protein, 25 aa, synthetic construct
  source 1..25: note = Seed: VKLQTVHSIPLTINKEEALQRPVAS
VKLQTVHSIPLTIMKDEAFQRPVAS

SEQ ID NO: 58178 - protein, 25 aa, synthetic construct
  source 1..25: note = Seed: VKLQTVHSIPLTINKEEALQRPVAS
VKLQTVHSIPLTIMKDEAIQRPVAS

SEQ ID NO: 58179 - protein, 25 aa, synthetic construct
  source 1..25: note = Seed: VKLQTVHSIPLTINKEEALQRPVAS
VKLQTVHSIPLTIMKDEALQRPVAS

SEQ ID NO: 58180 - protein, 25 aa, synthetic construct
  source 1..25: note = Seed: VKLQTVHSIPLTINKEEALQRPVAS
VKLQTVHSIPLTIMKDEAMQRPVAS

SEQ ID NO: 58181 - protein, 25 aa, synthetic construct
  source 1..25: note = Seed: VKLQTVHSIPLTINKEEALQRPVAS
VKLQTVHSIPLTIMKDEAVQRPVAS

SEQ ID NO: 58182 - protein, 25 aa, synthetic construct
  source 1..25: note = Seed: VKLQTVHSIPLTINKEEALQRPVAS
VKLQTVHSIPLTIMKFEAAQRPVAS

SEQ ID NO: 58183 - protein, 25 aa, synthetic construct
  source 1..25: note = Seed: VKLQTVHSIPLTINKEEALQRPVAS
VKLQTVHSIPLTIMKFEACQRPVAS

SEQ ID NO: 58184 - protein, 25 aa, synthetic construct
  source 1..25: note = Seed: VKLQTVHSIPLTINKEEALQRPVAS
VKLQTVHSIPLTIMKFEADQRPVAS

SEQ ID NO: 58185 - protein, 25 aa, synthetic construct
  source 1..25: note = Seed: VKLQTVHSIPLTINKEEALQRPVAS
VKLQTVHSIPLTIMKFEAEQRPVAS

SEQ ID NO: 58186 - protein, 25 aa, synthetic construct
  source 1..25: note = Seed: VKLQTVHSIPLTINKEEALQRPVAS
VKLQTVHSIPLTIMKFEAFQRPVAS

SEQ ID NO: 58187 - protein, 25 aa, synthetic construct
  source 1..25: note = Seed: VKLQTVHSIPLTINKEEALQRPVAS
VKLQTVHSIPLTIMKFEAGQRPVAS

SEQ ID NO: 58188 - protein, 25 aa, synthetic construct
  source 1..25: note = Seed: VKLQTVHSIPLTINKEEALQRPVAS
VKLQTVHSIPLTIMKFEAHQRPVAS

SEQ ID NO: 58189 - protein, 25 aa, synthetic construct
  source 1..25: note = Seed: VKLQTVHSIPLTINKEEALQRPVAS
VKLQTVHSIPLTIMKFEAIQRPVAS

SEQ ID NO: 58190 - protein, 25 aa, synthetic construct
  source 1..25: note = Seed: VKLQTVHSIPLTINKEEALQRPVAS
VKLQTVHSIPLTIMKFEAKQRPVAS

SEQ ID NO: 58191 - protein, 25 aa, synthetic construct
  source 1..25: note = Seed: VKLQTVHSIPLTINKEEALQRPVAS
VKLQTVHSIPLTIMKFEALQRPVAS

SEQ ID NO: 58192 - protein, 25 aa, synthetic construct
  source 1..25: note = Seed: VKLQTVHSIPLTINKEEALQRPVAS
VKLQTVHSIPLTIMKFEAMQRPVAS

SEQ ID NO: 58193 - protein, 25 aa, synthetic construct
  source 1..25: note = Seed: VKLQTVHSIPLTINKEEALQRPVAS
VKLQTVHSIPLTIMKFEANQRPVAS

SEQ ID NO: 58194 - protein, 25 aa, synthetic construct
  source 1..25: note = Seed: VKLQTVHSIPLTINKEEALQRPVAS
VKLQTVHSIPLTIMKFEAPQRPVAS

SEQ ID NO: 58195 - protein, 25 aa, synthetic construct
  source 1..25: note = Seed: VKLQTVHSIPLTINKEEALQRPVAS
VKLQTVHSIPLTIMKFEAQQRPVAS

SEQ ID NO: 58196 - protein, 25 aa, synthetic construct
  source 1..25: note = Seed: VKLQTVHSIPLTINKEEALQRPVAS
VKLQTVHSIPLTIMKFEARQRPVAS

SEQ ID NO: 58197 - protein, 25 aa, synthetic construct
  source 1..25: note = Seed: VKLQTVHSIPLTINKEEALQRPVAS
VKLQTVHSIPLTIMKFEASQRPVAS

SEQ ID NO: 58198 - protein, 25 aa, synthetic construct
  source 1..25: note = Seed: VKLQTVHSIPLTINKEEALQRPVAS
VKLQTVHSIPLTIMKFEATQRPVAS

SEQ ID NO: 58199 - protein, 25 aa, synthetic construct
  source 1..25: note = Seed: VKLQTVHSIPLTINKEEALQRPVAS
VKLQTVHSIPLTIMKFEAVQRPVAS

SEQ ID NO: 58200 - protein, 25 aa, synthetic construct
  source 1..25: note = Seed: VKLQTVHSIPLTINKEEALQRPVAS
VKLQTVHSIPLTIMKFEAWQRPVAS

SEQ ID NO: 58201 - protein, 25 aa, synthetic construct
  source 1..25: note = Seed: VKLQTVHSIPLTINKEEALQRPVAS
VKLQTVHSIPLTIMKFEAYQRPVAS

SEQ ID NO: 58202 - protein, 25 aa, synthetic construct
  source 1..25: note = Seed: VKLQTVHSIPLTINKEEALQRPVAS
VKLQTVHSIPLTIMKGEAVQRPVAS

SEQ ID NO: 58203 - protein, 25 aa, synthetic construct
  source 1..25: note = Seed: VKLQTVHSIPLTINKEEALQRPVAS
VKLQTVHSIPLTIMKHEAFQRPVAS

SEQ ID NO: 58204 - protein, 25 aa, synthetic construct
  source 1..25: note = Seed: VKLQTVHSIPLTINKEEALQRPVAS
VKLQTVHSIPLTIMKHEAIQRPVAS

SEQ ID NO: 58205 - protein, 25 aa, synthetic construct
  source 1..25: note = Seed: VKLQTVHSIPLTINKEEALQRPVAS
VKLQTVHSIPLTIMKHEALQRPVAS

SEQ ID NO: 58206 - protein, 25 aa, synthetic construct
  source 1..25: note = Seed: VKLQTVHSIPLTINKEEALQRPVAS
VKLQTVHSIPLTIMKHEAVQRPVAS

SEQ ID NO: 58207 - protein, 25 aa, synthetic construct
  source 1..25: note = Seed: VKLQTVHSIPLTINKEEALQRPVAS
VKLQTVHSIPLTIMKHEAYQRPVAS

SEQ ID NO: 58208 - protein, 25 aa, synthetic construct
  source 1..25: note = Seed: VKLQTVHSIPLTINKEEALQRPVAS
VKLQTVHSIPLTIMKIEAAQRPVAS

SEQ ID NO: 58209 - protein, 25 aa, synthetic construct
  source 1..25: note = Seed: VKLQTVHSIPLTINKEEALQRPVAS
VKLQTVHSIPLTIMKIEACQRPVAS

SEQ ID NO: 58210 - protein, 25 aa, synthetic construct
  source 1..25: note = Seed: VKLQTVHSIPLTINKEEALQRPVAS
VKLQTVHSIPLTIMKIEADQRPVAS

SEQ ID NO: 58211 - protein, 25 aa, synthetic construct
  source 1..25: note = Seed: VKLQTVHSIPLTINKEEALQRPVAS
VKLQTVHSIPLTIMKIEAEQRPVAS

SEQ ID NO: 58212 - protein, 25 aa, synthetic construct
  source 1..25: note = Seed: VKLQTVHSIPLTINKEEALQRPVAS
VKLQTVHSIPLTIMKIEAFQRPVAS

SEQ ID NO: 58213 - protein, 25 aa, synthetic construct
  source 1..25: note = Seed: VKLQTVHSIPLTINKEEALQRPVAS
VKLQTVHSIPLTIMKIEAGQRPVAS

SEQ ID NO: 58214 - protein, 25 aa, synthetic construct
  source 1..25: note = Seed: VKLQTVHSIPLTINKEEALQRPVAS
VKLQTVHSIPLTIMKIEAIQRPVAS

SEQ ID NO: 58215 - protein, 25 aa, synthetic construct
  source 1..25: note = Seed: VKLQTVHSIPLTINKEEALQRPVAS
VKLQTVHSIPLTIMKIEALQRPVAS

SEQ ID NO: 58216 - protein, 25 aa, synthetic construct
  source 1..25: note = Seed: VKLQTVHSIPLTINKEEALQRPVAS
VKLQTVHSIPLTIMKIEAMQRPVAS

SEQ ID NO: 58217 - protein, 25 aa, synthetic construct
  source 1..25: note = Seed: VKLQTVHSIPLTINKEEALQRPVAS
VKLQTVHSIPLTIMKIEANQRPVAS

SEQ ID NO: 58218 - protein, 25 aa, synthetic construct
  source 1..25: note = Seed: VKLQTVHSIPLTINKEEALQRPVAS
VKLQTVHSIPLTIMKIEAQQRPVAS

SEQ ID NO: 58219 - protein, 25 aa, synthetic construct
  source 1..25: note = Seed: VKLQTVHSIPLTINKEEALQRPVAS
VKLQTVHSIPLTIMKIEARQRPVAS

SEQ ID NO: 58220 - protein, 25 aa, synthetic construct
  source 1..25: note = Seed: VKLQTVHSIPLTINKEEALQRPVAS
VKLQTVHSIPLTIMKIEASQRPVAS

SEQ ID NO: 58221 - protein, 25 aa, synthetic construct
  source 1..25: note = Seed: VKLQTVHSIPLTINKEEALQRPVAS
VKLQTVHSIPLTIMKIEATQRPVAS

SEQ ID NO: 58222 - protein, 25 aa, synthetic construct
  source 1..25: note = Seed: VKLQTVHSIPLTINKEEALQRPVAS
VKLQTVHSIPLTIMKIEAVQRPVAS

SEQ ID NO: 58223 - protein, 25 aa, synthetic construct
  source 1..25: note = Seed: VKLQTVHSIPLTINKEEALQRPVAS
VKLQTVHSIPLTIMKIEAYQRPVAS

SEQ ID NO: 58224 - protein, 25 aa, synthetic construct
  source 1..25: note = Seed: VKLQTVHSIPLTINKEEALQRPVAS
VKLQTVHSIPLTIMKKEAFQRPVAS

SEQ ID NO: 58225 - protein, 25 aa, synthetic construct
  source 1..25: note = Seed: VKLQTVHSIPLTINKEEALQRPVAS
VKLQTVHSIPLTIMKKEAIQRPVAS

SEQ ID NO: 58226 - protein, 25 aa, synthetic construct
  source 1..25: note = Seed: VKLQTVHSIPLTINKEEALQRPVAS
VKLQTVHSIPLTIMKKEALQRPVAS

SEQ ID NO: 58227 - protein, 25 aa, synthetic construct
  source 1..25: note = Seed: VKLQTVHSIPLTINKEEALQRPVAS
VKLQTVHSIPLTIMKKEAMQRPVAS

SEQ ID NO: 58228 - protein, 25 aa, synthetic construct
  source 1..25: note = Seed: VKLQTVHSIPLTINKEEALQRPVAS
VKLQTVHSIPLTIMKKEAVQRPVAS

SEQ ID NO: 58229 - protein, 25 aa, synthetic construct
  source 1..25: note = Seed: VKLQTVHSIPLTINKEEALQRPVAS
VKLQTVHSIPLTIMKKEAYQRPVAS

SEQ ID NO: 58230 - protein, 25 aa, synthetic construct
  source 1..25: note = Seed: VKLQTVHSIPLTINKEEALQRPVAS
VKLQTVHSIPLTIMKLEAAQRPVAS

SEQ ID NO: 58231 - protein, 25 aa, synthetic construct
  source 1..25: note = Seed: VKLQTVHSIPLTINKEEALQRPVAS
VKLQTVHSIPLTIMKLEAFQRPVAS

SEQ ID NO: 58232 - protein, 25 aa, synthetic construct
  source 1..25: note = Seed: VKLQTVHSIPLTINKEEALQRPVAS
VKLQTVHSIPLTIMKLEAIQRPVAS

SEQ ID NO: 58233 - protein, 25 aa, synthetic construct
  source 1..25: note = Seed: VKLQTVHSIPLTINKEEALQRPVAS
VKLQTVHSIPLTIMKLEALQRPVAS

SEQ ID NO: 58234 - protein, 25 aa, synthetic construct
  source 1..25: note = Seed: VKLQTVHSIPLTINKEEALQRPVAS
VKLQTVHSIPLTIMKLEAMQRPVAS

SEQ ID NO: 58235 - protein, 25 aa, synthetic construct
  source 1..25: note = Seed: VKLQTVHSIPLTINKEEALQRPVAS
VKLQTVHSIPLTIMKLEANQRPVAS

SEQ ID NO: 58236 - protein, 25 aa, synthetic construct
  source 1..25: note = Seed: VKLQTVHSIPLTINKEEALQRPVAS
VKLQTVHSIPLTIMKLEARQRPVAS

SEQ ID NO: 58237 - protein, 25 aa, synthetic construct
  source 1..25: note = Seed: VKLQTVHSIPLTINKEEALQRPVAS
VKLQTVHSIPLTIMKLEASQRPVAS

SEQ ID NO: 58238 - protein, 25 aa, synthetic construct
  source 1..25: note = Seed: VKLQTVHSIPLTINKEEALQRPVAS
VKLQTVHSIPLTIMKLEATQRPVAS

SEQ ID NO: 58239 - protein, 25 aa, synthetic construct
  source 1..25: note = Seed: VKLQTVHSIPLTINKEEALQRPVAS
VKLQTVHSIPLTIMKLEAVQRPVAS

SEQ ID NO: 58240 - protein, 25 aa, synthetic construct
  source 1..25: note = Seed: VKLQTVHSIPLTINKEEALQRPVAS
VKLQTVHSIPLTIMKLEAWQRPVAS

SEQ ID NO: 58241 - protein, 25 aa, synthetic construct
  source 1..25: note = Seed: VKLQTVHSIPLTINKEEALQRPVAS
VKLQTVHSIPLTIMKLEAYQRPVAS

SEQ ID NO: 58242 - protein, 25 aa, synthetic construct
  source 1..25: note = Seed: VKLQTVHSIPLTINKEEALQRPVAS
VKLQTVHSIPLTIMKMEAAQRPVAS

SEQ ID NO: 58243 - protein, 25 aa, synthetic construct
  source 1..25: note = Seed: VKLQTVHSIPLTINKEEALQRPVAS
VKLQTVHSIPLTIMKMEAFQRPVAS

SEQ ID NO: 58244 - protein, 25 aa, synthetic construct
  source 1..25: note = Seed: VKLQTVHSIPLTINKEEALQRPVAS
VKLQTVHSIPLTIMKMEAIQRPVAS

SEQ ID NO: 58245 - protein, 25 aa, synthetic construct
  source 1..25: note = Seed: VKLQTVHSIPLTINKEEALQRPVAS
VKLQTVHSIPLTIMKMEALQRPVAS

SEQ ID NO: 58246 - protein, 25 aa, synthetic construct
  source 1..25: note = Seed: VKLQTVHSIPLTINKEEALQRPVAS
VKLQTVHSIPLTIMKMEAMQRPVAS

SEQ ID NO: 58247 - protein, 25 aa, synthetic construct
  source 1..25: note = Seed: VKLQTVHSIPLTINKEEALQRPVAS
VKLQTVHSIPLTIMKMEASQRPVAS

SEQ ID NO: 58248 - protein, 25 aa, synthetic construct
  source 1..25: note = Seed: VKLQTVHSIPLTINKEEALQRPVAS
VKLQTVHSIPLTIMKMEAVQRPVAS

SEQ ID NO: 58249 - protein, 25 aa, synthetic construct
  source 1..25: note = Seed: VKLQTVHSIPLTINKEEALQRPVAS
VKLQTVHSIPLTIMKMEAYQRPVAS

SEQ ID NO: 58250 - protein, 25 aa, synthetic construct
  source 1..25: note = Seed: VKLQTVHSIPLTINKEEALQRPVAS
VKLQTVHSIPLTIMKNEAAQRPVAS

SEQ ID NO: 58251 - protein, 25 aa, synthetic construct
  source 1..25: note = Seed: VKLQTVHSIPLTINKEEALQRPVAS
VKLQTVHSIPLTIMKNEAFQRPVAS

SEQ ID NO: 58252 - protein, 25 aa, synthetic construct
  source 1..25: note = Seed: VKLQTVHSIPLTINKEEALQRPVAS
VKLQTVHSIPLTIMKNEAIQRPVAS

SEQ ID NO: 58253 - protein, 25 aa, synthetic construct
  source 1..25: note = Seed: VKLQTVHSIPLTINKEEALQRPVAS
VKLQTVHSIPLTIMKNEALQRPVAS

SEQ ID NO: 58254 - protein, 25 aa, synthetic construct
  source 1..25: note = Seed: VKLQTVHSIPLTINKEEALQRPVAS
VKLQTVHSIPLTIMKNEAMQRPVAS

SEQ ID NO: 58255 - protein, 25 aa, synthetic construct
  source 1..25: note = Seed: VKLQTVHSIPLTINKEEALQRPVAS
VKLQTVHSIPLTIMKNEAVQRPVAS

SEQ ID NO: 58256 - protein, 25 aa, synthetic construct
  source 1..25: note = Seed: VKLQTVHSIPLTINKEEALQRPVAS
VKLQTVHSIPLTIMKPEAIQRPVAS

SEQ ID NO: 58257 - protein, 25 aa, synthetic construct
  source 1..25: note = Seed: VKLQTVHSIPLTINKEEALQRPVAS
VKLQTVHSIPLTIMKPEAVQRPVAS

SEQ ID NO: 58258 - protein, 25 aa, synthetic construct
  source 1..25: note = Seed: VKLQTVHSIPLTINKEEALQRPVAS
VKLQTVHSIPLTIMKREAFQRPVAS

SEQ ID NO: 58259 - protein, 25 aa, synthetic construct
  source 1..25: note = Seed: VKLQTVHSIPLTINKEEALQRPVAS
VKLQTVHSIPLTIMKREAIQRPVAS

SEQ ID NO: 58260 - protein, 25 aa, synthetic construct
  source 1..25: note = Seed: VKLQTVHSIPLTINKEEALQRPVAS
VKLQTVHSIPLTIMKREALQRPVAS

SEQ ID NO: 58261 - protein, 25 aa, synthetic construct
  source 1..25: note = Seed: VKLQTVHSIPLTINKEEALQRPVAS
VKLQTVHSIPLTIMKREAMQRPVAS

SEQ ID NO: 58262 - protein, 25 aa, synthetic construct
  source 1..25: note = Seed: VKLQTVHSIPLTINKEEALQRPVAS
VKLQTVHSIPLTIMKREARQRPVAS

SEQ ID NO: 58263 - protein, 25 aa, synthetic construct
  source 1..25: note = Seed: VKLQTVHSIPLTINKEEALQRPVAS
VKLQTVHSIPLTIMKREAVQRPVAS

SEQ ID NO: 58264 - protein, 25 aa, synthetic construct
  source 1..25: note = Seed: VKLQTVHSIPLTINKEEALQRPVAS
VKLQTVHSIPLTIMKREAYQRPVAS

SEQ ID NO: 58265 - protein, 25 aa, synthetic construct
  source 1..25: note = Seed: VKLQTVHSIPLTINKEEALQRPVAS
VKLQTVHSIPLTIMKSEAAQRPVAS

SEQ ID NO: 58266 - protein, 25 aa, synthetic construct
  source 1..25: note = Seed: VKLQTVHSIPLTINKEEALQRPVAS
VKLQTVHSIPLTIMKSEAFQRPVAS

SEQ ID NO: 58267 - protein, 25 aa, synthetic construct
  source 1..25: note = Seed: VKLQTVHSIPLTINKEEALQRPVAS
VKLQTVHSIPLTIMKSEAIQRPVAS

SEQ ID NO: 58268 - protein, 25 aa, synthetic construct
  source 1..25: note = Seed: VKLQTVHSIPLTINKEEALQRPVAS
VKLQTVHSIPLTIMKSEALQRPVAS

SEQ ID NO: 58269 - protein, 25 aa, synthetic construct
  source 1..25: note = Seed: VKLQTVHSIPLTINKEEALQRPVAS
VKLQTVHSIPLTIMKSEAMQRPVAS

SEQ ID NO: 58270 - protein, 25 aa, synthetic construct
  source 1..25: note = Seed: VKLQTVHSIPLTINKEEALQRPVAS
VKLQTVHSIPLTIMKSEAVQRPVAS

SEQ ID NO: 58271 - protein, 25 aa, synthetic construct
  source 1..25: note = Seed: VKLQTVHSIPLTINKEEALQRPVAS
VKLQTVHSIPLTIMKTEAAQRPVAS

SEQ ID NO: 58272 - protein, 25 aa, synthetic construct
  source 1..25: note = Seed: VKLQTVHSIPLTINKEEALQRPVAS
VKLQTVHSIPLTIMKTEAFQRPVAS

SEQ ID NO: 58273 - protein, 25 aa, synthetic construct
  source 1..25: note = Seed: VKLQTVHSIPLTINKEEALQRPVAS
VKLQTVHSIPLTIMKTEAIQRPVAS

SEQ ID NO: 58274 - protein, 25 aa, synthetic construct
  source 1..25: note = Seed: VKLQTVHSIPLTINKEEALQRPVAS
VKLQTVHSIPLTIMKTEALQRPVAS

SEQ ID NO: 58275 - protein, 25 aa, synthetic construct
  source 1..25: note = Seed: VKLQTVHSIPLTINKEEALQRPVAS
VKLQTVHSIPLTIMKTEAMQRPVAS

SEQ ID NO: 58276 - protein, 25 aa, synthetic construct
  source 1..25: note = Seed: VKLQTVHSIPLTINKEEALQRPVAS
VKLQTVHSIPLTIMKTEAVQRPVAS

SEQ ID NO: 58277 - protein, 25 aa, synthetic construct
  source 1..25: note = Seed: VKLQTVHSIPLTINKEEALQRPVAS
VKLQTVHSIPLTIMKVEAAQRPVAS

SEQ ID NO: 58278 - protein, 25 aa, synthetic construct
  source 1..25: note = Seed: VKLQTVHSIPLTINKEEALQRPVAS
VKLQTVHSIPLTIMKVEAFQRPVAS

SEQ ID NO: 58279 - protein, 25 aa, synthetic construct
  source 1..25: note = Seed: VKLQTVHSIPLTINKEEALQRPVAS
VKLQTVHSIPLTIMKVEAIQRPVAS

SEQ ID NO: 58280 - protein, 25 aa, synthetic construct
  source 1..25: note = Seed: VKLQTVHSIPLTINKEEALQRPVAS
VKLQTVHSIPLTIMKVEALQRPVAS

SEQ ID NO: 58281 - protein, 25 aa, synthetic construct
  source 1..25: note = Seed: VKLQTVHSIPLTINKEEALQRPVAS
VKLQTVHSIPLTIMKVEAMQRPVAS

SEQ ID NO: 58282 - protein, 25 aa, synthetic construct
  source 1..25: note = Seed: VKLQTVHSIPLTINKEEALQRPVAS
VKLQTVHSIPLTIMKVEANQRPVAS

SEQ ID NO: 58283 - protein, 25 aa, synthetic construct
  source 1..25: note = Seed: VKLQTVHSIPLTINKEEALQRPVAS
VKLQTVHSIPLTIMKVEASQRPVAS

SEQ ID NO: 58284 - protein, 25 aa, synthetic construct
  source 1..25: note = Seed: VKLQTVHSIPLTINKEEALQRPVAS
VKLQTVHSIPLTIMKVEATQRPVAS

SEQ ID NO: 58285 - protein, 25 aa, synthetic construct
  source 1..25: note = Seed: VKLQTVHSIPLTINKEEALQRPVAS
VKLQTVHSIPLTIMKVEAVQRPVAS

SEQ ID NO: 58286 - protein, 25 aa, synthetic construct
  source 1..25: note = Seed: VKLQTVHSIPLTINKEEALQRPVAS
VKLQTVHSIPLTIMKVEAYQRPVAS

SEQ ID NO: 58287 - protein, 25 aa, synthetic construct
  source 1..25: note = Seed: VKLQTVHSIPLTINKEEALQRPVAS
VKLQTVHSIPLTIMKWEAFQRPVAS

SEQ ID NO: 58288 - protein, 25 aa, synthetic construct
  source 1..25: note = Seed: VKLQTVHSIPLTINKEEALQRPVAS
VKLQTVHSIPLTIMKWEAIQRPVAS

SEQ ID NO: 58289 - protein, 25 aa, synthetic construct
  source 1..25: note = Seed: VKLQTVHSIPLTINKEEALQRPVAS
VKLQTVHSIPLTIMKWEALQRPVAS

SEQ ID NO: 58290 - protein, 25 aa, synthetic construct
  source 1..25: note = Seed: VKLQTVHSIPLTINKEEALQRPVAS
VKLQTVHSIPLTIMKWEAMQRPVAS

SEQ ID NO: 58291 - protein, 25 aa, synthetic construct
  source 1..25: note = Seed: VKLQTVHSIPLTINKEEALQRPVAS
VKLQTVHSIPLTIMKWEAVQRPVAS

SEQ ID NO: 58292 - protein, 25 aa, synthetic construct
  source 1..25: note = Seed: VKLQTVHSIPLTINKEEALQRPVAS
VKLQTVHSIPLTIMKWEAYQRPVAS

SEQ ID NO: 58293 - protein, 25 aa, synthetic construct
  source 1..25: note = Seed: VKLQTVHSIPLTINKEEALQRPVAS
VKLQTVHSIPLTIMKYEAAQRPVAS

SEQ ID NO: 58294 - protein, 25 aa, synthetic construct
  source 1..25: note = Seed: VKLQTVHSIPLTINKEEALQRPVAS
VKLQTVHSIPLTIMKYEAFQRPVAS

SEQ ID NO: 58295 - protein, 25 aa, synthetic construct
  source 1..25: note = Seed: VKLQTVHSIPLTINKEEALQRPVAS
VKLQTVHSIPLTIMKYEAIQRPVAS

SEQ ID NO: 58296 - protein, 25 aa, synthetic construct
  source 1..25: note = Seed: VKLQTVHSIPLTINKEEALQRPVAS
VKLQTVHSIPLTIMKYEALQRPVAS

SEQ ID NO: 58297 - protein, 25 aa, synthetic construct
  source 1..25: note = Seed: VKLQTVHSIPLTINKEEALQRPVAS
VKLQTVHSIPLTIMKYEAMQRPVAS

SEQ ID NO: 58298 - protein, 25 aa, synthetic construct
  source 1..25: note = Seed: VKLQTVHSIPLTINKEEALQRPVAS
VKLQTVHSIPLTIMKYEAVQRPVAS

SEQ ID NO: 58299 - protein, 25 aa, synthetic construct
  source 1..25: note = Seed: VKLQTVHSIPLTINKEEALQRPVAS
VKLQTVHSIPLTIMKYEAWQRPVAS

SEQ ID NO: 58300 - protein, 25 aa, synthetic construct
  source 1..25: note = Seed: VKLQTVHSIPLTINKEEALQRPVAS
VKLQTVHSIPLTIMKYEAYQRPVAS

SEQ ID NO: 58301 - protein, 25 aa, synthetic construct
  source 1..25: note = Seed: VKLQTVHSIPLTINKEEALQRPVAS
VKLQTVHSIPLTINKAEAAQRPVAS

SEQ ID NO: 58302 - protein, 25 aa, synthetic construct
  source 1..25: note = Seed: VKLQTVHSIPLTINKEEALQRPVAS
VKLQTVHSIPLTINKAEAFQRPVAS

SEQ ID NO: 58303 - protein, 25 aa, synthetic construct
  source 1..25: note = Seed: VKLQTVHSIPLTINKEEALQRPVAS
VKLQTVHSIPLTINKAEAIQRPVAS

SEQ ID NO: 58304 - protein, 25 aa, synthetic construct
  source 1..25: note = Seed: VKLQTVHSIPLTINKEEALQRPVAS
VKLQTVHSIPLTINKAEAMQRPVAS

SEQ ID NO: 58305 - protein, 25 aa, synthetic construct
  source 1..25: note = Seed: VKLQTVHSIPLTINKEEALQRPVAS
VKLQTVHSIPLTINKAEASQRPVAS

SEQ ID NO: 58306 - protein, 25 aa, synthetic construct
  source 1..25: note = Seed: VKLQTVHSIPLTINKEEALQRPVAS
VKLQTVHSIPLTINKAEATQRPVAS

SEQ ID NO: 58307 - protein, 25 aa, synthetic construct
  source 1..25: note = Seed: VKLQTVHSIPLTINKEEALQRPVAS
VKLQTVHSIPLTINKAEAVQRPVAS

SEQ ID NO: 58308 - protein, 25 aa, synthetic construct
  source 1..25: note = Seed: VKLQTVHSIPLTINKEEALQRPVAS
VKLQTVHSIPLTINKAEAWQRPVAS

SEQ ID NO: 58309 - protein, 25 aa, synthetic construct
  source 1..25: note = Seed: VKLQTVHSIPLTINKEEALQRPVAS
VKLQTVHSIPLTINKAEAYQRPVAS

SEQ ID NO: 58310 - protein, 25 aa, synthetic construct
  source 1..25: note = Seed: VKLQTVHSIPLTINKEEALQRPVAS
VKLQTVHSIPLTINKFEAAQRPVAS

SEQ ID NO: 58311 - protein, 25 aa, synthetic construct
  source 1..25: note = Seed: VKLQTVHSIPLTINKEEALQRPVAS
VKLQTVHSIPLTINKFEAFQRPVAS

SEQ ID NO: 58312 - protein, 25 aa, synthetic construct
  source 1..25: note = Seed: VKLQTVHSIPLTINKEEALQRPVAS
VKLQTVHSIPLTINKFEAIQRPVAS

SEQ ID NO: 58313 - protein, 25 aa, synthetic construct
  source 1..25: note = Seed: VKLQTVHSIPLTINKEEALQRPVAS
VKLQTVHSIPLTINKFEAMQRPVAS

SEQ ID NO: 58314 - protein, 25 aa, synthetic construct
  source 1..25: note = Seed: VKLQTVHSIPLTINKEEALQRPVAS
VKLQTVHSIPLTINKFEANQRPVAS

SEQ ID NO: 58315 - protein, 25 aa, synthetic construct
  source 1..25: note = Seed: VKLQTVHSIPLTINKEEALQRPVAS
VKLQTVHSIPLTINKFEASQRPVAS

SEQ ID NO: 58316 - protein, 25 aa, synthetic construct
  source 1..25: note = Seed: VKLQTVHSIPLTINKEEALQRPVAS
VKLQTVHSIPLTINKFEATQRPVAS

SEQ ID NO: 58317 - protein, 25 aa, synthetic construct
  source 1..25: note = Seed: VKLQTVHSIPLTINKEEALQRPVAS
VKLQTVHSIPLTINKFEAVQRPVAS

SEQ ID NO: 58318 - protein, 25 aa, synthetic construct
  source 1..25: note = Seed: VKLQTVHSIPLTINKEEALQRPVAS
VKLQTVHSIPLTINKFEAWQRPVAS

SEQ ID NO: 58319 - protein, 25 aa, synthetic construct
  source 1..25: note = Seed: VKLQTVHSIPLTINKEEALQRPVAS
VKLQTVHSIPLTINKFEAYQRPVAS

SEQ ID NO: 58320 - protein, 25 aa, synthetic construct
  source 1..25: note = Seed: VKLQTVHSIPLTINKEEALQRPVAS
VKLQTVHSIPLTINKGEAAQRPVAS

SEQ ID NO: 58321 - protein, 25 aa, synthetic construct
  source 1..25: note = Seed: VKLQTVHSIPLTINKEEALQRPVAS
VKLQTVHSIPLTINKGEAFQRPVAS

SEQ ID NO: 58322 - protein, 25 aa, synthetic construct
  source 1..25: note = Seed: VKLQTVHSIPLTINKEEALQRPVAS
VKLQTVHSIPLTINKGEAIQRPVAS

SEQ ID NO: 58323 - protein, 25 aa, synthetic construct
  source 1..25: note = Seed: VKLQTVHSIPLTINKEEALQRPVAS
VKLQTVHSIPLTINKGEAMQRPVAS

SEQ ID NO: 58324 - protein, 25 aa, synthetic construct
  source 1..25: note = Seed: VKLQTVHSIPLTINKEEALQRPVAS
VKLQTVHSIPLTINKGEAVQRPVAS

SEQ ID NO: 58325 - protein, 25 aa, synthetic construct
  source 1..25: note = Seed: VKLQTVHSIPLTINKEEALQRPVAS
VKLQTVHSIPLTINKGEAYQRPVAS

SEQ ID NO: 58326 - protein, 25 aa, synthetic construct
  source 1..25: note = Seed: VKLQTVHSIPLTINKEEALQRPVAS
VKLQTVHSIPLTINKHEAIQRPVAS

SEQ ID NO: 58327 - protein, 25 aa, synthetic construct
  source 1..25: note = Seed: VKLQTVHSIPLTINKEEALQRPVAS
VKLQTVHSIPLTINKHEAVQRPVAS

SEQ ID NO: 58328 - protein, 25 aa, synthetic construct
  source 1..25: note = Seed: VKLQTVHSIPLTINKEEALQRPVAS
VKLQTVHSIPLTINKIEAAQRPVAS

SEQ ID NO: 58329 - protein, 25 aa, synthetic construct
  source 1..25: note = Seed: VKLQTVHSIPLTINKEEALQRPVAS
VKLQTVHSIPLTINKIEAFQRPVAS

SEQ ID NO: 58330 - protein, 25 aa, synthetic construct
  source 1..25: note = Seed: VKLQTVHSIPLTINKEEALQRPVAS
VKLQTVHSIPLTINKIEAIQRPVAS

SEQ ID NO: 58331 - protein, 25 aa, synthetic construct
  source 1..25: note = Seed: VKLQTVHSIPLTINKEEALQRPVAS
VKLQTVHSIPLTINKIEAMQRPVAS

SEQ ID NO: 58332 - protein, 25 aa, synthetic construct
  source 1..25: note = Seed: VKLQTVHSIPLTINKEEALQRPVAS
VKLQTVHSIPLTINKIEAVQRPVAS

SEQ ID NO: 58333 - protein, 25 aa, synthetic construct
  source 1..25: note = Seed: VKLQTVHSIPLTINKEEALQRPVAS
VKLQTVHSIPLTINKIEAYQRPVAS

SEQ ID NO: 58334 - protein, 25 aa, synthetic construct
  source 1..25: note = Seed: VKLQTVHSIPLTINKEEALQRPVAS
VKLQTVHSIPLTINKLEAFQRPVAS

SEQ ID NO: 58335 - protein, 25 aa, synthetic construct
  source 1..25: note = Seed: VKLQTVHSIPLTINKEEALQRPVAS
VKLQTVHSIPLTINKLEAIQRPVAS

SEQ ID NO: 58336 - protein, 25 aa, synthetic construct
  source 1..25: note = Seed: VKLQTVHSIPLTINKEEALQRPVAS
VKLQTVHSIPLTINKLEAVQRPVAS

SEQ ID NO: 58337 - protein, 25 aa, synthetic construct
  source 1..25: note = Seed: VKLQTVHSIPLTINKEEALQRPVAS
VKLQTVHSIPLTINKLEAYQRPVAS

SEQ ID NO: 58338 - protein, 25 aa, synthetic construct
  source 1..25: note = Seed: VKLQTVHSIPLTINKEEALQRPVAS
VKLQTVHSIPLTINKMEAFQRPVAS

SEQ ID NO: 58339 - protein, 25 aa, synthetic construct
  source 1..25: note = Seed: VKLQTVHSIPLTINKEEALQRPVAS
VKLQTVHSIPLTINKMEAIQRPVAS

SEQ ID NO: 58340 - protein, 25 aa, synthetic construct
  source 1..25: note = Seed: VKLQTVHSIPLTINKEEALQRPVAS
VKLQTVHSIPLTINKMEAVQRPVAS

SEQ ID NO: 58341 - protein, 25 aa, synthetic construct
  source 1..25: note = Seed: VKLQTVHSIPLTINKEEALQRPVAS
VKLQTVHSIPLTINKNEAAQRPVAS

SEQ ID NO: 58342 - protein, 25 aa, synthetic construct
  source 1..25: note = Seed: VKLQTVHSIPLTINKEEALQRPVAS
VKLQTVHSIPLTINKNEAFQRPVAS

SEQ ID NO: 58343 - protein, 25 aa, synthetic construct
  source 1..25: note = Seed: VKLQTVHSIPLTINKEEALQRPVAS
VKLQTVHSIPLTINKNEAIQRPVAS

SEQ ID NO: 58344 - protein, 25 aa, synthetic construct
  source 1..25: note = Seed: VKLQTVHSIPLTINKEEALQRPVAS
VKLQTVHSIPLTINKNEAMQRPVAS

SEQ ID NO: 58345 - protein, 25 aa, synthetic construct
  source 1..25: note = Seed: VKLQTVHSIPLTINKEEALQRPVAS
VKLQTVHSIPLTINKNEASQRPVAS

SEQ ID NO: 58346 - protein, 25 aa, synthetic construct
  source 1..25: note = Seed: VKLQTVHSIPLTINKEEALQRPVAS
VKLQTVHSIPLTINKNEATQRPVAS

SEQ ID NO: 58347 - protein, 25 aa, synthetic construct
  source 1..25: note = Seed: VKLQTVHSIPLTINKEEALQRPVAS
VKLQTVHSIPLTINKNEAVQRPVAS

SEQ ID NO: 58348 - protein, 25 aa, synthetic construct
  source 1..25: note = Seed: VKLQTVHSIPLTINKEEALQRPVAS
VKLQTVHSIPLTINKNEAWQRPVAS

SEQ ID NO: 58349 - protein, 25 aa, synthetic construct
  source 1..25: note = Seed: VKLQTVHSIPLTINKEEALQRPVAS
VKLQTVHSIPLTINKNEAYQRPVAS

SEQ ID NO: 58350 - protein, 25 aa, synthetic construct
  source 1..25: note = Seed: VKLQTVHSIPLTINKEEALQRPVAS
VKLQTVHSIPLTINKPEAFQRPVAS

SEQ ID NO: 58351 - protein, 25 aa, synthetic construct
  source 1..25: note = Seed: VKLQTVHSIPLTINKEEALQRPVAS
VKLQTVHSIPLTINKPEAIQRPVAS

SEQ ID NO: 58352 - protein, 25 aa, synthetic construct
  source 1..25: note = Seed: VKLQTVHSIPLTINKEEALQRPVAS
VKLQTVHSIPLTINKPEAMQRPVAS

SEQ ID NO: 58353 - protein, 25 aa, synthetic construct
  source 1..25: note = Seed: VKLQTVHSIPLTINKEEALQRPVAS
VKLQTVHSIPLTINKPEAVQRPVAS

SEQ ID NO: 58354 - protein, 25 aa, synthetic construct
  source 1..25: note = Seed: VKLQTVHSIPLTINKEEALQRPVAS
VKLQTVHSIPLTINKPEAYQRPVAS

SEQ ID NO: 58355 - protein, 25 aa, synthetic construct
  source 1..25: note = Seed: VKLQTVHSIPLTINKEEALQRPVAS
VKLQTVHSIPLTINKSEAAQRPVAS

SEQ ID NO: 58356 - protein, 25 aa, synthetic construct
  source 1..25: note = Seed: VKLQTVHSIPLTINKEEALQRPVAS
VKLQTVHSIPLTINKSEAFQRPVAS

SEQ ID NO: 58357 - protein, 25 aa, synthetic construct
  source 1..25: note = Seed: VKLQTVHSIPLTINKEEALQRPVAS
VKLQTVHSIPLTINKSEAIQRPVAS

SEQ ID NO: 58358 - protein, 25 aa, synthetic construct
  source 1..25: note = Seed: VKLQTVHSIPLTINKEEALQRPVAS
VKLQTVHSIPLTINKSEAMQRPVAS

SEQ ID NO: 58359 - protein, 25 aa, synthetic construct
  source 1..25: note = Seed: VKLQTVHSIPLTINKEEALQRPVAS
VKLQTVHSIPLTINKSEASQRPVAS

SEQ ID NO: 58360 - protein, 25 aa, synthetic construct
  source 1..25: note = Seed: VKLQTVHSIPLTINKEEALQRPVAS
VKLQTVHSIPLTINKSEATQRPVAS

SEQ ID NO: 58361 - protein, 25 aa, synthetic construct
  source 1..25: note = Seed: VKLQTVHSIPLTINKEEALQRPVAS
VKLQTVHSIPLTINKSEAVQRPVAS

SEQ ID NO: 58362 - protein, 25 aa, synthetic construct
  source 1..25: note = Seed: VKLQTVHSIPLTINKEEALQRPVAS
VKLQTVHSIPLTINKSEAWQRPVAS

SEQ ID NO: 58363 - protein, 25 aa, synthetic construct
  source 1..25: note = Seed: VKLQTVHSIPLTINKEEALQRPVAS
VKLQTVHSIPLTINKSEAYQRPVAS

SEQ ID NO: 58364 - protein, 25 aa, synthetic construct
  source 1..25: note = Seed: VKLQTVHSIPLTINKEEALQRPVAS
VKLQTVHSIPLTINKTEAFQRPVAS

SEQ ID NO: 58365 - protein, 25 aa, synthetic construct
  source 1..25: note = Seed: VKLQTVHSIPLTINKEEALQRPVAS
VKLQTVHSIPLTINKTEAIQRPVAS

SEQ ID NO: 58366 - protein, 25 aa, synthetic construct
  source 1..25: note = Seed: VKLQTVHSIPLTINKEEALQRPVAS
VKLQTVHSIPLTINKTEAMQRPVAS

SEQ ID NO: 58367 - protein, 25 aa, synthetic construct
  source 1..25: note = Seed: VKLQTVHSIPLTINKEEALQRPVAS
VKLQTVHSIPLTINKTEAVQRPVAS

SEQ ID NO: 58368 - protein, 25 aa, synthetic construct
  source 1..25: note = Seed: VKLQTVHSIPLTINKEEALQRPVAS
VKLQTVHSIPLTINKTEAYQRPVAS

SEQ ID NO: 58369 - protein, 25 aa, synthetic construct
  source 1..25: note = Seed: VKLQTVHSIPLTINKEEALQRPVAS
VKLQTVHSIPLTINKVEAAQRPVAS

SEQ ID NO: 58370 - protein, 25 aa, synthetic construct
  source 1..25: note = Seed: VKLQTVHSIPLTINKEEALQRPVAS
VKLQTVHSIPLTINKVEAFQRPVAS

SEQ ID NO: 58371 - protein, 25 aa, synthetic construct
  source 1..25: note = Seed: VKLQTVHSIPLTINKEEALQRPVAS
VKLQTVHSIPLTINKVEAIQRPVAS

SEQ ID NO: 58372 - protein, 25 aa, synthetic construct
  source 1..25: note = Seed: VKLQTVHSIPLTINKEEALQRPVAS
VKLQTVHSIPLTINKVEAMQRPVAS

SEQ ID NO: 58373 - protein, 25 aa, synthetic construct
  source 1..25: note = Seed: VKLQTVHSIPLTINKEEALQRPVAS
VKLQTVHSIPLTINKVEAVQRPVAS

SEQ ID NO: 58374 - protein, 25 aa, synthetic construct
  source 1..25: note = Seed: VKLQTVHSIPLTINKEEALQRPVAS
VKLQTVHSIPLTINKVEAYQRPVAS

SEQ ID NO: 58375 - protein, 25 aa, synthetic construct
  source 1..25: note = Seed: VKLQTVHSIPLTINKEEALQRPVAS
VKLQTVHSIPLTINKYEAIQRPVAS

SEQ ID NO: 58376 - protein, 25 aa, synthetic construct
  source 1..25: note = Seed: VKLQTVHSIPLTINKEEALQRPVAS
VKLQTVHSIPLTINKYEAVQRPVAS

SEQ ID NO: 58377 - protein, 25 aa, synthetic construct
  source 1..25: note = Seed: VKLQTVHSIPLTINKEEALQRPVAS
VKLQTVHSIPLTIPKFEAIQRPVAS

SEQ ID NO: 58378 - protein, 25 aa, synthetic construct
  source 1..25: note = Seed: VKLQTVHSIPLTINKEEALQRPVAS
VKLQTVHSIPLTIPKFEALQRPVAS

SEQ ID NO: 58379 - protein, 25 aa, synthetic construct
  source 1..25: note = Seed: VKLQTVHSIPLTINKEEALQRPVAS
VKLQTVHSIPLTIQKFEAAQRPVAS

SEQ ID NO: 58380 - protein, 25 aa, synthetic construct
  source 1..25: note = Seed: VKLQTVHSIPLTINKEEALQRPVAS
VKLQTVHSIPLTIQKFEACQRPVAS

SEQ ID NO: 58381 - protein, 25 aa, synthetic construct
  source 1..25: note = Seed: VKLQTVHSIPLTINKEEALQRPVAS
VKLQTVHSIPLTIQKFEAEQRPVAS

SEQ ID NO: 58382 - protein, 25 aa, synthetic construct
  source 1..25: note = Seed: VKLQTVHSIPLTINKEEALQRPVAS
VKLQTVHSIPLTIQKFEAFQRPVAS

SEQ ID NO: 58383 - protein, 25 aa, synthetic construct
  source 1..25: note = Seed: VKLQTVHSIPLTINKEEALQRPVAS
VKLQTVHSIPLTIQKFEAIQRPVAS

SEQ ID NO: 58384 - protein, 25 aa, synthetic construct
  source 1..25: note = Seed: VKLQTVHSIPLTINKEEALQRPVAS
VKLQTVHSIPLTIQKFEALQRPVAS

SEQ ID NO: 58385 - protein, 25 aa, synthetic construct
  source 1..25: note = Seed: VKLQTVHSIPLTINKEEALQRPVAS
VKLQTVHSIPLTIQKFEAMQRPVAS

SEQ ID NO: 58386 - protein, 25 aa, synthetic construct
  source 1..25: note = Seed: VKLQTVHSIPLTINKEEALQRPVAS
VKLQTVHSIPLTIQKFEANQRPVAS

SEQ ID NO: 58387 - protein, 25 aa, synthetic construct
  source 1..25: note = Seed: VKLQTVHSIPLTINKEEALQRPVAS
VKLQTVHSIPLTIQKFEASQRPVAS

SEQ ID NO: 58388 - protein, 25 aa, synthetic construct
  source 1..25: note = Seed: VKLQTVHSIPLTINKEEALQRPVAS
VKLQTVHSIPLTIQKFEATQRPVAS

SEQ ID NO: 58389 - protein, 25 aa, synthetic construct
  source 1..25: note = Seed: VKLQTVHSIPLTINKEEALQRPVAS
VKLQTVHSIPLTIQKFEAVQRPVAS

SEQ ID NO: 58390 - protein, 25 aa, synthetic construct
  source 1..25: note = Seed: VKLQTVHSIPLTINKEEALQRPVAS
VKLQTVHSIPLTIQKFEAWQRPVAS

SEQ ID NO: 58391 - protein, 25 aa, synthetic construct
  source 1..25: note = Seed: VKLQTVHSIPLTINKEEALQRPVAS
VKLQTVHSIPLTIQKFEAYQRPVAS

SEQ ID NO: 58392 - protein, 25 aa, synthetic construct
  source 1..25: note = Seed: VKLQTVHSIPLTINKEEALQRPVAS
VKLQTVHSIPLTIQKIEAIQRPVAS

SEQ ID NO: 58393 - protein, 25 aa, synthetic construct
  source 1..25: note = Seed: VKLQTVHSIPLTINKEEALQRPVAS
VKLQTVHSIPLTIQKIEALQRPVAS

SEQ ID NO: 58394 - protein, 25 aa, synthetic construct
  source 1..25: note = Seed: VKLQTVHSIPLTINKEEALQRPVAS
VKLQTVHSIPLTIQKIEAVQRPVAS

SEQ ID NO: 58395 - protein, 25 aa, synthetic construct
  source 1..25: note = Seed: VKLQTVHSIPLTINKEEALQRPVAS
VKLQTVHSIPLTIQKLEAFQRPVAS

SEQ ID NO: 58396 - protein, 25 aa, synthetic construct
  source 1..25: note = Seed: VKLQTVHSIPLTINKEEALQRPVAS
VKLQTVHSIPLTIQKLEAIQRPVAS

SEQ ID NO: 58397 - protein, 25 aa, synthetic construct
  source 1..25: note = Seed: VKLQTVHSIPLTINKEEALQRPVAS
VKLQTVHSIPLTIQKLEALQRPVAS

SEQ ID NO: 58398 - protein, 25 aa, synthetic construct
  source 1..25: note = Seed: VKLQTVHSIPLTINKEEALQRPVAS
VKLQTVHSIPLTIQKLEAVQRPVAS

SEQ ID NO: 58399 - protein, 25 aa, synthetic construct
  source 1..25: note = Seed: VKLQTVHSIPLTINKEEALQRPVAS
VKLQTVHSIPLTIQKNEAIQRPVAS

SEQ ID NO: 58400 - protein, 25 aa, synthetic construct
  source 1..25: note = Seed: VKLQTVHSIPLTINKEEALQRPVAS
VKLQTVHSIPLTIQKNEAVQRPVAS

SEQ ID NO: 58401 - protein, 25 aa, synthetic construct
  source 1..25: note = Seed: VKLQTVHSIPLTINKEEALQRPVAS
VKLQTVHSIPLTIQKREAFQRPVAS

SEQ ID NO: 58402 - protein, 25 aa, synthetic construct
  source 1..25: note = Seed: VKLQTVHSIPLTINKEEALQRPVAS
VKLQTVHSIPLTIQKWEAFQRPVAS

SEQ ID NO: 58403 - protein, 25 aa, synthetic construct
  source 1..25: note = Seed: VKLQTVHSIPLTINKEEALQRPVAS
VKLQTVHSIPLTIQKWEAIQRPVAS

SEQ ID NO: 58404 - protein, 25 aa, synthetic construct
  source 1..25: note = Seed: VKLQTVHSIPLTINKEEALQRPVAS
VKLQTVHSIPLTIQKWEALQRPVAS

SEQ ID NO: 58405 - protein, 25 aa, synthetic construct
  source 1..25: note = Seed: VKLQTVHSIPLTINKEEALQRPVAS
VKLQTVHSIPLTIQKWEAVQRPVAS

SEQ ID NO: 58406 - protein, 25 aa, synthetic construct
  source 1..25: note = Seed: VKLQTVHSIPLTINKEEALQRPVAS
VKLQTVHSIPLTIQKYEAFQRPVAS

SEQ ID NO: 58407 - protein, 25 aa, synthetic construct
  source 1..25: note = Seed: VKLQTVHSIPLTINKEEALQRPVAS
VKLQTVHSIPLTIQKYEAIQRPVAS

SEQ ID NO: 58408 - protein, 25 aa, synthetic construct
  source 1..25: note = Seed: VKLQTVHSIPLTINKEEALQRPVAS
VKLQTVHSIPLTIQKYEALQRPVAS

SEQ ID NO: 58409 - protein, 25 aa, synthetic construct
  source 1..25: note = Seed: VKLQTVHSIPLTINKEEALQRPVAS
VKLQTVHSIPLTIQKYEAVQRPVAS

SEQ ID NO: 58410 - protein, 25 aa, synthetic construct
  source 1..25: note = Seed: VKLQTVHSIPLTINKEEALQRPVAS
VKLQTVHSIPLTIRKAEAFQRPVAS

SEQ ID NO: 58411 - protein, 25 aa, synthetic construct
  source 1..25: note = Seed: VKLQTVHSIPLTINKEEALQRPVAS
VKLQTVHSIPLTIRKFEAFQRPVAS

SEQ ID NO: 58412 - protein, 25 aa, synthetic construct
  source 1..25: note = Seed: VKLQTVHSIPLTINKEEALQRPVAS
VKLQTVHSIPLTIRKFEAIQRPVAS

SEQ ID NO: 58413 - protein, 25 aa, synthetic construct
  source 1..25: note = Seed: VKLQTVHSIPLTINKEEALQRPVAS
VKLQTVHSIPLTIRKFEALQRPVAS

SEQ ID NO: 58414 - protein, 25 aa, synthetic construct
  source 1..25: note = Seed: VKLQTVHSIPLTINKEEALQRPVAS
VKLQTVHSIPLTIRKFEAMQRPVAS

SEQ ID NO: 58415 - protein, 25 aa, synthetic construct
  source 1..25: note = Seed: VKLQTVHSIPLTINKEEALQRPVAS
VKLQTVHSIPLTIRKFEAVQRPVAS

SEQ ID NO: 58416 - protein, 25 aa, synthetic construct
  source 1..25: note = Seed: VKLQTVHSIPLTINKEEALQRPVAS
VKLQTVHSIPLTIRKREAFQRPVAS

SEQ ID NO: 58417 - protein, 25 aa, synthetic construct
  source 1..25: note = Seed: VKLQTVHSIPLTINKEEALQRPVAS
VKLQTVHSIPLTIRKREAIQRPVAS

SEQ ID NO: 58418 - protein, 25 aa, synthetic construct
  source 1..25: note = Seed: VKLQTVHSIPLTINKEEALQRPVAS
VKLQTVHSIPLTIRKREALQRPVAS

SEQ ID NO: 58419 - protein, 25 aa, synthetic construct
  source 1..25: note = Seed: VKLQTVHSIPLTINKEEALQRPVAS
VKLQTVHSIPLTIRKREAMQRPVAS

SEQ ID NO: 58420 - protein, 25 aa, synthetic construct
  source 1..25: note = Seed: VKLQTVHSIPLTINKEEALQRPVAS
VKLQTVHSIPLTIRKREAVQRPVAS

SEQ ID NO: 58421 - protein, 25 aa, synthetic construct
  source 1..25: note = Seed: VKLQTVHSIPLTINKEEALQRPVAS
VKLQTVHSIPLTIRKSEAFQRPVAS

SEQ ID NO: 58422 - protein, 25 aa, synthetic construct
  source 1..25: note = Seed: VKLQTVHSIPLTINKEEALQRPVAS
VKLQTVHSIPLTIRKVEARQRPVAS

SEQ ID NO: 58423 - protein, 25 aa, synthetic construct
  source 1..25: note = Seed: VKLQTVHSIPLTINKEEALQRPVAS
VKLQTVHSIPLTIRKVEAYQRPVAS

SEQ ID NO: 58424 - protein, 25 aa, synthetic construct
  source 1..25: note = Seed: VKLQTVHSIPLTINKEEALQRPVAS
VKLQTVHSIPLTISKAEAIQRPVAS

SEQ ID NO: 58425 - protein, 25 aa, synthetic construct
  source 1..25: note = Seed: VKLQTVHSIPLTINKEEALQRPVAS
VKLQTVHSIPLTISKAEALQRPVAS

SEQ ID NO: 58426 - protein, 25 aa, synthetic construct
  source 1..25: note = Seed: VKLQTVHSIPLTINKEEALQRPVAS
VKLQTVHSIPLTISKAEAVQRPVAS

SEQ ID NO: 58427 - protein, 25 aa, synthetic construct
  source 1..25: note = Seed: VKLQTVHSIPLTINKEEALQRPVAS
VKLQTVHSIPLTISKFEAAQRPVAS

SEQ ID NO: 58428 - protein, 25 aa, synthetic construct
  source 1..25: note = Seed: VKLQTVHSIPLTINKEEALQRPVAS
VKLQTVHSIPLTISKFEACQRPVAS

SEQ ID NO: 58429 - protein, 25 aa, synthetic construct
  source 1..25: note = Seed: VKLQTVHSIPLTINKEEALQRPVAS
VKLQTVHSIPLTISKFEADQRPVAS

SEQ ID NO: 58430 - protein, 25 aa, synthetic construct
  source 1..25: note = Seed: VKLQTVHSIPLTINKEEALQRPVAS
VKLQTVHSIPLTISKFEAEQRPVAS

SEQ ID NO: 58431 - protein, 25 aa, synthetic construct
  source 1..25: note = Seed: VKLQTVHSIPLTINKEEALQRPVAS
VKLQTVHSIPLTISKFEAFQRPVAS

SEQ ID NO: 58432 - protein, 25 aa, synthetic construct
  source 1..25: note = Seed: VKLQTVHSIPLTINKEEALQRPVAS
VKLQTVHSIPLTISKFEAHQRPVAS

SEQ ID NO: 58433 - protein, 25 aa, synthetic construct
  source 1..25: note = Seed: VKLQTVHSIPLTINKEEALQRPVAS
VKLQTVHSIPLTISKFEAIQRPVAS

SEQ ID NO: 58434 - protein, 25 aa, synthetic construct
  source 1..25: note = Seed: VKLQTVHSIPLTINKEEALQRPVAS
VKLQTVHSIPLTISKFEALQRPVAS

SEQ ID NO: 58435 - protein, 25 aa, synthetic construct
  source 1..25: note = Seed: VKLQTVHSIPLTINKEEALQRPVAS
VKLQTVHSIPLTISKFEAMQRPVAS

SEQ ID NO: 58436 - protein, 25 aa, synthetic construct
  source 1..25: note = Seed: VKLQTVHSIPLTINKEEALQRPVAS
VKLQTVHSIPLTISKFEANQRPVAS

SEQ ID NO: 58437 - protein, 25 aa, synthetic construct
  source 1..25: note = Seed: VKLQTVHSIPLTINKEEALQRPVAS
VKLQTVHSIPLTISKFEAPQRPVAS

SEQ ID NO: 58438 - protein, 25 aa, synthetic construct
  source 1..25: note = Seed: VKLQTVHSIPLTINKEEALQRPVAS
VKLQTVHSIPLTISKFEAQQRPVAS

SEQ ID NO: 58439 - protein, 25 aa, synthetic construct
  source 1..25: note = Seed: VKLQTVHSIPLTINKEEALQRPVAS
VKLQTVHSIPLTISKFEASQRPVAS

SEQ ID NO: 58440 - protein, 25 aa, synthetic construct
  source 1..25: note = Seed: VKLQTVHSIPLTINKEEALQRPVAS
VKLQTVHSIPLTISKFEATQRPVAS

SEQ ID NO: 58441 - protein, 25 aa, synthetic construct
  source 1..25: note = Seed: VKLQTVHSIPLTINKEEALQRPVAS
VKLQTVHSIPLTISKFEAVQRPVAS

SEQ ID NO: 58442 - protein, 25 aa, synthetic construct
  source 1..25: note = Seed: VKLQTVHSIPLTINKEEALQRPVAS
VKLQTVHSIPLTISKFEAWQRPVAS

SEQ ID NO: 58443 - protein, 25 aa, synthetic construct
  source 1..25: note = Seed: VKLQTVHSIPLTINKEEALQRPVAS
VKLQTVHSIPLTISKFEAYQRPVAS

SEQ ID NO: 58444 - protein, 25 aa, synthetic construct
  source 1..25: note = Seed: VKLQTVHSIPLTINKEEALQRPVAS
VKLQTVHSIPLTISKIEAAQRPVAS

SEQ ID NO: 58445 - protein, 25 aa, synthetic construct
  source 1..25: note = Seed: VKLQTVHSIPLTINKEEALQRPVAS
VKLQTVHSIPLTISKIEAFQRPVAS

SEQ ID NO: 58446 - protein, 25 aa, synthetic construct
  source 1..25: note = Seed: VKLQTVHSIPLTINKEEALQRPVAS
VKLQTVHSIPLTISKIEAIQRPVAS

SEQ ID NO: 58447 - protein, 25 aa, synthetic construct
  source 1..25: note = Seed: VKLQTVHSIPLTINKEEALQRPVAS
VKLQTVHSIPLTISKIEALQRPVAS

SEQ ID NO: 58448 - protein, 25 aa, synthetic construct
  source 1..25: note = Seed: VKLQTVHSIPLTINKEEALQRPVAS
VKLQTVHSIPLTISKIEAMQRPVAS

SEQ ID NO: 58449 - protein, 25 aa, synthetic construct
  source 1..25: note = Seed: VKLQTVHSIPLTINKEEALQRPVAS
VKLQTVHSIPLTISKIEASQRPVAS

SEQ ID NO: 58450 - protein, 25 aa, synthetic construct
  source 1..25: note = Seed: VKLQTVHSIPLTINKEEALQRPVAS
VKLQTVHSIPLTISKIEAVQRPVAS

SEQ ID NO: 58451 - protein, 25 aa, synthetic construct
  source 1..25: note = Seed: VKLQTVHSIPLTINKEEALQRPVAS
VKLQTVHSIPLTISKIEAYQRPVAS

SEQ ID NO: 58452 - protein, 25 aa, synthetic construct
  source 1..25: note = Seed: VKLQTVHSIPLTINKEEALQRPVAS
VKLQTVHSIPLTISKLEAFQRPVAS

SEQ ID NO: 58453 - protein, 25 aa, synthetic construct
  source 1..25: note = Seed: VKLQTVHSIPLTINKEEALQRPVAS
VKLQTVHSIPLTISKLEAIQRPVAS

SEQ ID NO: 58454 - protein, 25 aa, synthetic construct
  source 1..25: note = Seed: VKLQTVHSIPLTINKEEALQRPVAS
VKLQTVHSIPLTISKLEALQRPVAS

SEQ ID NO: 58455 - protein, 25 aa, synthetic construct
  source 1..25: note = Seed: VKLQTVHSIPLTINKEEALQRPVAS
VKLQTVHSIPLTISKLEAMQRPVAS

SEQ ID NO: 58456 - protein, 25 aa, synthetic construct
  source 1..25: note = Seed: VKLQTVHSIPLTINKEEALQRPVAS
VKLQTVHSIPLTISKLEAVQRPVAS

SEQ ID NO: 58457 - protein, 25 aa, synthetic construct
  source 1..25: note = Seed: VKLQTVHSIPLTINKEEALQRPVAS
VKLQTVHSIPLTISKNEAFQRPVAS

SEQ ID NO: 58458 - protein, 25 aa, synthetic construct
  source 1..25: note = Seed: VKLQTVHSIPLTINKEEALQRPVAS
VKLQTVHSIPLTISKNEAIQRPVAS

SEQ ID NO: 58459 - protein, 25 aa, synthetic construct
  source 1..25: note = Seed: VKLQTVHSIPLTINKEEALQRPVAS
VKLQTVHSIPLTISKNEALQRPVAS

SEQ ID NO: 58460 - protein, 25 aa, synthetic construct
  source 1..25: note = Seed: VKLQTVHSIPLTINKEEALQRPVAS
VKLQTVHSIPLTISKNEAVQRPVAS

SEQ ID NO: 58461 - protein, 25 aa, synthetic construct
  source 1..25: note = Seed: VKLQTVHSIPLTINKEEALQRPVAS
VKLQTVHSIPLTISKSEAIQRPVAS

SEQ ID NO: 58462 - protein, 25 aa, synthetic construct
  source 1..25: note = Seed: VKLQTVHSIPLTINKEEALQRPVAS
VKLQTVHSIPLTISKSEAVQRPVAS

SEQ ID NO: 58463 - protein, 25 aa, synthetic construct
  source 1..25: note = Seed: VKLQTVHSIPLTINKEEALQRPVAS
VKLQTVHSIPLTISKVEAAQRPVAS

SEQ ID NO: 58464 - protein, 25 aa, synthetic construct
  source 1..25: note = Seed: VKLQTVHSIPLTINKEEALQRPVAS
VKLQTVHSIPLTISKVEAFQRPVAS

SEQ ID NO: 58465 - protein, 25 aa, synthetic construct
  source 1..25: note = Seed: VKLQTVHSIPLTINKEEALQRPVAS
VKLQTVHSIPLTISKVEAIQRPVAS

SEQ ID NO: 58466 - protein, 25 aa, synthetic construct
  source 1..25: note = Seed: VKLQTVHSIPLTINKEEALQRPVAS
VKLQTVHSIPLTISKVEALQRPVAS

SEQ ID NO: 58467 - protein, 25 aa, synthetic construct
  source 1..25: note = Seed: VKLQTVHSIPLTINKEEALQRPVAS
VKLQTVHSIPLTISKVEAMQRPVAS

SEQ ID NO: 58468 - protein, 25 aa, synthetic construct
  source 1..25: note = Seed: VKLQTVHSIPLTINKEEALQRPVAS
VKLQTVHSIPLTISKVEAVQRPVAS

SEQ ID NO: 58469 - protein, 25 aa, synthetic construct
  source 1..25: note = Seed: VKLQTVHSIPLTINKEEALQRPVAS
VKLQTVHSIPLTISKWEAFQRPVAS

SEQ ID NO: 58470 - protein, 25 aa, synthetic construct
  source 1..25: note = Seed: VKLQTVHSIPLTINKEEALQRPVAS
VKLQTVHSIPLTISKWEAIQRPVAS

SEQ ID NO: 58471 - protein, 25 aa, synthetic construct
  source 1..25: note = Seed: VKLQTVHSIPLTINKEEALQRPVAS
VKLQTVHSIPLTISKWEALQRPVAS

SEQ ID NO: 58472 - protein, 25 aa, synthetic construct
  source 1..25: note = Seed: VKLQTVHSIPLTINKEEALQRPVAS
VKLQTVHSIPLTISKWEAMQRPVAS

SEQ ID NO: 58473 - protein, 25 aa, synthetic construct
  source 1..25: note = Seed: VKLQTVHSIPLTINKEEALQRPVAS
VKLQTVHSIPLTISKWEAVQRPVAS

SEQ ID NO: 58474 - protein, 25 aa, synthetic construct
  source 1..25: note = Seed: VKLQTVHSIPLTINKEEALQRPVAS
VKLQTVHSIPLTISKYEAFQRPVAS

SEQ ID NO: 58475 - protein, 25 aa, synthetic construct
  source 1..25: note = Seed: VKLQTVHSIPLTINKEEALQRPVAS
VKLQTVHSIPLTISKYEAIQRPVAS

SEQ ID NO: 58476 - protein, 25 aa, synthetic construct
  source 1..25: note = Seed: VKLQTVHSIPLTINKEEALQRPVAS
VKLQTVHSIPLTISKYEALQRPVAS

SEQ ID NO: 58477 - protein, 25 aa, synthetic construct
  source 1..25: note = Seed: VKLQTVHSIPLTINKEEALQRPVAS
VKLQTVHSIPLTISKYEAMQRPVAS

SEQ ID NO: 58478 - protein, 25 aa, synthetic construct
  source 1..25: note = Seed: VKLQTVHSIPLTINKEEALQRPVAS
VKLQTVHSIPLTISKYEAVQRPVAS

SEQ ID NO: 58479 - protein, 25 aa, synthetic construct
  source 1..25: note = Seed: VKLQTVHSIPLTINKEEALQRPVAS
VKLQTVHSIPLTITKFEAAQRPVAS

SEQ ID NO: 58480 - protein, 25 aa, synthetic construct
  source 1..25: note = Seed: VKLQTVHSIPLTINKEEALQRPVAS
VKLQTVHSIPLTITKFEACQRPVAS

SEQ ID NO: 58481 - protein, 25 aa, synthetic construct
  source 1..25: note = Seed: VKLQTVHSIPLTINKEEALQRPVAS
VKLQTVHSIPLTITKFEADQRPVAS

SEQ ID NO: 58482 - protein, 25 aa, synthetic construct
  source 1..25: note = Seed: VKLQTVHSIPLTINKEEALQRPVAS
VKLQTVHSIPLTITKFEAEQRPVAS

SEQ ID NO: 58483 - protein, 25 aa, synthetic construct
  source 1..25: note = Seed: VKLQTVHSIPLTINKEEALQRPVAS
VKLQTVHSIPLTITKFEAFQRPVAS

SEQ ID NO: 58484 - protein, 25 aa, synthetic construct
  source 1..25: note = Seed: VKLQTVHSIPLTINKEEALQRPVAS
VKLQTVHSIPLTITKFEAHQRPVAS

SEQ ID NO: 58485 - protein, 25 aa, synthetic construct
  source 1..25: note = Seed: VKLQTVHSIPLTINKEEALQRPVAS
VKLQTVHSIPLTITKFEAIQRPVAS

SEQ ID NO: 58486 - protein, 25 aa, synthetic construct
  source 1..25: note = Seed: VKLQTVHSIPLTINKEEALQRPVAS
VKLQTVHSIPLTITKFEALQRPVAS

SEQ ID NO: 58487 - protein, 25 aa, synthetic construct
  source 1..25: note = Seed: VKLQTVHSIPLTINKEEALQRPVAS
VKLQTVHSIPLTITKFEAMQRPVAS

SEQ ID NO: 58488 - protein, 25 aa, synthetic construct
  source 1..25: note = Seed: VKLQTVHSIPLTINKEEALQRPVAS
VKLQTVHSIPLTITKFEANQRPVAS

SEQ ID NO: 58489 - protein, 25 aa, synthetic construct
  source 1..25: note = Seed: VKLQTVHSIPLTINKEEALQRPVAS
VKLQTVHSIPLTITKFEAPQRPVAS

SEQ ID NO: 58490 - protein, 25 aa, synthetic construct
  source 1..25: note = Seed: VKLQTVHSIPLTINKEEALQRPVAS
VKLQTVHSIPLTITKFEAQQRPVAS

SEQ ID NO: 58491 - protein, 25 aa, synthetic construct
  source 1..25: note = Seed: VKLQTVHSIPLTINKEEALQRPVAS
VKLQTVHSIPLTITKFEASQRPVAS

SEQ ID NO: 58492 - protein, 25 aa, synthetic construct
  source 1..25: note = Seed: VKLQTVHSIPLTINKEEALQRPVAS
VKLQTVHSIPLTITKFEATQRPVAS

SEQ ID NO: 58493 - protein, 25 aa, synthetic construct
  source 1..25: note = Seed: VKLQTVHSIPLTINKEEALQRPVAS
VKLQTVHSIPLTITKFEAVQRPVAS

SEQ ID NO: 58494 - protein, 25 aa, synthetic construct
  source 1..25: note = Seed: VKLQTVHSIPLTINKEEALQRPVAS
VKLQTVHSIPLTITKFEAWQRPVAS

SEQ ID NO: 58495 - protein, 25 aa, synthetic construct
  source 1..25: note = Seed: VKLQTVHSIPLTINKEEALQRPVAS
VKLQTVHSIPLTITKFEAYQRPVAS

SEQ ID NO: 58496 - protein, 25 aa, synthetic construct
  source 1..25: note = Seed: VKLQTVHSIPLTINKEEALQRPVAS
VKLQTVHSIPLTITKIEAAQRPVAS

SEQ ID NO: 58497 - protein, 25 aa, synthetic construct
  source 1..25: note = Seed: VKLQTVHSIPLTINKEEALQRPVAS
VKLQTVHSIPLTITKIEAFQRPVAS

SEQ ID NO: 58498 - protein, 25 aa, synthetic construct
  source 1..25: note = Seed: VKLQTVHSIPLTINKEEALQRPVAS
VKLQTVHSIPLTITKIEAIQRPVAS

SEQ ID NO: 58499 - protein, 25 aa, synthetic construct
  source 1..25: note = Seed: VKLQTVHSIPLTINKEEALQRPVAS
VKLQTVHSIPLTITKIEALQRPVAS

SEQ ID NO: 58500 - protein, 25 aa, synthetic construct
  source 1..25: note = Seed: VKLQTVHSIPLTINKEEALQRPVAS
VKLQTVHSIPLTITKIEAVQRPVAS

SEQ ID NO: 58501 - protein, 25 aa, synthetic construct
  source 1..25: note = Seed: VKLQTVHSIPLTINKEEALQRPVAS
VKLQTVHSIPLTITKLEAAQRPVAS

SEQ ID NO: 58502 - protein, 25 aa, synthetic construct
  source 1..25: note = Seed: VKLQTVHSIPLTINKEEALQRPVAS
VKLQTVHSIPLTITKLEAFQRPVAS

SEQ ID NO: 58503 - protein, 25 aa, synthetic construct
  source 1..25: note = Seed: VKLQTVHSIPLTINKEEALQRPVAS
VKLQTVHSIPLTITKLEAIQRPVAS

SEQ ID NO: 58504 - protein, 25 aa, synthetic construct
  source 1..25: note = Seed: VKLQTVHSIPLTINKEEALQRPVAS
VKLQTVHSIPLTITKLEALQRPVAS

SEQ ID NO: 58505 - protein, 25 aa, synthetic construct
  source 1..25: note = Seed: VKLQTVHSIPLTINKEEALQRPVAS
VKLQTVHSIPLTITKLEAMQRPVAS

SEQ ID NO: 58506 - protein, 25 aa, synthetic construct
  source 1..25: note = Seed: VKLQTVHSIPLTINKEEALQRPVAS
VKLQTVHSIPLTITKLEAVQRPVAS

SEQ ID NO: 58507 - protein, 25 aa, synthetic construct
  source 1..25: note = Seed: VKLQTVHSIPLTINKEEALQRPVAS
VKLQTVHSIPLTITKMEAIQRPVAS

SEQ ID NO: 58508 - protein, 25 aa, synthetic construct
  source 1..25: note = Seed: VKLQTVHSIPLTINKEEALQRPVAS
VKLQTVHSIPLTITKMEALQRPVAS

SEQ ID NO: 58509 - protein, 25 aa, synthetic construct
  source 1..25: note = Seed: VKLQTVHSIPLTINKEEALQRPVAS
VKLQTVHSIPLTITKMEAVQRPVAS

SEQ ID NO: 58510 - protein, 25 aa, synthetic construct
  source 1..25: note = Seed: VKLQTVHSIPLTINKEEALQRPVAS
VKLQTVHSIPLTITKNEAIQRPVAS

SEQ ID NO: 58511 - protein, 25 aa, synthetic construct
  source 1..25: note = Seed: VKLQTVHSIPLTINKEEALQRPVAS
VKLQTVHSIPLTITKNEAVQRPVAS

SEQ ID NO: 58512 - protein, 25 aa, synthetic construct
  source 1..25: note = Seed: VKLQTVHSIPLTINKEEALQRPVAS
VKLQTVHSIPLTITKWEAFQRPVAS

SEQ ID NO: 58513 - protein, 25 aa, synthetic construct
  source 1..25: note = Seed: VKLQTVHSIPLTINKEEALQRPVAS
VKLQTVHSIPLTITKWEAIQRPVAS

SEQ ID NO: 58514 - protein, 25 aa, synthetic construct
  source 1..25: note = Seed: VKLQTVHSIPLTINKEEALQRPVAS
VKLQTVHSIPLTITKWEALQRPVAS

SEQ ID NO: 58515 - protein, 25 aa, synthetic construct
  source 1..25: note = Seed: VKLQTVHSIPLTINKEEALQRPVAS
VKLQTVHSIPLTITKWEAMQRPVAS

SEQ ID NO: 58516 - protein, 25 aa, synthetic construct
  source 1..25: note = Seed: VKLQTVHSIPLTINKEEALQRPVAS
VKLQTVHSIPLTITKWEAVQRPVAS

SEQ ID NO: 58517 - protein, 25 aa, synthetic construct
  source 1..25: note = Seed: VKLQTVHSIPLTINKEEALQRPVAS
VKLQTVHSIPLTITKYEAFQRPVAS

SEQ ID NO: 58518 - protein, 25 aa, synthetic construct
  source 1..25: note = Seed: VKLQTVHSIPLTINKEEALQRPVAS
VKLQTVHSIPLTITKYEAIQRPVAS

SEQ ID NO: 58519 - protein, 25 aa, synthetic construct
  source 1..25: note = Seed: VKLQTVHSIPLTINKEEALQRPVAS
VKLQTVHSIPLTITKYEALQRPVAS

SEQ ID NO: 58520 - protein, 25 aa, synthetic construct
  source 1..25: note = Seed: VKLQTVHSIPLTINKEEALQRPVAS
VKLQTVHSIPLTITKYEAMQRPVAS

SEQ ID NO: 58521 - protein, 25 aa, synthetic construct
  source 1..25: note = Seed: VKLQTVHSIPLTINKEEALQRPVAS
VKLQTVHSIPLTITKYEAVQRPVAS

SEQ ID NO: 58522 - protein, 25 aa, synthetic construct
  source 1..25: note = Seed: VKLQTVHSIPLTINKEEALQRPVAS
VKLQTVHSIPLTITKYEAYQRPVAS

SEQ ID NO: 58523 - protein, 25 aa, synthetic construct
  source 1..25: note = Seed: VKLQTVHSIPLTINKEEALQRPVAS
VKLQTVHSIPLTIVKAEAAQRPVAS

SEQ ID NO: 58524 - protein, 25 aa, synthetic construct
  source 1..25: note = Seed: VKLQTVHSIPLTINKEEALQRPVAS
VKLQTVHSIPLTIVKAEAFQRPVAS

SEQ ID NO: 58525 - protein, 25 aa, synthetic construct
  source 1..25: note = Seed: VKLQTVHSIPLTINKEEALQRPVAS
VKLQTVHSIPLTIVKAEAIQRPVAS

SEQ ID NO: 58526 - protein, 25 aa, synthetic construct
  source 1..25: note = Seed: VKLQTVHSIPLTINKEEALQRPVAS
VKLQTVHSIPLTIVKAEALQRPVAS

SEQ ID NO: 58527 - protein, 25 aa, synthetic construct
  source 1..25: note = Seed: VKLQTVHSIPLTINKEEALQRPVAS
VKLQTVHSIPLTIVKAEAMQRPVAS

SEQ ID NO: 58528 - protein, 25 aa, synthetic construct
  source 1..25: note = Seed: VKLQTVHSIPLTINKEEALQRPVAS
VKLQTVHSIPLTIVKAEAVQRPVAS

SEQ ID NO: 58529 - protein, 25 aa, synthetic construct
  source 1..25: note = Seed: VKLQTVHSIPLTINKEEALQRPVAS
VKLQTVHSIPLTIVKAEAYQRPVAS

SEQ ID NO: 58530 - protein, 25 aa, synthetic construct
  source 1..25: note = Seed: VKLQTVHSIPLTINKEEALQRPVAS
VKLQTVHSIPLTIVKDEAAQRPVAS

SEQ ID NO: 58531 - protein, 25 aa, synthetic construct
  source 1..25: note = Seed: VKLQTVHSIPLTINKEEALQRPVAS
VKLQTVHSIPLTIVKDEAIQRPVAS

SEQ ID NO: 58532 - protein, 25 aa, synthetic construct
  source 1..25: note = Seed: VKLQTVHSIPLTINKEEALQRPVAS
VKLQTVHSIPLTIVKDEALQRPVAS

SEQ ID NO: 58533 - protein, 25 aa, synthetic construct
  source 1..25: note = Seed: VKLQTVHSIPLTINKEEALQRPVAS
VKLQTVHSIPLTIVKDEAMQRPVAS

SEQ ID NO: 58534 - protein, 25 aa, synthetic construct
  source 1..25: note = Seed: VKLQTVHSIPLTINKEEALQRPVAS
VKLQTVHSIPLTIVKDEAVQRPVAS

SEQ ID NO: 58535 - protein, 25 aa, synthetic construct
  source 1..25: note = Seed: VKLQTVHSIPLTINKEEALQRPVAS
VKLQTVHSIPLTIVKFEAAQRPVAS

SEQ ID NO: 58536 - protein, 25 aa, synthetic construct
  source 1..25: note = Seed: VKLQTVHSIPLTINKEEALQRPVAS
VKLQTVHSIPLTIVKFEACQRPVAS

SEQ ID NO: 58537 - protein, 25 aa, synthetic construct
  source 1..25: note = Seed: VKLQTVHSIPLTINKEEALQRPVAS
VKLQTVHSIPLTIVKFEADQRPVAS

SEQ ID NO: 58538 - protein, 25 aa, synthetic construct
  source 1..25: note = Seed: VKLQTVHSIPLTINKEEALQRPVAS
VKLQTVHSIPLTIVKFEAEQRPVAS

SEQ ID NO: 58539 - protein, 25 aa, synthetic construct
  source 1..25: note = Seed: VKLQTVHSIPLTINKEEALQRPVAS
VKLQTVHSIPLTIVKFEAFQRPVAS

SEQ ID NO: 58540 - protein, 25 aa, synthetic construct
  source 1..25: note = Seed: VKLQTVHSIPLTINKEEALQRPVAS
VKLQTVHSIPLTIVKFEAGQRPVAS

SEQ ID NO: 58541 - protein, 25 aa, synthetic construct
  source 1..25: note = Seed: VKLQTVHSIPLTINKEEALQRPVAS
VKLQTVHSIPLTIVKFEAHQRPVAS

SEQ ID NO: 58542 - protein, 25 aa, synthetic construct
  source 1..25: note = Seed: VKLQTVHSIPLTINKEEALQRPVAS
VKLQTVHSIPLTIVKFEAIQRPVAS

SEQ ID NO: 58543 - protein, 25 aa, synthetic construct
  source 1..25: note = Seed: VKLQTVHSIPLTINKEEALQRPVAS
VKLQTVHSIPLTIVKFEAKQRPVAS

SEQ ID NO: 58544 - protein, 25 aa, synthetic construct
  source 1..25: note = Seed: VKLQTVHSIPLTINKEEALQRPVAS
VKLQTVHSIPLTIVKFEALQRPVAS

SEQ ID NO: 58545 - protein, 25 aa, synthetic construct
  source 1..25: note = Seed: VKLQTVHSIPLTINKEEALQRPVAS
VKLQTVHSIPLTIVKFEAMQRPVAS

SEQ ID NO: 58546 - protein, 25 aa, synthetic construct
  source 1..25: note = Seed: VKLQTVHSIPLTINKEEALQRPVAS
VKLQTVHSIPLTIVKFEANQRPVAS

SEQ ID NO: 58547 - protein, 25 aa, synthetic construct
  source 1..25: note = Seed: VKLQTVHSIPLTINKEEALQRPVAS
VKLQTVHSIPLTIVKFEAPQRPVAS

SEQ ID NO: 58548 - protein, 25 aa, synthetic construct
  source 1..25: note = Seed: VKLQTVHSIPLTINKEEALQRPVAS
VKLQTVHSIPLTIVKFEAQQRPVAS

SEQ ID NO: 58549 - protein, 25 aa, synthetic construct
  source 1..25: note = Seed: VKLQTVHSIPLTINKEEALQRPVAS
VKLQTVHSIPLTIVKFEARQRPVAS

SEQ ID NO: 58550 - protein, 25 aa, synthetic construct
  source 1..25: note = Seed: VKLQTVHSIPLTINKEEALQRPVAS
VKLQTVHSIPLTIVKFEASQRPVAS

SEQ ID NO: 58551 - protein, 25 aa, synthetic construct
  source 1..25: note = Seed: VKLQTVHSIPLTINKEEALQRPVAS
VKLQTVHSIPLTIVKFEATQRPVAS

SEQ ID NO: 58552 - protein, 25 aa, synthetic construct
  source 1..25: note = Seed: VKLQTVHSIPLTINKEEALQRPVAS
VKLQTVHSIPLTIVKFEAVQRPVAS

SEQ ID NO: 58553 - protein, 25 aa, synthetic construct
  source 1..25: note = Seed: VKLQTVHSIPLTINKEEALQRPVAS
VKLQTVHSIPLTIVKFEAWQRPVAS

SEQ ID NO: 58554 - protein, 25 aa, synthetic construct
  source 1..25: note = Seed: VKLQTVHSIPLTINKEEALQRPVAS
VKLQTVHSIPLTIVKFEAYQRPVAS

SEQ ID NO: 58555 - protein, 25 aa, synthetic construct
  source 1..25: note = Seed: VKLQTVHSIPLTINKEEALQRPVAS
VKLQTVHSIPLTIVKHEALQRPVAS

SEQ ID NO: 58556 - protein, 25 aa, synthetic construct
  source 1..25: note = Seed: VKLQTVHSIPLTINKEEALQRPVAS
VKLQTVHSIPLTIVKIEAAQRPVAS

SEQ ID NO: 58557 - protein, 25 aa, synthetic construct
  source 1..25: note = Seed: VKLQTVHSIPLTINKEEALQRPVAS
VKLQTVHSIPLTIVKIEAEQRPVAS

SEQ ID NO: 58558 - protein, 25 aa, synthetic construct
  source 1..25: note = Seed: VKLQTVHSIPLTINKEEALQRPVAS
VKLQTVHSIPLTIVKIEAFQRPVAS

SEQ ID NO: 58559 - protein, 25 aa, synthetic construct
  source 1..25: note = Seed: VKLQTVHSIPLTINKEEALQRPVAS
VKLQTVHSIPLTIVKIEAIQRPVAS

SEQ ID NO: 58560 - protein, 25 aa, synthetic construct
  source 1..25: note = Seed: VKLQTVHSIPLTINKEEALQRPVAS
VKLQTVHSIPLTIVKIEALQRPVAS

SEQ ID NO: 58561 - protein, 25 aa, synthetic construct
  source 1..25: note = Seed: VKLQTVHSIPLTINKEEALQRPVAS
VKLQTVHSIPLTIVKIEAMQRPVAS

SEQ ID NO: 58562 - protein, 25 aa, synthetic construct
  source 1..25: note = Seed: VKLQTVHSIPLTINKEEALQRPVAS
VKLQTVHSIPLTIVKIEANQRPVAS

SEQ ID NO: 58563 - protein, 25 aa, synthetic construct
  source 1..25: note = Seed: VKLQTVHSIPLTINKEEALQRPVAS
VKLQTVHSIPLTIVKIEAQQRPVAS

SEQ ID NO: 58564 - protein, 25 aa, synthetic construct
  source 1..25: note = Seed: VKLQTVHSIPLTINKEEALQRPVAS
VKLQTVHSIPLTIVKIEASQRPVAS

SEQ ID NO: 58565 - protein, 25 aa, synthetic construct
  source 1..25: note = Seed: VKLQTVHSIPLTINKEEALQRPVAS
VKLQTVHSIPLTIVKIEATQRPVAS

SEQ ID NO: 58566 - protein, 25 aa, synthetic construct
  source 1..25: note = Seed: VKLQTVHSIPLTINKEEALQRPVAS
VKLQTVHSIPLTIVKIEAVQRPVAS

SEQ ID NO: 58567 - protein, 25 aa, synthetic construct
  source 1..25: note = Seed: VKLQTVHSIPLTINKEEALQRPVAS
VKLQTVHSIPLTIVKIEAYQRPVAS

SEQ ID NO: 58568 - protein, 25 aa, synthetic construct
  source 1..25: note = Seed: VKLQTVHSIPLTINKEEALQRPVAS
VKLQTVHSIPLTIVKKEAFQRPVAS

SEQ ID NO: 58569 - protein, 25 aa, synthetic construct
  source 1..25: note = Seed: VKLQTVHSIPLTINKEEALQRPVAS
VKLQTVHSIPLTIVKKEAIQRPVAS

SEQ ID NO: 58570 - protein, 25 aa, synthetic construct
  source 1..25: note = Seed: VKLQTVHSIPLTINKEEALQRPVAS
VKLQTVHSIPLTIVKKEALQRPVAS

SEQ ID NO: 58571 - protein, 25 aa, synthetic construct
  source 1..25: note = Seed: VKLQTVHSIPLTINKEEALQRPVAS
VKLQTVHSIPLTIVKKEAYQRPVAS

SEQ ID NO: 58572 - protein, 25 aa, synthetic construct
  source 1..25: note = Seed: VKLQTVHSIPLTINKEEALQRPVAS
VKLQTVHSIPLTIVKLEAAQRPVAS

SEQ ID NO: 58573 - protein, 25 aa, synthetic construct
  source 1..25: note = Seed: VKLQTVHSIPLTINKEEALQRPVAS
VKLQTVHSIPLTIVKLEADQRPVAS

SEQ ID NO: 58574 - protein, 25 aa, synthetic construct
  source 1..25: note = Seed: VKLQTVHSIPLTINKEEALQRPVAS
VKLQTVHSIPLTIVKLEAEQRPVAS

SEQ ID NO: 58575 - protein, 25 aa, synthetic construct
  source 1..25: note = Seed: VKLQTVHSIPLTINKEEALQRPVAS
VKLQTVHSIPLTIVKLEAFQRPVAS

SEQ ID NO: 58576 - protein, 25 aa, synthetic construct
  source 1..25: note = Seed: VKLQTVHSIPLTINKEEALQRPVAS
VKLQTVHSIPLTIVKLEAHQRPVAS

SEQ ID NO: 58577 - protein, 25 aa, synthetic construct
  source 1..25: note = Seed: VKLQTVHSIPLTINKEEALQRPVAS
VKLQTVHSIPLTIVKLEAIQRPVAS

SEQ ID NO: 58578 - protein, 25 aa, synthetic construct
  source 1..25: note = Seed: VKLQTVHSIPLTINKEEALQRPVAS
VKLQTVHSIPLTIVKLEALQRPVAS

SEQ ID NO: 58579 - protein, 25 aa, synthetic construct
  source 1..25: note = Seed: VKLQTVHSIPLTINKEEALQRPVAS
VKLQTVHSIPLTIVKLEAMQRPVAS

SEQ ID NO: 58580 - protein, 25 aa, synthetic construct
  source 1..25: note = Seed: VKLQTVHSIPLTINKEEALQRPVAS
VKLQTVHSIPLTIVKLEANQRPVAS

SEQ ID NO: 58581 - protein, 25 aa, synthetic construct
  source 1..25: note = Seed: VKLQTVHSIPLTINKEEALQRPVAS
VKLQTVHSIPLTIVKLEAQQRPVAS

SEQ ID NO: 58582 - protein, 25 aa, synthetic construct
  source 1..25: note = Seed: VKLQTVHSIPLTINKEEALQRPVAS
VKLQTVHSIPLTIVKLEARQRPVAS

SEQ ID NO: 58583 - protein, 25 aa, synthetic construct
  source 1..25: note = Seed: VKLQTVHSIPLTINKEEALQRPVAS
VKLQTVHSIPLTIVKLEASQRPVAS

SEQ ID NO: 58584 - protein, 25 aa, synthetic construct
  source 1..25: note = Seed: VKLQTVHSIPLTINKEEALQRPVAS
VKLQTVHSIPLTIVKLEATQRPVAS

SEQ ID NO: 58585 - protein, 25 aa, synthetic construct
  source 1..25: note = Seed: VKLQTVHSIPLTINKEEALQRPVAS
VKLQTVHSIPLTIVKLEAVQRPVAS

SEQ ID NO: 58586 - protein, 25 aa, synthetic construct
  source 1..25: note = Seed: VKLQTVHSIPLTINKEEALQRPVAS
VKLQTVHSIPLTIVKLEAWQRPVAS

SEQ ID NO: 58587 - protein, 25 aa, synthetic construct
  source 1..25: note = Seed: VKLQTVHSIPLTINKEEALQRPVAS
VKLQTVHSIPLTIVKLEAYQRPVAS

SEQ ID NO: 58588 - protein, 25 aa, synthetic construct
  source 1..25: note = Seed: VKLQTVHSIPLTINKEEALQRPVAS
VKLQTVHSIPLTIVKMEAAQRPVAS

SEQ ID NO: 58589 - protein, 25 aa, synthetic construct
  source 1..25: note = Seed: VKLQTVHSIPLTINKEEALQRPVAS
VKLQTVHSIPLTIVKMEAFQRPVAS

SEQ ID NO: 58590 - protein, 25 aa, synthetic construct
  source 1..25: note = Seed: VKLQTVHSIPLTINKEEALQRPVAS
VKLQTVHSIPLTIVKMEAIQRPVAS

SEQ ID NO: 58591 - protein, 25 aa, synthetic construct
  source 1..25: note = Seed: VKLQTVHSIPLTINKEEALQRPVAS
VKLQTVHSIPLTIVKMEALQRPVAS

SEQ ID NO: 58592 - protein, 25 aa, synthetic construct
  source 1..25: note = Seed: VKLQTVHSIPLTINKEEALQRPVAS
VKLQTVHSIPLTIVKMEAMQRPVAS

SEQ ID NO: 58593 - protein, 25 aa, synthetic construct
  source 1..25: note = Seed: VKLQTVHSIPLTINKEEALQRPVAS
VKLQTVHSIPLTIVKMEAVQRPVAS

SEQ ID NO: 58594 - protein, 25 aa, synthetic construct
  source 1..25: note = Seed: VKLQTVHSIPLTINKEEALQRPVAS
VKLQTVHSIPLTIVKMEAYQRPVAS

SEQ ID NO: 58595 - protein, 25 aa, synthetic construct
  source 1..25: note = Seed: VKLQTVHSIPLTINKEEALQRPVAS
VKLQTVHSIPLTIVKNEAAQRPVAS

SEQ ID NO: 58596 - protein, 25 aa, synthetic construct
  source 1..25: note = Seed: VKLQTVHSIPLTINKEEALQRPVAS
VKLQTVHSIPLTIVKNEAIQRPVAS

SEQ ID NO: 58597 - protein, 25 aa, synthetic construct
  source 1..25: note = Seed: VKLQTVHSIPLTINKEEALQRPVAS
VKLQTVHSIPLTIVKNEALQRPVAS

SEQ ID NO: 58598 - protein, 25 aa, synthetic construct
  source 1..25: note = Seed: VKLQTVHSIPLTINKEEALQRPVAS
VKLQTVHSIPLTIVKNEAVQRPVAS

SEQ ID NO: 58599 - protein, 25 aa, synthetic construct
  source 1..25: note = Seed: VKLQTVHSIPLTINKEEALQRPVAS
VKLQTVHSIPLTIVKREAFQRPVAS

SEQ ID NO: 58600 - protein, 25 aa, synthetic construct
  source 1..25: note = Seed: VKLQTVHSIPLTINKEEALQRPVAS
VKLQTVHSIPLTIVKREAIQRPVAS

SEQ ID NO: 58601 - protein, 25 aa, synthetic construct
  source 1..25: note = Seed: VKLQTVHSIPLTINKEEALQRPVAS
VKLQTVHSIPLTIVKREALQRPVAS

SEQ ID NO: 58602 - protein, 25 aa, synthetic construct
  source 1..25: note = Seed: VKLQTVHSIPLTINKEEALQRPVAS
VKLQTVHSIPLTIVKREAMQRPVAS

SEQ ID NO: 58603 - protein, 25 aa, synthetic construct
  source 1..25: note = Seed: VKLQTVHSIPLTINKEEALQRPVAS
VKLQTVHSIPLTIVKREARQRPVAS

SEQ ID NO: 58604 - protein, 25 aa, synthetic construct
  source 1..25: note = Seed: VKLQTVHSIPLTINKEEALQRPVAS
VKLQTVHSIPLTIVKREAVQRPVAS

SEQ ID NO: 58605 - protein, 25 aa, synthetic construct
  source 1..25: note = Seed: VKLQTVHSIPLTINKEEALQRPVAS
VKLQTVHSIPLTIVKREAYQRPVAS

SEQ ID NO: 58606 - protein, 25 aa, synthetic construct
  source 1..25: note = Seed: VKLQTVHSIPLTINKEEALQRPVAS
VKLQTVHSIPLTIVKSEAFQRPVAS

SEQ ID NO: 58607 - protein, 25 aa, synthetic construct
  source 1..25: note = Seed: VKLQTVHSIPLTINKEEALQRPVAS
VKLQTVHSIPLTIVKSEAIQRPVAS

SEQ ID NO: 58608 - protein, 25 aa, synthetic construct
  source 1..25: note = Seed: VKLQTVHSIPLTINKEEALQRPVAS
VKLQTVHSIPLTIVKSEALQRPVAS

SEQ ID NO: 58609 - protein, 25 aa, synthetic construct
  source 1..25: note = Seed: VKLQTVHSIPLTINKEEALQRPVAS
VKLQTVHSIPLTIVKSEAVQRPVAS

SEQ ID NO: 58610 - protein, 25 aa, synthetic construct
  source 1..25: note = Seed: VKLQTVHSIPLTINKEEALQRPVAS
VKLQTVHSIPLTIVKTEAFQRPVAS

SEQ ID NO: 58611 - protein, 25 aa, synthetic construct
  source 1..25: note = Seed: VKLQTVHSIPLTINKEEALQRPVAS
VKLQTVHSIPLTIVKTEAIQRPVAS

SEQ ID NO: 58612 - protein, 25 aa, synthetic construct
  source 1..25: note = Seed: VKLQTVHSIPLTINKEEALQRPVAS
VKLQTVHSIPLTIVKTEAVQRPVAS

SEQ ID NO: 58613 - protein, 25 aa, synthetic construct
  source 1..25: note = Seed: VKLQTVHSIPLTINKEEALQRPVAS
VKLQTVHSIPLTIVKVEAAQRPVAS

SEQ ID NO: 58614 - protein, 25 aa, synthetic construct
  source 1..25: note = Seed: VKLQTVHSIPLTINKEEALQRPVAS
VKLQTVHSIPLTIVKVEAFQRPVAS

SEQ ID NO: 58615 - protein, 25 aa, synthetic construct
  source 1..25: note = Seed: VKLQTVHSIPLTINKEEALQRPVAS
VKLQTVHSIPLTIVKVEAIQRPVAS

SEQ ID NO: 58616 - protein, 25 aa, synthetic construct
  source 1..25: note = Seed: VKLQTVHSIPLTINKEEALQRPVAS
VKLQTVHSIPLTIVKVEALQRPVAS

SEQ ID NO: 58617 - protein, 25 aa, synthetic construct
  source 1..25: note = Seed: VKLQTVHSIPLTINKEEALQRPVAS
VKLQTVHSIPLTIVKVEAMQRPVAS

SEQ ID NO: 58618 - protein, 25 aa, synthetic construct
  source 1..25: note = Seed: VKLQTVHSIPLTINKEEALQRPVAS
VKLQTVHSIPLTIVKVEASQRPVAS

SEQ ID NO: 58619 - protein, 25 aa, synthetic construct
  source 1..25: note = Seed: VKLQTVHSIPLTINKEEALQRPVAS
VKLQTVHSIPLTIVKVEAVQRPVAS

SEQ ID NO: 58620 - protein, 25 aa, synthetic construct
  source 1..25: note = Seed: VKLQTVHSIPLTINKEEALQRPVAS
VKLQTVHSIPLTIVKVEAYQRPVAS

SEQ ID NO: 58621 - protein, 25 aa, synthetic construct
  source 1..25: note = Seed: VKLQTVHSIPLTINKEEALQRPVAS
VKLQTVHSIPLTIVKWEAAQRPVAS

SEQ ID NO: 58622 - protein, 25 aa, synthetic construct
  source 1..25: note = Seed: VKLQTVHSIPLTINKEEALQRPVAS
VKLQTVHSIPLTIVKWEADQRPVAS

SEQ ID NO: 58623 - protein, 25 aa, synthetic construct
  source 1..25: note = Seed: VKLQTVHSIPLTINKEEALQRPVAS
VKLQTVHSIPLTIVKWEAEQRPVAS

SEQ ID NO: 58624 - protein, 25 aa, synthetic construct
  source 1..25: note = Seed: VKLQTVHSIPLTINKEEALQRPVAS
VKLQTVHSIPLTIVKWEAFQRPVAS

SEQ ID NO: 58625 - protein, 25 aa, synthetic construct
  source 1..25: note = Seed: VKLQTVHSIPLTINKEEALQRPVAS
VKLQTVHSIPLTIVKWEAIQRPVAS

SEQ ID NO: 58626 - protein, 25 aa, synthetic construct
  source 1..25: note = Seed: VKLQTVHSIPLTINKEEALQRPVAS
VKLQTVHSIPLTIVKWEALQRPVAS

SEQ ID NO: 58627 - protein, 25 aa, synthetic construct
  source 1..25: note = Seed: VKLQTVHSIPLTINKEEALQRPVAS
VKLQTVHSIPLTIVKWEAMQRPVAS

SEQ ID NO: 58628 - protein, 25 aa, synthetic construct
  source 1..25: note = Seed: VKLQTVHSIPLTINKEEALQRPVAS
VKLQTVHSIPLTIVKWEANQRPVAS

SEQ ID NO: 58629 - protein, 25 aa, synthetic construct
  source 1..25: note = Seed: VKLQTVHSIPLTINKEEALQRPVAS
VKLQTVHSIPLTIVKWEAQQRPVAS

SEQ ID NO: 58630 - protein, 25 aa, synthetic construct
  source 1..25: note = Seed: VKLQTVHSIPLTINKEEALQRPVAS
VKLQTVHSIPLTIVKWEARQRPVAS

SEQ ID NO: 58631 - protein, 25 aa, synthetic construct
  source 1..25: note = Seed: VKLQTVHSIPLTINKEEALQRPVAS
VKLQTVHSIPLTIVKWEASQRPVAS

SEQ ID NO: 58632 - protein, 25 aa, synthetic construct
  source 1..25: note = Seed: VKLQTVHSIPLTINKEEALQRPVAS
VKLQTVHSIPLTIVKWEATQRPVAS

SEQ ID NO: 58633 - protein, 25 aa, synthetic construct
  source 1..25: note = Seed: VKLQTVHSIPLTINKEEALQRPVAS
VKLQTVHSIPLTIVKWEAVQRPVAS

SEQ ID NO: 58634 - protein, 25 aa, synthetic construct
  source 1..25: note = Seed: VKLQTVHSIPLTINKEEALQRPVAS
VKLQTVHSIPLTIVKWEAYQRPVAS

SEQ ID NO: 58635 - protein, 25 aa, synthetic construct
  source 1..25: note = Seed: VKLQTVHSIPLTINKEEALQRPVAS
VKLQTVHSIPLTIVKYEAAQRPVAS

SEQ ID NO: 58636 - protein, 25 aa, synthetic construct
  source 1..25: note = Seed: VKLQTVHSIPLTINKEEALQRPVAS
VKLQTVHSIPLTIVKYEACQRPVAS

SEQ ID NO: 58637 - protein, 25 aa, synthetic construct
  source 1..25: note = Seed: VKLQTVHSIPLTINKEEALQRPVAS
VKLQTVHSIPLTIVKYEADQRPVAS

SEQ ID NO: 58638 - protein, 25 aa, synthetic construct
  source 1..25: note = Seed: VKLQTVHSIPLTINKEEALQRPVAS
VKLQTVHSIPLTIVKYEAEQRPVAS

SEQ ID NO: 58639 - protein, 25 aa, synthetic construct
  source 1..25: note = Seed: VKLQTVHSIPLTINKEEALQRPVAS
VKLQTVHSIPLTIVKYEAFQRPVAS

SEQ ID NO: 58640 - protein, 25 aa, synthetic construct
  source 1..25: note = Seed: VKLQTVHSIPLTINKEEALQRPVAS
VKLQTVHSIPLTIVKYEAGQRPVAS

SEQ ID NO: 58641 - protein, 25 aa, synthetic construct
  source 1..25: note = Seed: VKLQTVHSIPLTINKEEALQRPVAS
VKLQTVHSIPLTIVKYEAHQRPVAS

SEQ ID NO: 58642 - protein, 25 aa, synthetic construct
  source 1..25: note = Seed: VKLQTVHSIPLTINKEEALQRPVAS
VKLQTVHSIPLTIVKYEAIQRPVAS

SEQ ID NO: 58643 - protein, 25 aa, synthetic construct
  source 1..25: note = Seed: VKLQTVHSIPLTINKEEALQRPVAS
VKLQTVHSIPLTIVKYEAKQRPVAS

SEQ ID NO: 58644 - protein, 25 aa, synthetic construct
  source 1..25: note = Seed: VKLQTVHSIPLTINKEEALQRPVAS
VKLQTVHSIPLTIVKYEALQRPVAS

SEQ ID NO: 58645 - protein, 25 aa, synthetic construct
  source 1..25: note = Seed: VKLQTVHSIPLTINKEEALQRPVAS
VKLQTVHSIPLTIVKYEAMQRPVAS

SEQ ID NO: 58646 - protein, 25 aa, synthetic construct
  source 1..25: note = Seed: VKLQTVHSIPLTINKEEALQRPVAS
VKLQTVHSIPLTIVKYEANQRPVAS

SEQ ID NO: 58647 - protein, 25 aa, synthetic construct
  source 1..25: note = Seed: VKLQTVHSIPLTINKEEALQRPVAS
VKLQTVHSIPLTIVKYEAPQRPVAS

SEQ ID NO: 58648 - protein, 25 aa, synthetic construct
  source 1..25: note = Seed: VKLQTVHSIPLTINKEEALQRPVAS
VKLQTVHSIPLTIVKYEAQQRPVAS

SEQ ID NO: 58649 - protein, 25 aa, synthetic construct
  source 1..25: note = Seed: VKLQTVHSIPLTINKEEALQRPVAS
VKLQTVHSIPLTIVKYEARQRPVAS

SEQ ID NO: 58650 - protein, 25 aa, synthetic construct
  source 1..25: note = Seed: VKLQTVHSIPLTINKEEALQRPVAS
VKLQTVHSIPLTIVKYEASQRPVAS

SEQ ID NO: 58651 - protein, 25 aa, synthetic construct
  source 1..25: note = Seed: VKLQTVHSIPLTINKEEALQRPVAS
VKLQTVHSIPLTIVKYEATQRPVAS

SEQ ID NO: 58652 - protein, 25 aa, synthetic construct
  source 1..25: note = Seed: VKLQTVHSIPLTINKEEALQRPVAS
VKLQTVHSIPLTIVKYEAVQRPVAS

SEQ ID NO: 58653 - protein, 25 aa, synthetic construct
  source 1..25: note = Seed: VKLQTVHSIPLTINKEEALQRPVAS
VKLQTVHSIPLTIVKYEAWQRPVAS

SEQ ID NO: 58654 - protein, 25 aa, synthetic construct
  source 1..25: note = Seed: VKLQTVHSIPLTINKEEALQRPVAS
VKLQTVHSIPLTIVKYEAYQRPVAS

SEQ ID NO: 58655 - protein, 25 aa, synthetic construct
  source 1..25: note = Seed: VKLQTVHSIPLTINKEEALQRPVAS
VKLQTVHSIPLTIWKAEAAQRPVAS

SEQ ID NO: 58656 - protein, 25 aa, synthetic construct
  source 1..25: note = Seed: VKLQTVHSIPLTINKEEALQRPVAS
VKLQTVHSIPLTIWKAEAFQRPVAS

SEQ ID NO: 58657 - protein, 25 aa, synthetic construct
  source 1..25: note = Seed: VKLQTVHSIPLTINKEEALQRPVAS
VKLQTVHSIPLTIWKAEAIQRPVAS

SEQ ID NO: 58658 - protein, 25 aa, synthetic construct
  source 1..25: note = Seed: VKLQTVHSIPLTINKEEALQRPVAS
VKLQTVHSIPLTIWKAEALQRPVAS

SEQ ID NO: 58659 - protein, 25 aa, synthetic construct
  source 1..25: note = Seed: VKLQTVHSIPLTINKEEALQRPVAS
VKLQTVHSIPLTIWKAEAMQRPVAS

SEQ ID NO: 58660 - protein, 25 aa, synthetic construct
  source 1..25: note = Seed: VKLQTVHSIPLTINKEEALQRPVAS
VKLQTVHSIPLTIWKAEASQRPVAS

SEQ ID NO: 58661 - protein, 25 aa, synthetic construct
  source 1..25: note = Seed: VKLQTVHSIPLTINKEEALQRPVAS
VKLQTVHSIPLTIWKAEAVQRPVAS

SEQ ID NO: 58662 - protein, 25 aa, synthetic construct
  source 1..25: note = Seed: VKLQTVHSIPLTINKEEALQRPVAS
VKLQTVHSIPLTIWKAEAYQRPVAS

SEQ ID NO: 58663 - protein, 25 aa, synthetic construct
  source 1..25: note = Seed: VKLQTVHSIPLTINKEEALQRPVAS
VKLQTVHSIPLTIWKDEAAQRPVAS

SEQ ID NO: 58664 - protein, 25 aa, synthetic construct
  source 1..25: note = Seed: VKLQTVHSIPLTINKEEALQRPVAS
VKLQTVHSIPLTIWKDEAFQRPVAS

SEQ ID NO: 58665 - protein, 25 aa, synthetic construct
  source 1..25: note = Seed: VKLQTVHSIPLTINKEEALQRPVAS
VKLQTVHSIPLTIWKDEAIQRPVAS

SEQ ID NO: 58666 - protein, 25 aa, synthetic construct
  source 1..25: note = Seed: VKLQTVHSIPLTINKEEALQRPVAS
VKLQTVHSIPLTIWKDEALQRPVAS

SEQ ID NO: 58667 - protein, 25 aa, synthetic construct
  source 1..25: note = Seed: VKLQTVHSIPLTINKEEALQRPVAS
VKLQTVHSIPLTIWKDEAMQRPVAS

SEQ ID NO: 58668 - protein, 25 aa, synthetic construct
  source 1..25: note = Seed: VKLQTVHSIPLTINKEEALQRPVAS
VKLQTVHSIPLTIWKDEASQRPVAS

SEQ ID NO: 58669 - protein, 25 aa, synthetic construct
  source 1..25: note = Seed: VKLQTVHSIPLTINKEEALQRPVAS
VKLQTVHSIPLTIWKDEAVQRPVAS

SEQ ID NO: 58670 - protein, 25 aa, synthetic construct
  source 1..25: note = Seed: VKLQTVHSIPLTINKEEALQRPVAS
VKLQTVHSIPLTIWKDEAYQRPVAS

SEQ ID NO: 58671 - protein, 25 aa, synthetic construct
  source 1..25: note = Seed: VKLQTVHSIPLTINKEEALQRPVAS
VKLQTVHSIPLTIWKFEAAQRPVAS

SEQ ID NO: 58672 - protein, 25 aa, synthetic construct
  source 1..25: note = Seed: VKLQTVHSIPLTINKEEALQRPVAS
VKLQTVHSIPLTIWKFEAFQRPVAS

SEQ ID NO: 58673 - protein, 25 aa, synthetic construct
  source 1..25: note = Seed: VKLQTVHSIPLTINKEEALQRPVAS
VKLQTVHSIPLTIWKFEAIQRPVAS

SEQ ID NO: 58674 - protein, 25 aa, synthetic construct
  source 1..25: note = Seed: VKLQTVHSIPLTINKEEALQRPVAS
VKLQTVHSIPLTIWKFEALQRPVAS

SEQ ID NO: 58675 - protein, 25 aa, synthetic construct
  source 1..25: note = Seed: VKLQTVHSIPLTINKEEALQRPVAS
VKLQTVHSIPLTIWKFEAMQRPVAS

SEQ ID NO: 58676 - protein, 25 aa, synthetic construct
  source 1..25: note = Seed: VKLQTVHSIPLTINKEEALQRPVAS
VKLQTVHSIPLTIWKFEANQRPVAS

SEQ ID NO: 58677 - protein, 25 aa, synthetic construct
  source 1..25: note = Seed: VKLQTVHSIPLTINKEEALQRPVAS
VKLQTVHSIPLTIWKFEASQRPVAS

SEQ ID NO: 58678 - protein, 25 aa, synthetic construct
  source 1..25: note = Seed: VKLQTVHSIPLTINKEEALQRPVAS
VKLQTVHSIPLTIWKFEATQRPVAS

SEQ ID NO: 58679 - protein, 25 aa, synthetic construct
  source 1..25: note = Seed: VKLQTVHSIPLTINKEEALQRPVAS
VKLQTVHSIPLTIWKFEAVQRPVAS

SEQ ID NO: 58680 - protein, 25 aa, synthetic construct
  source 1..25: note = Seed: VKLQTVHSIPLTINKEEALQRPVAS
VKLQTVHSIPLTIWKFEAWQRPVAS

SEQ ID NO: 58681 - protein, 25 aa, synthetic construct
  source 1..25: note = Seed: VKLQTVHSIPLTINKEEALQRPVAS
VKLQTVHSIPLTIWKFEAYQRPVAS

SEQ ID NO: 58682 - protein, 25 aa, synthetic construct
  source 1..25: note = Seed: VKLQTVHSIPLTINKEEALQRPVAS
VKLQTVHSIPLTIWKHEAFQRPVAS

SEQ ID NO: 58683 - protein, 25 aa, synthetic construct
  source 1..25: note = Seed: VKLQTVHSIPLTINKEEALQRPVAS
VKLQTVHSIPLTIWKHEAIQRPVAS

SEQ ID NO: 58684 - protein, 25 aa, synthetic construct
  source 1..25: note = Seed: VKLQTVHSIPLTINKEEALQRPVAS
VKLQTVHSIPLTIWKHEALQRPVAS

SEQ ID NO: 58685 - protein, 25 aa, synthetic construct
  source 1..25: note = Seed: VKLQTVHSIPLTINKEEALQRPVAS
VKLQTVHSIPLTIWKIEAAQRPVAS

SEQ ID NO: 58686 - protein, 25 aa, synthetic construct
  source 1..25: note = Seed: VKLQTVHSIPLTINKEEALQRPVAS
VKLQTVHSIPLTIWKIEAFQRPVAS

SEQ ID NO: 58687 - protein, 25 aa, synthetic construct
  source 1..25: note = Seed: VKLQTVHSIPLTINKEEALQRPVAS
VKLQTVHSIPLTIWKIEAIQRPVAS

SEQ ID NO: 58688 - protein, 25 aa, synthetic construct
  source 1..25: note = Seed: VKLQTVHSIPLTINKEEALQRPVAS
VKLQTVHSIPLTIWKIEALQRPVAS

SEQ ID NO: 58689 - protein, 25 aa, synthetic construct
  source 1..25: note = Seed: VKLQTVHSIPLTINKEEALQRPVAS
VKLQTVHSIPLTIWKIEAMQRPVAS

SEQ ID NO: 58690 - protein, 25 aa, synthetic construct
  source 1..25: note = Seed: VKLQTVHSIPLTINKEEALQRPVAS
VKLQTVHSIPLTIWKIEASQRPVAS

SEQ ID NO: 58691 - protein, 25 aa, synthetic construct
  source 1..25: note = Seed: VKLQTVHSIPLTINKEEALQRPVAS
VKLQTVHSIPLTIWKIEATQRPVAS

SEQ ID NO: 58692 - protein, 25 aa, synthetic construct
  source 1..25: note = Seed: VKLQTVHSIPLTINKEEALQRPVAS
VKLQTVHSIPLTIWKIEAVQRPVAS

SEQ ID NO: 58693 - protein, 25 aa, synthetic construct
  source 1..25: note = Seed: VKLQTVHSIPLTINKEEALQRPVAS
VKLQTVHSIPLTIWKIEAYQRPVAS

SEQ ID NO: 58694 - protein, 25 aa, synthetic construct
  source 1..25: note = Seed: VKLQTVHSIPLTINKEEALQRPVAS
VKLQTVHSIPLTIWKKEAFQRPVAS

SEQ ID NO: 58695 - protein, 25 aa, synthetic construct
  source 1..25: note = Seed: VKLQTVHSIPLTINKEEALQRPVAS
VKLQTVHSIPLTIWKKEALQRPVAS

SEQ ID NO: 58696 - protein, 25 aa, synthetic construct
  source 1..25: note = Seed: VKLQTVHSIPLTINKEEALQRPVAS
VKLQTVHSIPLTIWKLEAAQRPVAS

SEQ ID NO: 58697 - protein, 25 aa, synthetic construct
  source 1..25: note = Seed: VKLQTVHSIPLTINKEEALQRPVAS
VKLQTVHSIPLTIWKLEAFQRPVAS

SEQ ID NO: 58698 - protein, 25 aa, synthetic construct
  source 1..25: note = Seed: VKLQTVHSIPLTINKEEALQRPVAS
VKLQTVHSIPLTIWKLEAIQRPVAS

SEQ ID NO: 58699 - protein, 25 aa, synthetic construct
  source 1..25: note = Seed: VKLQTVHSIPLTINKEEALQRPVAS
VKLQTVHSIPLTIWKLEALQRPVAS

SEQ ID NO: 58700 - protein, 25 aa, synthetic construct
  source 1..25: note = Seed: VKLQTVHSIPLTINKEEALQRPVAS
VKLQTVHSIPLTIWKLEAMQRPVAS

SEQ ID NO: 58701 - protein, 25 aa, synthetic construct
  source 1..25: note = Seed: VKLQTVHSIPLTINKEEALQRPVAS
VKLQTVHSIPLTIWKLEASQRPVAS

SEQ ID NO: 58702 - protein, 25 aa, synthetic construct
  source 1..25: note = Seed: VKLQTVHSIPLTINKEEALQRPVAS
VKLQTVHSIPLTIWKLEAVQRPVAS

SEQ ID NO: 58703 - protein, 25 aa, synthetic construct
  source 1..25: note = Seed: VKLQTVHSIPLTINKEEALQRPVAS
VKLQTVHSIPLTIWKLEAYQRPVAS

SEQ ID NO: 58704 - protein, 25 aa, synthetic construct
  source 1..25: note = Seed: VKLQTVHSIPLTINKEEALQRPVAS
VKLQTVHSIPLTIWKMEAAQRPVAS

SEQ ID NO: 58705 - protein, 25 aa, synthetic construct
  source 1..25: note = Seed: VKLQTVHSIPLTINKEEALQRPVAS
VKLQTVHSIPLTIWKMEAFQRPVAS

SEQ ID NO: 58706 - protein, 25 aa, synthetic construct
  source 1..25: note = Seed: VKLQTVHSIPLTINKEEALQRPVAS
VKLQTVHSIPLTIWKMEAIQRPVAS

SEQ ID NO: 58707 - protein, 25 aa, synthetic construct
  source 1..25: note = Seed: VKLQTVHSIPLTINKEEALQRPVAS
VKLQTVHSIPLTIWKMEALQRPVAS

SEQ ID NO: 58708 - protein, 25 aa, synthetic construct
  source 1..25: note = Seed: VKLQTVHSIPLTINKEEALQRPVAS
VKLQTVHSIPLTIWKMEAMQRPVAS

SEQ ID NO: 58709 - protein, 25 aa, synthetic construct
  source 1..25: note = Seed: VKLQTVHSIPLTINKEEALQRPVAS
VKLQTVHSIPLTIWKMEAVQRPVAS

SEQ ID NO: 58710 - protein, 25 aa, synthetic construct
  source 1..25: note = Seed: VKLQTVHSIPLTINKEEALQRPVAS
VKLQTVHSIPLTIWKNEAAQRPVAS

SEQ ID NO: 58711 - protein, 25 aa, synthetic construct
  source 1..25: note = Seed: VKLQTVHSIPLTINKEEALQRPVAS
VKLQTVHSIPLTIWKNEAFQRPVAS

SEQ ID NO: 58712 - protein, 25 aa, synthetic construct
  source 1..25: note = Seed: VKLQTVHSIPLTINKEEALQRPVAS
VKLQTVHSIPLTIWKNEAIQRPVAS

SEQ ID NO: 58713 - protein, 25 aa, synthetic construct
  source 1..25: note = Seed: VKLQTVHSIPLTINKEEALQRPVAS
VKLQTVHSIPLTIWKNEALQRPVAS

SEQ ID NO: 58714 - protein, 25 aa, synthetic construct
  source 1..25: note = Seed: VKLQTVHSIPLTINKEEALQRPVAS
VKLQTVHSIPLTIWKNEAMQRPVAS

SEQ ID NO: 58715 - protein, 25 aa, synthetic construct
  source 1..25: note = Seed: VKLQTVHSIPLTINKEEALQRPVAS
VKLQTVHSIPLTIWKNEAVQRPVAS

SEQ ID NO: 58716 - protein, 25 aa, synthetic construct
  source 1..25: note = Seed: VKLQTVHSIPLTINKEEALQRPVAS
VKLQTVHSIPLTIWKREAFQRPVAS

SEQ ID NO: 58717 - protein, 25 aa, synthetic construct
  source 1..25: note = Seed: VKLQTVHSIPLTINKEEALQRPVAS
VKLQTVHSIPLTIWKREAIQRPVAS

SEQ ID NO: 58718 - protein, 25 aa, synthetic construct
  source 1..25: note = Seed: VKLQTVHSIPLTINKEEALQRPVAS
VKLQTVHSIPLTIWKREALQRPVAS

SEQ ID NO: 58719 - protein, 25 aa, synthetic construct
  source 1..25: note = Seed: VKLQTVHSIPLTINKEEALQRPVAS
VKLQTVHSIPLTIWKREAMQRPVAS

SEQ ID NO: 58720 - protein, 25 aa, synthetic construct
  source 1..25: note = Seed: VKLQTVHSIPLTINKEEALQRPVAS
VKLQTVHSIPLTIWKREAVQRPVAS

SEQ ID NO: 58721 - protein, 25 aa, synthetic construct
  source 1..25: note = Seed: VKLQTVHSIPLTINKEEALQRPVAS
VKLQTVHSIPLTIWKREAYQRPVAS

SEQ ID NO: 58722 - protein, 25 aa, synthetic construct
  source 1..25: note = Seed: VKLQTVHSIPLTINKEEALQRPVAS
VKLQTVHSIPLTIWKSEAAQRPVAS

SEQ ID NO: 58723 - protein, 25 aa, synthetic construct
  source 1..25: note = Seed: VKLQTVHSIPLTINKEEALQRPVAS
VKLQTVHSIPLTIWKSEAIQRPVAS

SEQ ID NO: 58724 - protein, 25 aa, synthetic construct
  source 1..25: note = Seed: VKLQTVHSIPLTINKEEALQRPVAS
VKLQTVHSIPLTIWKSEALQRPVAS

SEQ ID NO: 58725 - protein, 25 aa, synthetic construct
  source 1..25: note = Seed: VKLQTVHSIPLTINKEEALQRPVAS
VKLQTVHSIPLTIWKSEAVQRPVAS

SEQ ID NO: 58726 - protein, 25 aa, synthetic construct
  source 1..25: note = Seed: VKLQTVHSIPLTINKEEALQRPVAS
VKLQTVHSIPLTIWKTEAIQRPVAS

SEQ ID NO: 58727 - protein, 25 aa, synthetic construct
  source 1..25: note = Seed: VKLQTVHSIPLTINKEEALQRPVAS
VKLQTVHSIPLTIWKTEALQRPVAS

SEQ ID NO: 58728 - protein, 25 aa, synthetic construct
  source 1..25: note = Seed: VKLQTVHSIPLTINKEEALQRPVAS
VKLQTVHSIPLTIWKTEAVQRPVAS

SEQ ID NO: 58729 - protein, 25 aa, synthetic construct
  source 1..25: note = Seed: VKLQTVHSIPLTINKEEALQRPVAS
VKLQTVHSIPLTIWKVEAAQRPVAS

SEQ ID NO: 58730 - protein, 25 aa, synthetic construct
  source 1..25: note = Seed: VKLQTVHSIPLTINKEEALQRPVAS
VKLQTVHSIPLTIWKVEAFQRPVAS

SEQ ID NO: 58731 - protein, 25 aa, synthetic construct
  source 1..25: note = Seed: VKLQTVHSIPLTINKEEALQRPVAS
VKLQTVHSIPLTIWKVEAIQRPVAS

SEQ ID NO: 58732 - protein, 25 aa, synthetic construct
  source 1..25: note = Seed: VKLQTVHSIPLTINKEEALQRPVAS
VKLQTVHSIPLTIWKVEALQRPVAS

SEQ ID NO: 58733 - protein, 25 aa, synthetic construct
  source 1..25: note = Seed: VKLQTVHSIPLTINKEEALQRPVAS
VKLQTVHSIPLTIWKVEAMQRPVAS

SEQ ID NO: 58734 - protein, 25 aa, synthetic construct
  source 1..25: note = Seed: VKLQTVHSIPLTINKEEALQRPVAS
VKLQTVHSIPLTIWKVEASQRPVAS

SEQ ID NO: 58735 - protein, 25 aa, synthetic construct
  source 1..25: note = Seed: VKLQTVHSIPLTINKEEALQRPVAS
VKLQTVHSIPLTIWKVEAVQRPVAS

SEQ ID NO: 58736 - protein, 25 aa, synthetic construct
  source 1..25: note = Seed: VKLQTVHSIPLTINKEEALQRPVAS
VKLQTVHSIPLTIWKVEAYQRPVAS

SEQ ID NO: 58737 - protein, 25 aa, synthetic construct
  source 1..25: note = Seed: VKLQTVHSIPLTINKEEALQRPVAS
VKLQTVHSIPLTIWKWEAFQRPVAS

SEQ ID NO: 58738 - protein, 25 aa, synthetic construct
  source 1..25: note = Seed: VKLQTVHSIPLTINKEEALQRPVAS
VKLQTVHSIPLTIWKWEAIQRPVAS

SEQ ID NO: 58739 - protein, 25 aa, synthetic construct
  source 1..25: note = Seed: VKLQTVHSIPLTINKEEALQRPVAS
VKLQTVHSIPLTIWKWEALQRPVAS

SEQ ID NO: 58740 - protein, 25 aa, synthetic construct
  source 1..25: note = Seed: VKLQTVHSIPLTINKEEALQRPVAS
VKLQTVHSIPLTIWKWEAMQRPVAS

SEQ ID NO: 58741 - protein, 25 aa, synthetic construct
  source 1..25: note = Seed: VKLQTVHSIPLTINKEEALQRPVAS
VKLQTVHSIPLTIWKWEAVQRPVAS

SEQ ID NO: 58742 - protein, 25 aa, synthetic construct
  source 1..25: note = Seed: VKLQTVHSIPLTINKEEALQRPVAS
VKLQTVHSIPLTIWKYEAFQRPVAS

SEQ ID NO: 58743 - protein, 25 aa, synthetic construct
  source 1..25: note = Seed: VKLQTVHSIPLTINKEEALQRPVAS
VKLQTVHSIPLTIWKYEAIQRPVAS

SEQ ID NO: 58744 - protein, 25 aa, synthetic construct
  source 1..25: note = Seed: VKLQTVHSIPLTINKEEALQRPVAS
VKLQTVHSIPLTIWKYEALQRPVAS

SEQ ID NO: 58745 - protein, 25 aa, synthetic construct
  source 1..25: note = Seed: VKLQTVHSIPLTINKEEALQRPVAS
VKLQTVHSIPLTIWKYEAMQRPVAS

SEQ ID NO: 58746 - protein, 25 aa, synthetic construct
  source 1..25: note = Seed: VKLQTVHSIPLTINKEEALQRPVAS
VKLQTVHSIPLTIWKYEAVQRPVAS

SEQ ID NO: 58747 - protein, 25 aa, synthetic construct
  source 1..25: note = Seed: VKLQTVHSIPLTINKEEALQRPVAS
VKLQTVHSIPLTIWKYEAYQRPVAS

SEQ ID NO: 58748 - protein, 25 aa, synthetic construct
  source 1..25: note = Seed: VKLQTVHSIPLTINKEEALQRPVAS
VKLQTVHSIPLTIYKAEAAQRPVAS

SEQ ID NO: 58749 - protein, 25 aa, synthetic construct
  source 1..25: note = Seed: VKLQTVHSIPLTINKEEALQRPVAS
VKLQTVHSIPLTIYKAEACQRPVAS

SEQ ID NO: 58750 - protein, 25 aa, synthetic construct
  source 1..25: note = Seed: VKLQTVHSIPLTINKEEALQRPVAS
VKLQTVHSIPLTIYKAEAFQRPVAS

SEQ ID NO: 58751 - protein, 25 aa, synthetic construct
  source 1..25: note = Seed: VKLQTVHSIPLTINKEEALQRPVAS
VKLQTVHSIPLTIYKAEAIQRPVAS

SEQ ID NO: 58752 - protein, 25 aa, synthetic construct
  source 1..25: note = Seed: VKLQTVHSIPLTINKEEALQRPVAS
VKLQTVHSIPLTIYKAEALQRPVAS

SEQ ID NO: 58753 - protein, 25 aa, synthetic construct
  source 1..25: note = Seed: VKLQTVHSIPLTINKEEALQRPVAS
VKLQTVHSIPLTIYKAEAMQRPVAS

SEQ ID NO: 58754 - protein, 25 aa, synthetic construct
  source 1..25: note = Seed: VKLQTVHSIPLTINKEEALQRPVAS
VKLQTVHSIPLTIYKAEASQRPVAS

SEQ ID NO: 58755 - protein, 25 aa, synthetic construct
  source 1..25: note = Seed: VKLQTVHSIPLTINKEEALQRPVAS
VKLQTVHSIPLTIYKAEATQRPVAS

SEQ ID NO: 58756 - protein, 25 aa, synthetic construct
  source 1..25: note = Seed: VKLQTVHSIPLTINKEEALQRPVAS
VKLQTVHSIPLTIYKAEAVQRPVAS

SEQ ID NO: 58757 - protein, 25 aa, synthetic construct
  source 1..25: note = Seed: VKLQTVHSIPLTINKEEALQRPVAS
VKLQTVHSIPLTIYKAEAYQRPVAS

SEQ ID NO: 58758 - protein, 25 aa, synthetic construct
  source 1..25: note = Seed: VKLQTVHSIPLTINKEEALQRPVAS
VKLQTVHSIPLTIYKDEAAQRPVAS

SEQ ID NO: 58759 - protein, 25 aa, synthetic construct
  source 1..25: note = Seed: VKLQTVHSIPLTINKEEALQRPVAS
VKLQTVHSIPLTIYKDEACQRPVAS

SEQ ID NO: 58760 - protein, 25 aa, synthetic construct
  source 1..25: note = Seed: VKLQTVHSIPLTINKEEALQRPVAS
VKLQTVHSIPLTIYKDEAFQRPVAS

SEQ ID NO: 58761 - protein, 25 aa, synthetic construct
  source 1..25: note = Seed: VKLQTVHSIPLTINKEEALQRPVAS
VKLQTVHSIPLTIYKDEAGQRPVAS

SEQ ID NO: 58762 - protein, 25 aa, synthetic construct
  source 1..25: note = Seed: VKLQTVHSIPLTINKEEALQRPVAS
VKLQTVHSIPLTIYKDEAIQRPVAS

SEQ ID NO: 58763 - protein, 25 aa, synthetic construct
  source 1..25: note = Seed: VKLQTVHSIPLTINKEEALQRPVAS
VKLQTVHSIPLTIYKDEALQRPVAS

SEQ ID NO: 58764 - protein, 25 aa, synthetic construct
  source 1..25: note = Seed: VKLQTVHSIPLTINKEEALQRPVAS
VKLQTVHSIPLTIYKDEAMQRPVAS

SEQ ID NO: 58765 - protein, 25 aa, synthetic construct
  source 1..25: note = Seed: VKLQTVHSIPLTINKEEALQRPVAS
VKLQTVHSIPLTIYKDEANQRPVAS

SEQ ID NO: 58766 - protein, 25 aa, synthetic construct
  source 1..25: note = Seed: VKLQTVHSIPLTINKEEALQRPVAS
VKLQTVHSIPLTIYKDEAQQRPVAS

SEQ ID NO: 58767 - protein, 25 aa, synthetic construct
  source 1..25: note = Seed: VKLQTVHSIPLTINKEEALQRPVAS
VKLQTVHSIPLTIYKDEASQRPVAS

SEQ ID NO: 58768 - protein, 25 aa, synthetic construct
  source 1..25: note = Seed: VKLQTVHSIPLTINKEEALQRPVAS
VKLQTVHSIPLTIYKDEATQRPVAS

SEQ ID NO: 58769 - protein, 25 aa, synthetic construct
  source 1..25: note = Seed: VKLQTVHSIPLTINKEEALQRPVAS
VKLQTVHSIPLTIYKDEAVQRPVAS

SEQ ID NO: 58770 - protein, 25 aa, synthetic construct
  source 1..25: note = Seed: VKLQTVHSIPLTINKEEALQRPVAS
VKLQTVHSIPLTIYKDEAYQRPVAS

SEQ ID NO: 58771 - protein, 25 aa, synthetic construct
  source 1..25: note = Seed: VKLQTVHSIPLTINKEEALQRPVAS
VKLQTVHSIPLTIYKFEAAQRPVAS

SEQ ID NO: 58772 - protein, 25 aa, synthetic construct
  source 1..25: note = Seed: VKLQTVHSIPLTINKEEALQRPVAS
VKLQTVHSIPLTIYKFEACQRPVAS

SEQ ID NO: 58773 - protein, 25 aa, synthetic construct
  source 1..25: note = Seed: VKLQTVHSIPLTINKEEALQRPVAS
VKLQTVHSIPLTIYKFEADQRPVAS

SEQ ID NO: 58774 - protein, 25 aa, synthetic construct
  source 1..25: note = Seed: VKLQTVHSIPLTINKEEALQRPVAS
VKLQTVHSIPLTIYKFEAEQRPVAS

SEQ ID NO: 58775 - protein, 25 aa, synthetic construct
  source 1..25: note = Seed: VKLQTVHSIPLTINKEEALQRPVAS
VKLQTVHSIPLTIYKFEAFQRPVAS

SEQ ID NO: 58776 - protein, 25 aa, synthetic construct
  source 1..25: note = Seed: VKLQTVHSIPLTINKEEALQRPVAS
VKLQTVHSIPLTIYKFEAHQRPVAS

SEQ ID NO: 58777 - protein, 25 aa, synthetic construct
  source 1..25: note = Seed: VKLQTVHSIPLTINKEEALQRPVAS
VKLQTVHSIPLTIYKFEAIQRPVAS

SEQ ID NO: 58778 - protein, 25 aa, synthetic construct
  source 1..25: note = Seed: VKLQTVHSIPLTINKEEALQRPVAS
VKLQTVHSIPLTIYKFEAKQRPVAS

SEQ ID NO: 58779 - protein, 25 aa, synthetic construct
  source 1..25: note = Seed: VKLQTVHSIPLTINKEEALQRPVAS
VKLQTVHSIPLTIYKFEALQRPVAS

SEQ ID NO: 58780 - protein, 25 aa, synthetic construct
  source 1..25: note = Seed: VKLQTVHSIPLTINKEEALQRPVAS
VKLQTVHSIPLTIYKFEAMQRPVAS

SEQ ID NO: 58781 - protein, 25 aa, synthetic construct
  source 1..25: note = Seed: VKLQTVHSIPLTINKEEALQRPVAS
VKLQTVHSIPLTIYKFEANQRPVAS

SEQ ID NO: 58782 - protein, 25 aa, synthetic construct
  source 1..25: note = Seed: VKLQTVHSIPLTINKEEALQRPVAS
VKLQTVHSIPLTIYKFEAPQRPVAS

SEQ ID NO: 58783 - protein, 25 aa, synthetic construct
  source 1..25: note = Seed: VKLQTVHSIPLTINKEEALQRPVAS
VKLQTVHSIPLTIYKFEAQQRPVAS

SEQ ID NO: 58784 - protein, 25 aa, synthetic construct
  source 1..25: note = Seed: VKLQTVHSIPLTINKEEALQRPVAS
VKLQTVHSIPLTIYKFEARQRPVAS

SEQ ID NO: 58785 - protein, 25 aa, synthetic construct
  source 1..25: note = Seed: VKLQTVHSIPLTINKEEALQRPVAS
VKLQTVHSIPLTIYKFEASQRPVAS

SEQ ID NO: 58786 - protein, 25 aa, synthetic construct
  source 1..25: note = Seed: VKLQTVHSIPLTINKEEALQRPVAS
VKLQTVHSIPLTIYKFEATQRPVAS

SEQ ID NO: 58787 - protein, 25 aa, synthetic construct
  source 1..25: note = Seed: VKLQTVHSIPLTINKEEALQRPVAS
VKLQTVHSIPLTIYKFEAVQRPVAS

SEQ ID NO: 58788 - protein, 25 aa, synthetic construct
  source 1..25: note = Seed: VKLQTVHSIPLTINKEEALQRPVAS
VKLQTVHSIPLTIYKFEAWQRPVAS

SEQ ID NO: 58789 - protein, 25 aa, synthetic construct
  source 1..25: note = Seed: VKLQTVHSIPLTINKEEALQRPVAS
VKLQTVHSIPLTIYKFEAYQRPVAS

SEQ ID NO: 58790 - protein, 25 aa, synthetic construct
  source 1..25: note = Seed: VKLQTVHSIPLTINKEEALQRPVAS
VKLQTVHSIPLTIYKGEAIQRPVAS

SEQ ID NO: 58791 - protein, 25 aa, synthetic construct
  source 1..25: note = Seed: VKLQTVHSIPLTINKEEALQRPVAS
VKLQTVHSIPLTIYKGEAVQRPVAS

SEQ ID NO: 58792 - protein, 25 aa, synthetic construct
  source 1..25: note = Seed: VKLQTVHSIPLTINKEEALQRPVAS
VKLQTVHSIPLTIYKHEAFQRPVAS

SEQ ID NO: 58793 - protein, 25 aa, synthetic construct
  source 1..25: note = Seed: VKLQTVHSIPLTINKEEALQRPVAS
VKLQTVHSIPLTIYKHEAIQRPVAS

SEQ ID NO: 58794 - protein, 25 aa, synthetic construct
  source 1..25: note = Seed: VKLQTVHSIPLTINKEEALQRPVAS
VKLQTVHSIPLTIYKHEALQRPVAS

SEQ ID NO: 58795 - protein, 25 aa, synthetic construct
  source 1..25: note = Seed: VKLQTVHSIPLTINKEEALQRPVAS
VKLQTVHSIPLTIYKHEAMQRPVAS

SEQ ID NO: 58796 - protein, 25 aa, synthetic construct
  source 1..25: note = Seed: VKLQTVHSIPLTINKEEALQRPVAS
VKLQTVHSIPLTIYKIEAAQRPVAS

SEQ ID NO: 58797 - protein, 25 aa, synthetic construct
  source 1..25: note = Seed: VKLQTVHSIPLTINKEEALQRPVAS
VKLQTVHSIPLTIYKIEACQRPVAS

SEQ ID NO: 58798 - protein, 25 aa, synthetic construct
  source 1..25: note = Seed: VKLQTVHSIPLTINKEEALQRPVAS
VKLQTVHSIPLTIYKIEADQRPVAS

SEQ ID NO: 58799 - protein, 25 aa, synthetic construct
  source 1..25: note = Seed: VKLQTVHSIPLTINKEEALQRPVAS
VKLQTVHSIPLTIYKIEAEQRPVAS

SEQ ID NO: 58800 - protein, 25 aa, synthetic construct
  source 1..25: note = Seed: VKLQTVHSIPLTINKEEALQRPVAS
VKLQTVHSIPLTIYKIEAFQRPVAS

SEQ ID NO: 58801 - protein, 25 aa, synthetic construct
  source 1..25: note = Seed: VKLQTVHSIPLTINKEEALQRPVAS
VKLQTVHSIPLTIYKIEAGQRPVAS

SEQ ID NO: 58802 - protein, 25 aa, synthetic construct
  source 1..25: note = Seed: VKLQTVHSIPLTINKEEALQRPVAS
VKLQTVHSIPLTIYKIEAHQRPVAS

SEQ ID NO: 58803 - protein, 25 aa, synthetic construct
  source 1..25: note = Seed: VKLQTVHSIPLTINKEEALQRPVAS
VKLQTVHSIPLTIYKIEAIQRPVAS

SEQ ID NO: 58804 - protein, 25 aa, synthetic construct
  source 1..25: note = Seed: VKLQTVHSIPLTINKEEALQRPVAS
VKLQTVHSIPLTIYKIEALQRPVAS

SEQ ID NO: 58805 - protein, 25 aa, synthetic construct
  source 1..25: note = Seed: VKLQTVHSIPLTINKEEALQRPVAS
VKLQTVHSIPLTIYKIEAMQRPVAS

SEQ ID NO: 58806 - protein, 25 aa, synthetic construct
  source 1..25: note = Seed: VKLQTVHSIPLTINKEEALQRPVAS
VKLQTVHSIPLTIYKIEANQRPVAS

SEQ ID NO: 58807 - protein, 25 aa, synthetic construct
  source 1..25: note = Seed: VKLQTVHSIPLTINKEEALQRPVAS
VKLQTVHSIPLTIYKIEAQQRPVAS

SEQ ID NO: 58808 - protein, 25 aa, synthetic construct
  source 1..25: note = Seed: VKLQTVHSIPLTINKEEALQRPVAS
VKLQTVHSIPLTIYKIEARQRPVAS

SEQ ID NO: 58809 - protein, 25 aa, synthetic construct
  source 1..25: note = Seed: VKLQTVHSIPLTINKEEALQRPVAS
VKLQTVHSIPLTIYKIEASQRPVAS

SEQ ID NO: 58810 - protein, 25 aa, synthetic construct
  source 1..25: note = Seed: VKLQTVHSIPLTINKEEALQRPVAS
VKLQTVHSIPLTIYKIEATQRPVAS

SEQ ID NO: 58811 - protein, 25 aa, synthetic construct
  source 1..25: note = Seed: VKLQTVHSIPLTINKEEALQRPVAS
VKLQTVHSIPLTIYKIEAVQRPVAS

SEQ ID NO: 58812 - protein, 25 aa, synthetic construct
  source 1..25: note = Seed: VKLQTVHSIPLTINKEEALQRPVAS
VKLQTVHSIPLTIYKIEAYQRPVAS

SEQ ID NO: 58813 - protein, 25 aa, synthetic construct
  source 1..25: note = Seed: VKLQTVHSIPLTINKEEALQRPVAS
VKLQTVHSIPLTIYKKEAFQRPVAS

SEQ ID NO: 58814 - protein, 25 aa, synthetic construct
  source 1..25: note = Seed: VKLQTVHSIPLTINKEEALQRPVAS
VKLQTVHSIPLTIYKKEALQRPVAS

SEQ ID NO: 58815 - protein, 25 aa, synthetic construct
  source 1..25: note = Seed: VKLQTVHSIPLTINKEEALQRPVAS
VKLQTVHSIPLTIYKLEAAQRPVAS

SEQ ID NO: 58816 - protein, 25 aa, synthetic construct
  source 1..25: note = Seed: VKLQTVHSIPLTINKEEALQRPVAS
VKLQTVHSIPLTIYKLEAEQRPVAS

SEQ ID NO: 58817 - protein, 25 aa, synthetic construct
  source 1..25: note = Seed: VKLQTVHSIPLTINKEEALQRPVAS
VKLQTVHSIPLTIYKLEAFQRPVAS

SEQ ID NO: 58818 - protein, 25 aa, synthetic construct
  source 1..25: note = Seed: VKLQTVHSIPLTINKEEALQRPVAS
VKLQTVHSIPLTIYKLEAIQRPVAS

SEQ ID NO: 58819 - protein, 25 aa, synthetic construct
  source 1..25: note = Seed: VKLQTVHSIPLTINKEEALQRPVAS
VKLQTVHSIPLTIYKLEALQRPVAS

SEQ ID NO: 58820 - protein, 25 aa, synthetic construct
  source 1..25: note = Seed: VKLQTVHSIPLTINKEEALQRPVAS
VKLQTVHSIPLTIYKLEAMQRPVAS

SEQ ID NO: 58821 - protein, 25 aa, synthetic construct
  source 1..25: note = Seed: VKLQTVHSIPLTINKEEALQRPVAS
VKLQTVHSIPLTIYKLEANQRPVAS

SEQ ID NO: 58822 - protein, 25 aa, synthetic construct
  source 1..25: note = Seed: VKLQTVHSIPLTINKEEALQRPVAS
VKLQTVHSIPLTIYKLEASQRPVAS

SEQ ID NO: 58823 - protein, 25 aa, synthetic construct
  source 1..25: note = Seed: VKLQTVHSIPLTINKEEALQRPVAS
VKLQTVHSIPLTIYKLEATQRPVAS

SEQ ID NO: 58824 - protein, 25 aa, synthetic construct
  source 1..25: note = Seed: VKLQTVHSIPLTINKEEALQRPVAS
VKLQTVHSIPLTIYKLEAVQRPVAS

SEQ ID NO: 58825 - protein, 25 aa, synthetic construct
  source 1..25: note = Seed: VKLQTVHSIPLTINKEEALQRPVAS
VKLQTVHSIPLTIYKLEAWQRPVAS

SEQ ID NO: 58826 - protein, 25 aa, synthetic construct
  source 1..25: note = Seed: VKLQTVHSIPLTINKEEALQRPVAS
VKLQTVHSIPLTIYKLEAYQRPVAS

SEQ ID NO: 58827 - protein, 25 aa, synthetic construct
  source 1..25: note = Seed: VKLQTVHSIPLTINKEEALQRPVAS
VKLQTVHSIPLTIYKMEAAQRPVAS

SEQ ID NO: 58828 - protein, 25 aa, synthetic construct
  source 1..25: note = Seed: VKLQTVHSIPLTINKEEALQRPVAS
VKLQTVHSIPLTIYKMEAFQRPVAS

SEQ ID NO: 58829 - protein, 25 aa, synthetic construct
  source 1..25: note = Seed: VKLQTVHSIPLTINKEEALQRPVAS
VKLQTVHSIPLTIYKMEAIQRPVAS

SEQ ID NO: 58830 - protein, 25 aa, synthetic construct
  source 1..25: note = Seed: VKLQTVHSIPLTINKEEALQRPVAS
VKLQTVHSIPLTIYKMEALQRPVAS

SEQ ID NO: 58831 - protein, 25 aa, synthetic construct
  source 1..25: note = Seed: VKLQTVHSIPLTINKEEALQRPVAS
VKLQTVHSIPLTIYKMEAMQRPVAS

SEQ ID NO: 58832 - protein, 25 aa, synthetic construct
  source 1..25: note = Seed: VKLQTVHSIPLTINKEEALQRPVAS
VKLQTVHSIPLTIYKMEASQRPVAS

SEQ ID NO: 58833 - protein, 25 aa, synthetic construct
  source 1..25: note = Seed: VKLQTVHSIPLTINKEEALQRPVAS
VKLQTVHSIPLTIYKMEAVQRPVAS

SEQ ID NO: 58834 - protein, 25 aa, synthetic construct
  source 1..25: note = Seed: VKLQTVHSIPLTINKEEALQRPVAS
VKLQTVHSIPLTIYKMEAYQRPVAS

SEQ ID NO: 58835 - protein, 25 aa, synthetic construct
  source 1..25: note = Seed: VKLQTVHSIPLTINKEEALQRPVAS
VKLQTVHSIPLTIYKNEAAQRPVAS

SEQ ID NO: 58836 - protein, 25 aa, synthetic construct
  source 1..25: note = Seed: VKLQTVHSIPLTINKEEALQRPVAS
VKLQTVHSIPLTIYKNEAFQRPVAS

SEQ ID NO: 58837 - protein, 25 aa, synthetic construct
  source 1..25: note = Seed: VKLQTVHSIPLTINKEEALQRPVAS
VKLQTVHSIPLTIYKNEAIQRPVAS

SEQ ID NO: 58838 - protein, 25 aa, synthetic construct
  source 1..25: note = Seed: VKLQTVHSIPLTINKEEALQRPVAS
VKLQTVHSIPLTIYKNEALQRPVAS

SEQ ID NO: 58839 - protein, 25 aa, synthetic construct
  source 1..25: note = Seed: VKLQTVHSIPLTINKEEALQRPVAS
VKLQTVHSIPLTIYKNEAMQRPVAS

SEQ ID NO: 58840 - protein, 25 aa, synthetic construct
  source 1..25: note = Seed: VKLQTVHSIPLTINKEEALQRPVAS
VKLQTVHSIPLTIYKNEASQRPVAS

SEQ ID NO: 58841 - protein, 25 aa, synthetic construct
  source 1..25: note = Seed: VKLQTVHSIPLTINKEEALQRPVAS
VKLQTVHSIPLTIYKNEAVQRPVAS

SEQ ID NO: 58842 - protein, 25 aa, synthetic construct
  source 1..25: note = Seed: VKLQTVHSIPLTINKEEALQRPVAS
VKLQTVHSIPLTIYKNEAYQRPVAS

SEQ ID NO: 58843 - protein, 25 aa, synthetic construct
  source 1..25: note = Seed: VKLQTVHSIPLTINKEEALQRPVAS
VKLQTVHSIPLTIYKPEAAQRPVAS

SEQ ID NO: 58844 - protein, 25 aa, synthetic construct
  source 1..25: note = Seed: VKLQTVHSIPLTINKEEALQRPVAS
VKLQTVHSIPLTIYKPEAIQRPVAS

SEQ ID NO: 58845 - protein, 25 aa, synthetic construct
  source 1..25: note = Seed: VKLQTVHSIPLTINKEEALQRPVAS
VKLQTVHSIPLTIYKPEALQRPVAS

SEQ ID NO: 58846 - protein, 25 aa, synthetic construct
  source 1..25: note = Seed: VKLQTVHSIPLTINKEEALQRPVAS
VKLQTVHSIPLTIYKPEAVQRPVAS

SEQ ID NO: 58847 - protein, 25 aa, synthetic construct
  source 1..25: note = Seed: VKLQTVHSIPLTINKEEALQRPVAS
VKLQTVHSIPLTIYKREAFQRPVAS

SEQ ID NO: 58848 - protein, 25 aa, synthetic construct
  source 1..25: note = Seed: VKLQTVHSIPLTINKEEALQRPVAS
VKLQTVHSIPLTIYKREAIQRPVAS

SEQ ID NO: 58849 - protein, 25 aa, synthetic construct
  source 1..25: note = Seed: VKLQTVHSIPLTINKEEALQRPVAS
VKLQTVHSIPLTIYKREALQRPVAS

SEQ ID NO: 58850 - protein, 25 aa, synthetic construct
  source 1..25: note = Seed: VKLQTVHSIPLTINKEEALQRPVAS
VKLQTVHSIPLTIYKREAMQRPVAS

SEQ ID NO: 58851 - protein, 25 aa, synthetic construct
  source 1..25: note = Seed: VKLQTVHSIPLTINKEEALQRPVAS
VKLQTVHSIPLTIYKREARQRPVAS

SEQ ID NO: 58852 - protein, 25 aa, synthetic construct
  source 1..25: note = Seed: VKLQTVHSIPLTINKEEALQRPVAS
VKLQTVHSIPLTIYKREAVQRPVAS

SEQ ID NO: 58853 - protein, 25 aa, synthetic construct
  source 1..25: note = Seed: VKLQTVHSIPLTINKEEALQRPVAS
VKLQTVHSIPLTIYKREAYQRPVAS

SEQ ID NO: 58854 - protein, 25 aa, synthetic construct
  source 1..25: note = Seed: VKLQTVHSIPLTINKEEALQRPVAS
VKLQTVHSIPLTIYKSEAAQRPVAS

SEQ ID NO: 58855 - protein, 25 aa, synthetic construct
  source 1..25: note = Seed: VKLQTVHSIPLTINKEEALQRPVAS
VKLQTVHSIPLTIYKSEAFQRPVAS

SEQ ID NO: 58856 - protein, 25 aa, synthetic construct
  source 1..25: note = Seed: VKLQTVHSIPLTINKEEALQRPVAS
VKLQTVHSIPLTIYKSEAIQRPVAS

SEQ ID NO: 58857 - protein, 25 aa, synthetic construct
  source 1..25: note = Seed: VKLQTVHSIPLTINKEEALQRPVAS
VKLQTVHSIPLTIYKSEALQRPVAS

SEQ ID NO: 58858 - protein, 25 aa, synthetic construct
  source 1..25: note = Seed: VKLQTVHSIPLTINKEEALQRPVAS
VKLQTVHSIPLTIYKSEAMQRPVAS

SEQ ID NO: 58859 - protein, 25 aa, synthetic construct
  source 1..25: note = Seed: VKLQTVHSIPLTINKEEALQRPVAS
VKLQTVHSIPLTIYKSEAVQRPVAS

SEQ ID NO: 58860 - protein, 25 aa, synthetic construct
  source 1..25: note = Seed: VKLQTVHSIPLTINKEEALQRPVAS
VKLQTVHSIPLTIYKTEAAQRPVAS

SEQ ID NO: 58861 - protein, 25 aa, synthetic construct
  source 1..25: note = Seed: VKLQTVHSIPLTINKEEALQRPVAS
VKLQTVHSIPLTIYKTEAFQRPVAS

SEQ ID NO: 58862 - protein, 25 aa, synthetic construct
  source 1..25: note = Seed: VKLQTVHSIPLTINKEEALQRPVAS
VKLQTVHSIPLTIYKTEAIQRPVAS

SEQ ID NO: 58863 - protein, 25 aa, synthetic construct
  source 1..25: note = Seed: VKLQTVHSIPLTINKEEALQRPVAS
VKLQTVHSIPLTIYKTEALQRPVAS

SEQ ID NO: 58864 - protein, 25 aa, synthetic construct
  source 1..25: note = Seed: VKLQTVHSIPLTINKEEALQRPVAS
VKLQTVHSIPLTIYKTEAMQRPVAS

SEQ ID NO: 58865 - protein, 25 aa, synthetic construct
  source 1..25: note = Seed: VKLQTVHSIPLTINKEEALQRPVAS
VKLQTVHSIPLTIYKTEAVQRPVAS

SEQ ID NO: 58866 - protein, 25 aa, synthetic construct
  source 1..25: note = Seed: VKLQTVHSIPLTINKEEALQRPVAS
VKLQTVHSIPLTIYKVEAAQRPVAS

SEQ ID NO: 58867 - protein, 25 aa, synthetic construct
  source 1..25: note = Seed: VKLQTVHSIPLTINKEEALQRPVAS
VKLQTVHSIPLTIYKVEACQRPVAS

SEQ ID NO: 58868 - protein, 25 aa, synthetic construct
  source 1..25: note = Seed: VKLQTVHSIPLTINKEEALQRPVAS
VKLQTVHSIPLTIYKVEAFQRPVAS

SEQ ID NO: 58869 - protein, 25 aa, synthetic construct
  source 1..25: note = Seed: VKLQTVHSIPLTINKEEALQRPVAS
VKLQTVHSIPLTIYKVEAGQRPVAS

SEQ ID NO: 58870 - protein, 25 aa, synthetic construct
  source 1..25: note = Seed: VKLQTVHSIPLTINKEEALQRPVAS
VKLQTVHSIPLTIYKVEAIQRPVAS

SEQ ID NO: 58871 - protein, 25 aa, synthetic construct
  source 1..25: note = Seed: VKLQTVHSIPLTINKEEALQRPVAS
VKLQTVHSIPLTIYKVEALQRPVAS

SEQ ID NO: 58872 - protein, 25 aa, synthetic construct
  source 1..25: note = Seed: VKLQTVHSIPLTINKEEALQRPVAS
VKLQTVHSIPLTIYKVEAMQRPVAS

SEQ ID NO: 58873 - protein, 25 aa, synthetic construct
  source 1..25: note = Seed: VKLQTVHSIPLTINKEEALQRPVAS
VKLQTVHSIPLTIYKVEANQRPVAS

SEQ ID NO: 58874 - protein, 25 aa, synthetic construct
  source 1..25: note = Seed: VKLQTVHSIPLTINKEEALQRPVAS
VKLQTVHSIPLTIYKVEAQQRPVAS

SEQ ID NO: 58875 - protein, 25 aa, synthetic construct
  source 1..25: note = Seed: VKLQTVHSIPLTINKEEALQRPVAS
VKLQTVHSIPLTIYKVEARQRPVAS

SEQ ID NO: 58876 - protein, 25 aa, synthetic construct
  source 1..25: note = Seed: VKLQTVHSIPLTINKEEALQRPVAS
VKLQTVHSIPLTIYKVEASQRPVAS

SEQ ID NO: 58877 - protein, 25 aa, synthetic construct
  source 1..25: note = Seed: VKLQTVHSIPLTINKEEALQRPVAS
VKLQTVHSIPLTIYKVEATQRPVAS

SEQ ID NO: 58878 - protein, 25 aa, synthetic construct
  source 1..25: note = Seed: VKLQTVHSIPLTINKEEALQRPVAS
VKLQTVHSIPLTIYKVEAVQRPVAS

SEQ ID NO: 58879 - protein, 25 aa, synthetic construct
  source 1..25: note = Seed: VKLQTVHSIPLTINKEEALQRPVAS
VKLQTVHSIPLTIYKVEAYQRPVAS

SEQ ID NO: 58880 - protein, 25 aa, synthetic construct
  source 1..25: note = Seed: VKLQTVHSIPLTINKEEALQRPVAS
VKLQTVHSIPLTIYKWEAAQRPVAS

SEQ ID NO: 58881 - protein, 25 aa, synthetic construct
  source 1..25: note = Seed: VKLQTVHSIPLTINKEEALQRPVAS
VKLQTVHSIPLTIYKWEAFQRPVAS

SEQ ID NO: 58882 - protein, 25 aa, synthetic construct
  source 1..25: note = Seed: VKLQTVHSIPLTINKEEALQRPVAS
VKLQTVHSIPLTIYKWEAIQRPVAS

SEQ ID NO: 58883 - protein, 25 aa, synthetic construct
  source 1..25: note = Seed: VKLQTVHSIPLTINKEEALQRPVAS
VKLQTVHSIPLTIYKWEALQRPVAS

SEQ ID NO: 58884 - protein, 25 aa, synthetic construct
  source 1..25: note = Seed: VKLQTVHSIPLTINKEEALQRPVAS
VKLQTVHSIPLTIYKWEAMQRPVAS

SEQ ID NO: 58885 - protein, 25 aa, synthetic construct
  source 1..25: note = Seed: VKLQTVHSIPLTINKEEALQRPVAS
VKLQTVHSIPLTIYKWEAVQRPVAS

SEQ ID NO: 58886 - protein, 25 aa, synthetic construct
  source 1..25: note = Seed: VKLQTVHSIPLTINKEEALQRPVAS
VKLQTVHSIPLTIYKWEAYQRPVAS

SEQ ID NO: 58887 - protein, 25 aa, synthetic construct
  source 1..25: note = Seed: VKLQTVHSIPLTINKEEALQRPVAS
VKLQTVHSIPLTIYKYEAAQRPVAS

SEQ ID NO: 58888 - protein, 25 aa, synthetic construct
  source 1..25: note = Seed: VKLQTVHSIPLTINKEEALQRPVAS
VKLQTVHSIPLTIYKYEAFQRPVAS

SEQ ID NO: 58889 - protein, 25 aa, synthetic construct
  source 1..25: note = Seed: VKLQTVHSIPLTINKEEALQRPVAS
VKLQTVHSIPLTIYKYEAIQRPVAS

SEQ ID NO: 58890 - protein, 25 aa, synthetic construct
  source 1..25: note = Seed: VKLQTVHSIPLTINKEEALQRPVAS
VKLQTVHSIPLTIYKYEALQRPVAS

SEQ ID NO: 58891 - protein, 25 aa, synthetic construct
  source 1..25: note = Seed: VKLQTVHSIPLTINKEEALQRPVAS
VKLQTVHSIPLTIYKYEAMQRPVAS

SEQ ID NO: 58892 - protein, 25 aa, synthetic construct
  source 1..25: note = Seed: VKLQTVHSIPLTINKEEALQRPVAS
VKLQTVHSIPLTIYKYEAVQRPVAS

SEQ ID NO: 58893 - protein, 25 aa, synthetic construct
  source 1..25: note = Seed: VKLQTVHSIPLTINKEEALQRPVAS
VKLQTVHSIPLTIYKYEAWQRPVAS

SEQ ID NO: 58894 - protein, 25 aa, synthetic construct
  source 1..25: note = Seed: VKLQTVHSIPLTINKEEALQRPVAS
VKLQTVHSIPLTIYKYEAYQRPVAS

SEQ ID NO: 58895 - protein, 25 aa, synthetic construct
  source 1..25: note = Seed: VKLQTVHSIPLTINKEEALQRPVAS
VKLQTVHSIPMTIAKAEAIQRPVAS

SEQ ID NO: 58896 - protein, 25 aa, synthetic construct
  source 1..25: note = Seed: VKLQTVHSIPLTINKEEALQRPVAS
VKLQTVHSIPMTIAKAEALQRPVAS

SEQ ID NO: 58897 - protein, 25 aa, synthetic construct
  source 1..25: note = Seed: VKLQTVHSIPLTINKEEALQRPVAS
VKLQTVHSIPMTIAKAEAVQRPVAS

SEQ ID NO: 58898 - protein, 25 aa, synthetic construct
  source 1..25: note = Seed: VKLQTVHSIPLTINKEEALQRPVAS
VKLQTVHSIPMTIAKDEAIQRPVAS

SEQ ID NO: 58899 - protein, 25 aa, synthetic construct
  source 1..25: note = Seed: VKLQTVHSIPLTINKEEALQRPVAS
VKLQTVHSIPMTIAKFEAFQRPVAS

SEQ ID NO: 58900 - protein, 25 aa, synthetic construct
  source 1..25: note = Seed: VKLQTVHSIPLTINKEEALQRPVAS
VKLQTVHSIPMTIAKFEAIQRPVAS

SEQ ID NO: 58901 - protein, 25 aa, synthetic construct
  source 1..25: note = Seed: VKLQTVHSIPLTINKEEALQRPVAS
VKLQTVHSIPMTIAKFEALQRPVAS

SEQ ID NO: 58902 - protein, 25 aa, synthetic construct
  source 1..25: note = Seed: VKLQTVHSIPLTINKEEALQRPVAS
VKLQTVHSIPMTIAKFEAMQRPVAS

SEQ ID NO: 58903 - protein, 25 aa, synthetic construct
  source 1..25: note = Seed: VKLQTVHSIPLTINKEEALQRPVAS
VKLQTVHSIPMTIAKFEAVQRPVAS

SEQ ID NO: 58904 - protein, 25 aa, synthetic construct
  source 1..25: note = Seed: VKLQTVHSIPLTINKEEALQRPVAS
VKLQTVHSIPMTIAKFEAYQRPVAS

SEQ ID NO: 58905 - protein, 25 aa, synthetic construct
  source 1..25: note = Seed: VKLQTVHSIPLTINKEEALQRPVAS
VKLQTVHSIPMTIAKIEAAQRPVAS

SEQ ID NO: 58906 - protein, 25 aa, synthetic construct
  source 1..25: note = Seed: VKLQTVHSIPLTINKEEALQRPVAS
VKLQTVHSIPMTIAKIEAFQRPVAS

SEQ ID NO: 58907 - protein, 25 aa, synthetic construct
  source 1..25: note = Seed: VKLQTVHSIPLTINKEEALQRPVAS
VKLQTVHSIPMTIAKIEAIQRPVAS

SEQ ID NO: 58908 - protein, 25 aa, synthetic construct
  source 1..25: note = Seed: VKLQTVHSIPLTINKEEALQRPVAS
VKLQTVHSIPMTIAKIEALQRPVAS

SEQ ID NO: 58909 - protein, 25 aa, synthetic construct
  source 1..25: note = Seed: VKLQTVHSIPLTINKEEALQRPVAS
VKLQTVHSIPMTIAKIEAMQRPVAS

SEQ ID NO: 58910 - protein, 25 aa, synthetic construct
  source 1..25: note = Seed: VKLQTVHSIPLTINKEEALQRPVAS
VKLQTVHSIPMTIAKIEASQRPVAS

SEQ ID NO: 58911 - protein, 25 aa, synthetic construct
  source 1..25: note = Seed: VKLQTVHSIPLTINKEEALQRPVAS
VKLQTVHSIPMTIAKIEAVQRPVAS

SEQ ID NO: 58912 - protein, 25 aa, synthetic construct
  source 1..25: note = Seed: VKLQTVHSIPLTINKEEALQRPVAS
VKLQTVHSIPMTIAKIEAYQRPVAS

SEQ ID NO: 58913 - protein, 25 aa, synthetic construct
  source 1..25: note = Seed: VKLQTVHSIPLTINKEEALQRPVAS
VKLQTVHSIPMTIAKLEAAQRPVAS

SEQ ID NO: 58914 - protein, 25 aa, synthetic construct
  source 1..25: note = Seed: VKLQTVHSIPLTINKEEALQRPVAS
VKLQTVHSIPMTIAKLEAIQRPVAS

SEQ ID NO: 58915 - protein, 25 aa, synthetic construct
  source 1..25: note = Seed: VKLQTVHSIPLTINKEEALQRPVAS
VKLQTVHSIPMTIAKLEALQRPVAS

SEQ ID NO: 58916 - protein, 25 aa, synthetic construct
  source 1..25: note = Seed: VKLQTVHSIPLTINKEEALQRPVAS
VKLQTVHSIPMTIAKLEAVQRPVAS

SEQ ID NO: 58917 - protein, 25 aa, synthetic construct
  source 1..25: note = Seed: VKLQTVHSIPLTINKEEALQRPVAS
VKLQTVHSIPMTIAKVEAAQRPVAS

SEQ ID NO: 58918 - protein, 25 aa, synthetic construct
  source 1..25: note = Seed: VKLQTVHSIPLTINKEEALQRPVAS
VKLQTVHSIPMTIAKVEAFQRPVAS

SEQ ID NO: 58919 - protein, 25 aa, synthetic construct
  source 1..25: note = Seed: VKLQTVHSIPLTINKEEALQRPVAS
VKLQTVHSIPMTIAKVEAIQRPVAS

SEQ ID NO: 58920 - protein, 25 aa, synthetic construct
  source 1..25: note = Seed: VKLQTVHSIPLTINKEEALQRPVAS
VKLQTVHSIPMTIAKVEALQRPVAS

SEQ ID NO: 58921 - protein, 25 aa, synthetic construct
  source 1..25: note = Seed: VKLQTVHSIPLTINKEEALQRPVAS
VKLQTVHSIPMTIAKVEAMQRPVAS

SEQ ID NO: 58922 - protein, 25 aa, synthetic construct
  source 1..25: note = Seed: VKLQTVHSIPLTINKEEALQRPVAS
VKLQTVHSIPMTIAKVEAVQRPVAS

SEQ ID NO: 58923 - protein, 25 aa, synthetic construct
  source 1..25: note = Seed: VKLQTVHSIPLTINKEEALQRPVAS
VKLQTVHSIPMTICKFEAFQRPVAS

SEQ ID NO: 58924 - protein, 25 aa, synthetic construct
  source 1..25: note = Seed: VKLQTVHSIPLTINKEEALQRPVAS
VKLQTVHSIPMTICKFEALQRPVAS

SEQ ID NO: 58925 - protein, 25 aa, synthetic construct
  source 1..25: note = Seed: VKLQTVHSIPLTINKEEALQRPVAS
VKLQTVHSIPMTIEKFEAFQRPVAS

SEQ ID NO: 58926 - protein, 25 aa, synthetic construct
  source 1..25: note = Seed: VKLQTVHSIPLTINKEEALQRPVAS
VKLQTVHSIPMTIEKFEAIQRPVAS

SEQ ID NO: 58927 - protein, 25 aa, synthetic construct
  source 1..25: note = Seed: VKLQTVHSIPLTINKEEALQRPVAS
VKLQTVHSIPMTIEKFEALQRPVAS

SEQ ID NO: 58928 - protein, 25 aa, synthetic construct
  source 1..25: note = Seed: VKLQTVHSIPLTINKEEALQRPVAS
VKLQTVHSIPMTIEKFEAMQRPVAS

SEQ ID NO: 58929 - protein, 25 aa, synthetic construct
  source 1..25: note = Seed: VKLQTVHSIPLTINKEEALQRPVAS
VKLQTVHSIPMTIEKFEAVQRPVAS

SEQ ID NO: 58930 - protein, 25 aa, synthetic construct
  source 1..25: note = Seed: VKLQTVHSIPLTINKEEALQRPVAS
VKLQTVHSIPMTIEKFEAYQRPVAS

SEQ ID NO: 58931 - protein, 25 aa, synthetic construct
  source 1..25: note = Seed: VKLQTVHSIPLTINKEEALQRPVAS
VKLQTVHSIPMTIFKAEAAQRPVAS

SEQ ID NO: 58932 - protein, 25 aa, synthetic construct
  source 1..25: note = Seed: VKLQTVHSIPLTINKEEALQRPVAS
VKLQTVHSIPMTIFKAEACQRPVAS

SEQ ID NO: 58933 - protein, 25 aa, synthetic construct
  source 1..25: note = Seed: VKLQTVHSIPLTINKEEALQRPVAS
VKLQTVHSIPMTIFKAEAFQRPVAS

SEQ ID NO: 58934 - protein, 25 aa, synthetic construct
  source 1..25: note = Seed: VKLQTVHSIPLTINKEEALQRPVAS
VKLQTVHSIPMTIFKAEAGQRPVAS

SEQ ID NO: 58935 - protein, 25 aa, synthetic construct
  source 1..25: note = Seed: VKLQTVHSIPLTINKEEALQRPVAS
VKLQTVHSIPMTIFKAEAIQRPVAS

SEQ ID NO: 58936 - protein, 25 aa, synthetic construct
  source 1..25: note = Seed: VKLQTVHSIPLTINKEEALQRPVAS
VKLQTVHSIPMTIFKAEALQRPVAS

SEQ ID NO: 58937 - protein, 25 aa, synthetic construct
  source 1..25: note = Seed: VKLQTVHSIPLTINKEEALQRPVAS
VKLQTVHSIPMTIFKAEAMQRPVAS

SEQ ID NO: 58938 - protein, 25 aa, synthetic construct
  source 1..25: note = Seed: VKLQTVHSIPLTINKEEALQRPVAS
VKLQTVHSIPMTIFKAEAQQRPVAS

SEQ ID NO: 58939 - protein, 25 aa, synthetic construct
  source 1..25: note = Seed: VKLQTVHSIPLTINKEEALQRPVAS
VKLQTVHSIPMTIFKAEASQRPVAS

SEQ ID NO: 58940 - protein, 25 aa, synthetic construct
  source 1..25: note = Seed: VKLQTVHSIPLTINKEEALQRPVAS
VKLQTVHSIPMTIFKAEATQRPVAS

SEQ ID NO: 58941 - protein, 25 aa, synthetic construct
  source 1..25: note = Seed: VKLQTVHSIPLTINKEEALQRPVAS
VKLQTVHSIPMTIFKAEAVQRPVAS

SEQ ID NO: 58942 - protein, 25 aa, synthetic construct
  source 1..25: note = Seed: VKLQTVHSIPLTINKEEALQRPVAS
VKLQTVHSIPMTIFKAEAYQRPVAS

SEQ ID NO: 58943 - protein, 25 aa, synthetic construct
  source 1..25: note = Seed: VKLQTVHSIPLTINKEEALQRPVAS
VKLQTVHSIPMTIFKDEAAQRPVAS

SEQ ID NO: 58944 - protein, 25 aa, synthetic construct
  source 1..25: note = Seed: VKLQTVHSIPLTINKEEALQRPVAS
VKLQTVHSIPMTIFKDEACQRPVAS

SEQ ID NO: 58945 - protein, 25 aa, synthetic construct
  source 1..25: note = Seed: VKLQTVHSIPLTINKEEALQRPVAS
VKLQTVHSIPMTIFKDEAFQRPVAS

SEQ ID NO: 58946 - protein, 25 aa, synthetic construct
  source 1..25: note = Seed: VKLQTVHSIPLTINKEEALQRPVAS
VKLQTVHSIPMTIFKDEAGQRPVAS

SEQ ID NO: 58947 - protein, 25 aa, synthetic construct
  source 1..25: note = Seed: VKLQTVHSIPLTINKEEALQRPVAS
VKLQTVHSIPMTIFKDEAIQRPVAS

SEQ ID NO: 58948 - protein, 25 aa, synthetic construct
  source 1..25: note = Seed: VKLQTVHSIPLTINKEEALQRPVAS
VKLQTVHSIPMTIFKDEALQRPVAS

SEQ ID NO: 58949 - protein, 25 aa, synthetic construct
  source 1..25: note = Seed: VKLQTVHSIPLTINKEEALQRPVAS
VKLQTVHSIPMTIFKDEAMQRPVAS

SEQ ID NO: 58950 - protein, 25 aa, synthetic construct
  source 1..25: note = Seed: VKLQTVHSIPLTINKEEALQRPVAS
VKLQTVHSIPMTIFKDEAQQRPVAS

SEQ ID NO: 58951 - protein, 25 aa, synthetic construct
  source 1..25: note = Seed: VKLQTVHSIPLTINKEEALQRPVAS
VKLQTVHSIPMTIFKDEASQRPVAS

SEQ ID NO: 58952 - protein, 25 aa, synthetic construct
  source 1..25: note = Seed: VKLQTVHSIPLTINKEEALQRPVAS
VKLQTVHSIPMTIFKDEATQRPVAS

SEQ ID NO: 58953 - protein, 25 aa, synthetic construct
  source 1..25: note = Seed: VKLQTVHSIPLTINKEEALQRPVAS
VKLQTVHSIPMTIFKDEAVQRPVAS

SEQ ID NO: 58954 - protein, 25 aa, synthetic construct
  source 1..25: note = Seed: VKLQTVHSIPLTINKEEALQRPVAS
VKLQTVHSIPMTIFKDEAYQRPVAS

SEQ ID NO: 58955 - protein, 25 aa, synthetic construct
  source 1..25: note = Seed: VKLQTVHSIPLTINKEEALQRPVAS
VKLQTVHSIPMTIFKFEAAQRPVAS

SEQ ID NO: 58956 - protein, 25 aa, synthetic construct
  source 1..25: note = Seed: VKLQTVHSIPLTINKEEALQRPVAS
VKLQTVHSIPMTIFKFEADQRPVAS

SEQ ID NO: 58957 - protein, 25 aa, synthetic construct
  source 1..25: note = Seed: VKLQTVHSIPLTINKEEALQRPVAS
VKLQTVHSIPMTIFKFEAEQRPVAS

SEQ ID NO: 58958 - protein, 25 aa, synthetic construct
  source 1..25: note = Seed: VKLQTVHSIPLTINKEEALQRPVAS
VKLQTVHSIPMTIFKFEAFQRPVAS

SEQ ID NO: 58959 - protein, 25 aa, synthetic construct
  source 1..25: note = Seed: VKLQTVHSIPLTINKEEALQRPVAS
VKLQTVHSIPMTIFKFEAHQRPVAS

SEQ ID NO: 58960 - protein, 25 aa, synthetic construct
  source 1..25: note = Seed: VKLQTVHSIPLTINKEEALQRPVAS
VKLQTVHSIPMTIFKFEAIQRPVAS

SEQ ID NO: 58961 - protein, 25 aa, synthetic construct
  source 1..25: note = Seed: VKLQTVHSIPLTINKEEALQRPVAS
VKLQTVHSIPMTIFKFEALQRPVAS

SEQ ID NO: 58962 - protein, 25 aa, synthetic construct
  source 1..25: note = Seed: VKLQTVHSIPLTINKEEALQRPVAS
VKLQTVHSIPMTIFKFEAMQRPVAS

SEQ ID NO: 58963 - protein, 25 aa, synthetic construct
  source 1..25: note = Seed: VKLQTVHSIPLTINKEEALQRPVAS
VKLQTVHSIPMTIFKFEANQRPVAS

SEQ ID NO: 58964 - protein, 25 aa, synthetic construct
  source 1..25: note = Seed: VKLQTVHSIPLTINKEEALQRPVAS
VKLQTVHSIPMTIFKFEAPQRPVAS

SEQ ID NO: 58965 - protein, 25 aa, synthetic construct
  source 1..25: note = Seed: VKLQTVHSIPLTINKEEALQRPVAS
VKLQTVHSIPMTIFKFEAQQRPVAS

SEQ ID NO: 58966 - protein, 25 aa, synthetic construct
  source 1..25: note = Seed: VKLQTVHSIPLTINKEEALQRPVAS
VKLQTVHSIPMTIFKFEARQRPVAS

SEQ ID NO: 58967 - protein, 25 aa, synthetic construct
  source 1..25: note = Seed: VKLQTVHSIPLTINKEEALQRPVAS
VKLQTVHSIPMTIFKFEASQRPVAS

SEQ ID NO: 58968 - protein, 25 aa, synthetic construct
  source 1..25: note = Seed: VKLQTVHSIPLTINKEEALQRPVAS
VKLQTVHSIPMTIFKFEATQRPVAS

SEQ ID NO: 58969 - protein, 25 aa, synthetic construct
  source 1..25: note = Seed: VKLQTVHSIPLTINKEEALQRPVAS
VKLQTVHSIPMTIFKFEAVQRPVAS

SEQ ID NO: 58970 - protein, 25 aa, synthetic construct
  source 1..25: note = Seed: VKLQTVHSIPLTINKEEALQRPVAS
VKLQTVHSIPMTIFKFEAWQRPVAS

SEQ ID NO: 58971 - protein, 25 aa, synthetic construct
  source 1..25: note = Seed: VKLQTVHSIPLTINKEEALQRPVAS
VKLQTVHSIPMTIFKFEAYQRPVAS

SEQ ID NO: 58972 - protein, 25 aa, synthetic construct
  source 1..25: note = Seed: VKLQTVHSIPLTINKEEALQRPVAS
VKLQTVHSIPMTIFKGEAAQRPVAS

SEQ ID NO: 58973 - protein, 25 aa, synthetic construct
  source 1..25: note = Seed: VKLQTVHSIPLTINKEEALQRPVAS
VKLQTVHSIPMTIFKGEAIQRPVAS

SEQ ID NO: 58974 - protein, 25 aa, synthetic construct
  source 1..25: note = Seed: VKLQTVHSIPLTINKEEALQRPVAS
VKLQTVHSIPMTIFKGEALQRPVAS

SEQ ID NO: 58975 - protein, 25 aa, synthetic construct
  source 1..25: note = Seed: VKLQTVHSIPLTINKEEALQRPVAS
VKLQTVHSIPMTIFKGEAVQRPVAS

SEQ ID NO: 58976 - protein, 25 aa, synthetic construct
  source 1..25: note = Seed: VKLQTVHSIPLTINKEEALQRPVAS
VKLQTVHSIPMTIFKHEAFQRPVAS

SEQ ID NO: 58977 - protein, 25 aa, synthetic construct
  source 1..25: note = Seed: VKLQTVHSIPLTINKEEALQRPVAS
VKLQTVHSIPMTIFKHEAIQRPVAS

SEQ ID NO: 58978 - protein, 25 aa, synthetic construct
  source 1..25: note = Seed: VKLQTVHSIPLTINKEEALQRPVAS
VKLQTVHSIPMTIFKHEALQRPVAS

SEQ ID NO: 58979 - protein, 25 aa, synthetic construct
  source 1..25: note = Seed: VKLQTVHSIPLTINKEEALQRPVAS
VKLQTVHSIPMTIFKHEAMQRPVAS

SEQ ID NO: 58980 - protein, 25 aa, synthetic construct
  source 1..25: note = Seed: VKLQTVHSIPLTINKEEALQRPVAS
VKLQTVHSIPMTIFKHEAVQRPVAS

SEQ ID NO: 58981 - protein, 25 aa, synthetic construct
  source 1..25: note = Seed: VKLQTVHSIPLTINKEEALQRPVAS
VKLQTVHSIPMTIFKHEAYQRPVAS

SEQ ID NO: 58982 - protein, 25 aa, synthetic construct
  source 1..25: note = Seed: VKLQTVHSIPLTINKEEALQRPVAS
VKLQTVHSIPMTIFKIEAAQRPVAS

SEQ ID NO: 58983 - protein, 25 aa, synthetic construct
  source 1..25: note = Seed: VKLQTVHSIPLTINKEEALQRPVAS
VKLQTVHSIPMTIFKIEACQRPVAS

SEQ ID NO: 58984 - protein, 25 aa, synthetic construct
  source 1..25: note = Seed: VKLQTVHSIPLTINKEEALQRPVAS
VKLQTVHSIPMTIFKIEADQRPVAS

SEQ ID NO: 58985 - protein, 25 aa, synthetic construct
  source 1..25: note = Seed: VKLQTVHSIPLTINKEEALQRPVAS
VKLQTVHSIPMTIFKIEAEQRPVAS

SEQ ID NO: 58986 - protein, 25 aa, synthetic construct
  source 1..25: note = Seed: VKLQTVHSIPLTINKEEALQRPVAS
VKLQTVHSIPMTIFKIEAFQRPVAS

SEQ ID NO: 58987 - protein, 25 aa, synthetic construct
  source 1..25: note = Seed: VKLQTVHSIPLTINKEEALQRPVAS
VKLQTVHSIPMTIFKIEAGQRPVAS

SEQ ID NO: 58988 - protein, 25 aa, synthetic construct
  source 1..25: note = Seed: VKLQTVHSIPLTINKEEALQRPVAS
VKLQTVHSIPMTIFKIEAHQRPVAS

SEQ ID NO: 58989 - protein, 25 aa, synthetic construct
  source 1..25: note = Seed: VKLQTVHSIPLTINKEEALQRPVAS
VKLQTVHSIPMTIFKIEAIQRPVAS

SEQ ID NO: 58990 - protein, 25 aa, synthetic construct
  source 1..25: note = Seed: VKLQTVHSIPLTINKEEALQRPVAS
VKLQTVHSIPMTIFKIEALQRPVAS

SEQ ID NO: 58991 - protein, 25 aa, synthetic construct
  source 1..25: note = Seed: VKLQTVHSIPLTINKEEALQRPVAS
VKLQTVHSIPMTIFKIEAMQRPVAS

SEQ ID NO: 58992 - protein, 25 aa, synthetic construct
  source 1..25: note = Seed: VKLQTVHSIPLTINKEEALQRPVAS
VKLQTVHSIPMTIFKIEANQRPVAS

SEQ ID NO: 58993 - protein, 25 aa, synthetic construct
  source 1..25: note = Seed: VKLQTVHSIPLTINKEEALQRPVAS
VKLQTVHSIPMTIFKIEAPQRPVAS

SEQ ID NO: 58994 - protein, 25 aa, synthetic construct
  source 1..25: note = Seed: VKLQTVHSIPLTINKEEALQRPVAS
VKLQTVHSIPMTIFKIEAQQRPVAS

SEQ ID NO: 58995 - protein, 25 aa, synthetic construct
  source 1..25: note = Seed: VKLQTVHSIPLTINKEEALQRPVAS
VKLQTVHSIPMTIFKIEARQRPVAS

SEQ ID NO: 58996 - protein, 25 aa, synthetic construct
  source 1..25: note = Seed: VKLQTVHSIPLTINKEEALQRPVAS
VKLQTVHSIPMTIFKIEASQRPVAS

SEQ ID NO: 58997 - protein, 25 aa, synthetic construct
  source 1..25: note = Seed: VKLQTVHSIPLTINKEEALQRPVAS
VKLQTVHSIPMTIFKIEATQRPVAS

SEQ ID NO: 58998 - protein, 25 aa, synthetic construct
  source 1..25: note = Seed: VKLQTVHSIPLTINKEEALQRPVAS
VKLQTVHSIPMTIFKIEAVQRPVAS

SEQ ID NO: 58999 - protein, 25 aa, synthetic construct
  source 1..25: note = Seed: VKLQTVHSIPLTINKEEALQRPVAS
VKLQTVHSIPMTIFKIEAWQRPVAS

SEQ ID NO: 59000 - protein, 25 aa, synthetic construct
  source 1..25: note = Seed: VKLQTVHSIPLTINKEEALQRPVAS
VKLQTVHSIPMTIFKIEAYQRPVAS

SEQ ID NO: 59001 - protein, 25 aa, synthetic construct
  source 1..25: note = Seed: VKLQTVHSIPLTINKEEALQRPVAS
VKLQTVHSIPMTIFKKEAFQRPVAS

SEQ ID NO: 59002 - protein, 25 aa, synthetic construct
  source 1..25: note = Seed: VKLQTVHSIPLTINKEEALQRPVAS
VKLQTVHSIPMTIFKKEAIQRPVAS

SEQ ID NO: 59003 - protein, 25 aa, synthetic construct
  source 1..25: note = Seed: VKLQTVHSIPLTINKEEALQRPVAS
VKLQTVHSIPMTIFKKEALQRPVAS

SEQ ID NO: 59004 - protein, 25 aa, synthetic construct
  source 1..25: note = Seed: VKLQTVHSIPLTINKEEALQRPVAS
VKLQTVHSIPMTIFKKEAMQRPVAS

SEQ ID NO: 59005 - protein, 25 aa, synthetic construct
  source 1..25: note = Seed: VKLQTVHSIPLTINKEEALQRPVAS
VKLQTVHSIPMTIFKKEAVQRPVAS

SEQ ID NO: 59006 - protein, 25 aa, synthetic construct
  source 1..25: note = Seed: VKLQTVHSIPLTINKEEALQRPVAS
VKLQTVHSIPMTIFKLEAAQRPVAS

SEQ ID NO: 59007 - protein, 25 aa, synthetic construct
  source 1..25: note = Seed: VKLQTVHSIPLTINKEEALQRPVAS
VKLQTVHSIPMTIFKLEADQRPVAS

SEQ ID NO: 59008 - protein, 25 aa, synthetic construct
  source 1..25: note = Seed: VKLQTVHSIPLTINKEEALQRPVAS
VKLQTVHSIPMTIFKLEAFQRPVAS

SEQ ID NO: 59009 - protein, 25 aa, synthetic construct
  source 1..25: note = Seed: VKLQTVHSIPLTINKEEALQRPVAS
VKLQTVHSIPMTIFKLEAGQRPVAS

SEQ ID NO: 59010 - protein, 25 aa, synthetic construct
  source 1..25: note = Seed: VKLQTVHSIPLTINKEEALQRPVAS
VKLQTVHSIPMTIFKLEAHQRPVAS

SEQ ID NO: 59011 - protein, 25 aa, synthetic construct
  source 1..25: note = Seed: VKLQTVHSIPLTINKEEALQRPVAS
VKLQTVHSIPMTIFKLEAIQRPVAS

SEQ ID NO: 59012 - protein, 25 aa, synthetic construct
  source 1..25: note = Seed: VKLQTVHSIPLTINKEEALQRPVAS
VKLQTVHSIPMTIFKLEALQRPVAS

SEQ ID NO: 59013 - protein, 25 aa, synthetic construct
  source 1..25: note = Seed: VKLQTVHSIPLTINKEEALQRPVAS
VKLQTVHSIPMTIFKLEAMQRPVAS

SEQ ID NO: 59014 - protein, 25 aa, synthetic construct
  source 1..25: note = Seed: VKLQTVHSIPLTINKEEALQRPVAS
VKLQTVHSIPMTIFKLEANQRPVAS

SEQ ID NO: 59015 - protein, 25 aa, synthetic construct
  source 1..25: note = Seed: VKLQTVHSIPLTINKEEALQRPVAS
VKLQTVHSIPMTIFKLEAQQRPVAS

SEQ ID NO: 59016 - protein, 25 aa, synthetic construct
  source 1..25: note = Seed: VKLQTVHSIPLTINKEEALQRPVAS
VKLQTVHSIPMTIFKLEASQRPVAS

SEQ ID NO: 59017 - protein, 25 aa, synthetic construct
  source 1..25: note = Seed: VKLQTVHSIPLTINKEEALQRPVAS
VKLQTVHSIPMTIFKLEATQRPVAS

SEQ ID NO: 59018 - protein, 25 aa, synthetic construct
  source 1..25: note = Seed: VKLQTVHSIPLTINKEEALQRPVAS
VKLQTVHSIPMTIFKLEAVQRPVAS

SEQ ID NO: 59019 - protein, 25 aa, synthetic construct
  source 1..25: note = Seed: VKLQTVHSIPLTINKEEALQRPVAS
VKLQTVHSIPMTIFKLEAWQRPVAS

SEQ ID NO: 59020 - protein, 25 aa, synthetic construct
  source 1..25: note = Seed: VKLQTVHSIPLTINKEEALQRPVAS
VKLQTVHSIPMTIFKLEAYQRPVAS

SEQ ID NO: 59021 - protein, 25 aa, synthetic construct
  source 1..25: note = Seed: VKLQTVHSIPLTINKEEALQRPVAS
VKLQTVHSIPMTIFKMEAAQRPVAS

SEQ ID NO: 59022 - protein, 25 aa, synthetic construct
  source 1..25: note = Seed: VKLQTVHSIPLTINKEEALQRPVAS
VKLQTVHSIPMTIFKMEADQRPVAS

SEQ ID NO: 59023 - protein, 25 aa, synthetic construct
  source 1..25: note = Seed: VKLQTVHSIPLTINKEEALQRPVAS
VKLQTVHSIPMTIFKMEAFQRPVAS

SEQ ID NO: 59024 - protein, 25 aa, synthetic construct
  source 1..25: note = Seed: VKLQTVHSIPLTINKEEALQRPVAS
VKLQTVHSIPMTIFKMEAGQRPVAS

SEQ ID NO: 59025 - protein, 25 aa, synthetic construct
  source 1..25: note = Seed: VKLQTVHSIPLTINKEEALQRPVAS
VKLQTVHSIPMTIFKMEAIQRPVAS

SEQ ID NO: 59026 - protein, 25 aa, synthetic construct
  source 1..25: note = Seed: VKLQTVHSIPLTINKEEALQRPVAS
VKLQTVHSIPMTIFKMEALQRPVAS

SEQ ID NO: 59027 - protein, 25 aa, synthetic construct
  source 1..25: note = Seed: VKLQTVHSIPLTINKEEALQRPVAS
VKLQTVHSIPMTIFKMEAMQRPVAS

SEQ ID NO: 59028 - protein, 25 aa, synthetic construct
  source 1..25: note = Seed: VKLQTVHSIPLTINKEEALQRPVAS
VKLQTVHSIPMTIFKMEANQRPVAS

SEQ ID NO: 59029 - protein, 25 aa, synthetic construct
  source 1..25: note = Seed: VKLQTVHSIPLTINKEEALQRPVAS
VKLQTVHSIPMTIFKMEAQQRPVAS

SEQ ID NO: 59030 - protein, 25 aa, synthetic construct
  source 1..25: note = Seed: VKLQTVHSIPLTINKEEALQRPVAS
VKLQTVHSIPMTIFKMEASQRPVAS

SEQ ID NO: 59031 - protein, 25 aa, synthetic construct
  source 1..25: note = Seed: VKLQTVHSIPLTINKEEALQRPVAS
VKLQTVHSIPMTIFKMEATQRPVAS

SEQ ID NO: 59032 - protein, 25 aa, synthetic construct
  source 1..25: note = Seed: VKLQTVHSIPLTINKEEALQRPVAS
VKLQTVHSIPMTIFKMEAVQRPVAS

SEQ ID NO: 59033 - protein, 25 aa, synthetic construct
  source 1..25: note = Seed: VKLQTVHSIPLTINKEEALQRPVAS
VKLQTVHSIPMTIFKMEAYQRPVAS

SEQ ID NO: 59034 - protein, 25 aa, synthetic construct
  source 1..25: note = Seed: VKLQTVHSIPLTINKEEALQRPVAS
VKLQTVHSIPMTIFKNEAAQRPVAS

SEQ ID NO: 59035 - protein, 25 aa, synthetic construct
  source 1..25: note = Seed: VKLQTVHSIPLTINKEEALQRPVAS
VKLQTVHSIPMTIFKNEAFQRPVAS

SEQ ID NO: 59036 - protein, 25 aa, synthetic construct
  source 1..25: note = Seed: VKLQTVHSIPLTINKEEALQRPVAS
VKLQTVHSIPMTIFKNEAIQRPVAS

SEQ ID NO: 59037 - protein, 25 aa, synthetic construct
  source 1..25: note = Seed: VKLQTVHSIPLTINKEEALQRPVAS
VKLQTVHSIPMTIFKNEALQRPVAS

SEQ ID NO: 59038 - protein, 25 aa, synthetic construct
  source 1..25: note = Seed: VKLQTVHSIPLTINKEEALQRPVAS
VKLQTVHSIPMTIFKNEAMQRPVAS

SEQ ID NO: 59039 - protein, 25 aa, synthetic construct
  source 1..25: note = Seed: VKLQTVHSIPLTINKEEALQRPVAS
VKLQTVHSIPMTIFKNEASQRPVAS

SEQ ID NO: 59040 - protein, 25 aa, synthetic construct
  source 1..25: note = Seed: VKLQTVHSIPLTINKEEALQRPVAS
VKLQTVHSIPMTIFKNEAVQRPVAS

SEQ ID NO: 59041 - protein, 25 aa, synthetic construct
  source 1..25: note = Seed: VKLQTVHSIPLTINKEEALQRPVAS
VKLQTVHSIPMTIFKPEAAQRPVAS

SEQ ID NO: 59042 - protein, 25 aa, synthetic construct
  source 1..25: note = Seed: VKLQTVHSIPLTINKEEALQRPVAS
VKLQTVHSIPMTIFKPEAIQRPVAS

SEQ ID NO: 59043 - protein, 25 aa, synthetic construct
  source 1..25: note = Seed: VKLQTVHSIPLTINKEEALQRPVAS
VKLQTVHSIPMTIFKPEALQRPVAS

SEQ ID NO: 59044 - protein, 25 aa, synthetic construct
  source 1..25: note = Seed: VKLQTVHSIPLTINKEEALQRPVAS
VKLQTVHSIPMTIFKPEAVQRPVAS

SEQ ID NO: 59045 - protein, 25 aa, synthetic construct
  source 1..25: note = Seed: VKLQTVHSIPLTINKEEALQRPVAS
VKLQTVHSIPMTIFKQEAFQRPVAS

SEQ ID NO: 59046 - protein, 25 aa, synthetic construct
  source 1..25: note = Seed: VKLQTVHSIPLTINKEEALQRPVAS
VKLQTVHSIPMTIFKREAFQRPVAS

SEQ ID NO: 59047 - protein, 25 aa, synthetic construct
  source 1..25: note = Seed: VKLQTVHSIPLTINKEEALQRPVAS
VKLQTVHSIPMTIFKREAHQRPVAS

SEQ ID NO: 59048 - protein, 25 aa, synthetic construct
  source 1..25: note = Seed: VKLQTVHSIPLTINKEEALQRPVAS
VKLQTVHSIPMTIFKREAIQRPVAS

SEQ ID NO: 59049 - protein, 25 aa, synthetic construct
  source 1..25: note = Seed: VKLQTVHSIPLTINKEEALQRPVAS
VKLQTVHSIPMTIFKREALQRPVAS

SEQ ID NO: 59050 - protein, 25 aa, synthetic construct
  source 1..25: note = Seed: VKLQTVHSIPLTINKEEALQRPVAS
VKLQTVHSIPMTIFKREAMQRPVAS

SEQ ID NO: 59051 - protein, 25 aa, synthetic construct
  source 1..25: note = Seed: VKLQTVHSIPLTINKEEALQRPVAS
VKLQTVHSIPMTIFKREARQRPVAS

SEQ ID NO: 59052 - protein, 25 aa, synthetic construct
  source 1..25: note = Seed: VKLQTVHSIPLTINKEEALQRPVAS
VKLQTVHSIPMTIFKREAVQRPVAS

SEQ ID NO: 59053 - protein, 25 aa, synthetic construct
  source 1..25: note = Seed: VKLQTVHSIPLTINKEEALQRPVAS
VKLQTVHSIPMTIFKREAYQRPVAS

SEQ ID NO: 59054 - protein, 25 aa, synthetic construct
  source 1..25: note = Seed: VKLQTVHSIPLTINKEEALQRPVAS
VKLQTVHSIPMTIFKSEAAQRPVAS

SEQ ID NO: 59055 - protein, 25 aa, synthetic construct
  source 1..25: note = Seed: VKLQTVHSIPLTINKEEALQRPVAS
VKLQTVHSIPMTIFKSEAFQRPVAS

SEQ ID NO: 59056 - protein, 25 aa, synthetic construct
  source 1..25: note = Seed: VKLQTVHSIPLTINKEEALQRPVAS
VKLQTVHSIPMTIFKSEAIQRPVAS

SEQ ID NO: 59057 - protein, 25 aa, synthetic construct
  source 1..25: note = Seed: VKLQTVHSIPLTINKEEALQRPVAS
VKLQTVHSIPMTIFKSEALQRPVAS

SEQ ID NO: 59058 - protein, 25 aa, synthetic construct
  source 1..25: note = Seed: VKLQTVHSIPLTINKEEALQRPVAS
VKLQTVHSIPMTIFKSEAMQRPVAS

SEQ ID NO: 59059 - protein, 25 aa, synthetic construct
  source 1..25: note = Seed: VKLQTVHSIPLTINKEEALQRPVAS
VKLQTVHSIPMTIFKSEASQRPVAS

SEQ ID NO: 59060 - protein, 25 aa, synthetic construct
  source 1..25: note = Seed: VKLQTVHSIPLTINKEEALQRPVAS
VKLQTVHSIPMTIFKSEAVQRPVAS

SEQ ID NO: 59061 - protein, 25 aa, synthetic construct
  source 1..25: note = Seed: VKLQTVHSIPLTINKEEALQRPVAS
VKLQTVHSIPMTIFKTEAAQRPVAS

SEQ ID NO: 59062 - protein, 25 aa, synthetic construct
  source 1..25: note = Seed: VKLQTVHSIPLTINKEEALQRPVAS
VKLQTVHSIPMTIFKTEAFQRPVAS

SEQ ID NO: 59063 - protein, 25 aa, synthetic construct
  source 1..25: note = Seed: VKLQTVHSIPLTINKEEALQRPVAS
VKLQTVHSIPMTIFKTEAIQRPVAS

SEQ ID NO: 59064 - protein, 25 aa, synthetic construct
  source 1..25: note = Seed: VKLQTVHSIPLTINKEEALQRPVAS
VKLQTVHSIPMTIFKTEALQRPVAS

SEQ ID NO: 59065 - protein, 25 aa, synthetic construct
  source 1..25: note = Seed: VKLQTVHSIPLTINKEEALQRPVAS
VKLQTVHSIPMTIFKTEAMQRPVAS

SEQ ID NO: 59066 - protein, 25 aa, synthetic construct
  source 1..25: note = Seed: VKLQTVHSIPLTINKEEALQRPVAS
VKLQTVHSIPMTIFKTEASQRPVAS

SEQ ID NO: 59067 - protein, 25 aa, synthetic construct
  source 1..25: note = Seed: VKLQTVHSIPLTINKEEALQRPVAS
VKLQTVHSIPMTIFKTEAVQRPVAS

SEQ ID NO: 59068 - protein, 25 aa, synthetic construct
  source 1..25: note = Seed: VKLQTVHSIPLTINKEEALQRPVAS
VKLQTVHSIPMTIFKVEAAQRPVAS

SEQ ID NO: 59069 - protein, 25 aa, synthetic construct
  source 1..25: note = Seed: VKLQTVHSIPLTINKEEALQRPVAS
VKLQTVHSIPMTIFKVEACQRPVAS

SEQ ID NO: 59070 - protein, 25 aa, synthetic construct
  source 1..25: note = Seed: VKLQTVHSIPLTINKEEALQRPVAS
VKLQTVHSIPMTIFKVEADQRPVAS

SEQ ID NO: 59071 - protein, 25 aa, synthetic construct
  source 1..25: note = Seed: VKLQTVHSIPLTINKEEALQRPVAS
VKLQTVHSIPMTIFKVEAEQRPVAS

SEQ ID NO: 59072 - protein, 25 aa, synthetic construct
  source 1..25: note = Seed: VKLQTVHSIPLTINKEEALQRPVAS
VKLQTVHSIPMTIFKVEAFQRPVAS

SEQ ID NO: 59073 - protein, 25 aa, synthetic construct
  source 1..25: note = Seed: VKLQTVHSIPLTINKEEALQRPVAS
VKLQTVHSIPMTIFKVEAGQRPVAS

SEQ ID NO: 59074 - protein, 25 aa, synthetic construct
  source 1..25: note = Seed: VKLQTVHSIPLTINKEEALQRPVAS
VKLQTVHSIPMTIFKVEAHQRPVAS

SEQ ID NO: 59075 - protein, 25 aa, synthetic construct
  source 1..25: note = Seed: VKLQTVHSIPLTINKEEALQRPVAS
VKLQTVHSIPMTIFKVEAIQRPVAS

SEQ ID NO: 59076 - protein, 25 aa, synthetic construct
  source 1..25: note = Seed: VKLQTVHSIPLTINKEEALQRPVAS
VKLQTVHSIPMTIFKVEALQRPVAS

SEQ ID NO: 59077 - protein, 25 aa, synthetic construct
  source 1..25: note = Seed: VKLQTVHSIPLTINKEEALQRPVAS
VKLQTVHSIPMTIFKVEAMQRPVAS

SEQ ID NO: 59078 - protein, 25 aa, synthetic construct
  source 1..25: note = Seed: VKLQTVHSIPLTINKEEALQRPVAS
VKLQTVHSIPMTIFKVEANQRPVAS

SEQ ID NO: 59079 - protein, 25 aa, synthetic construct
  source 1..25: note = Seed: VKLQTVHSIPLTINKEEALQRPVAS
VKLQTVHSIPMTIFKVEAPQRPVAS

SEQ ID NO: 59080 - protein, 25 aa, synthetic construct
  source 1..25: note = Seed: VKLQTVHSIPLTINKEEALQRPVAS
VKLQTVHSIPMTIFKVEAQQRPVAS

SEQ ID NO: 59081 - protein, 25 aa, synthetic construct
  source 1..25: note = Seed: VKLQTVHSIPLTINKEEALQRPVAS
VKLQTVHSIPMTIFKVEASQRPVAS

SEQ ID NO: 59082 - protein, 25 aa, synthetic construct
  source 1..25: note = Seed: VKLQTVHSIPLTINKEEALQRPVAS
VKLQTVHSIPMTIFKVEATQRPVAS

SEQ ID NO: 59083 - protein, 25 aa, synthetic construct
  source 1..25: note = Seed: VKLQTVHSIPLTINKEEALQRPVAS
VKLQTVHSIPMTIFKVEAVQRPVAS

SEQ ID NO: 59084 - protein, 25 aa, synthetic construct
  source 1..25: note = Seed: VKLQTVHSIPLTINKEEALQRPVAS
VKLQTVHSIPMTIFKVEAYQRPVAS

SEQ ID NO: 59085 - protein, 25 aa, synthetic construct
  source 1..25: note = Seed: VKLQTVHSIPLTINKEEALQRPVAS
VKLQTVHSIPMTIFKWEAFQRPVAS

SEQ ID NO: 59086 - protein, 25 aa, synthetic construct
  source 1..25: note = Seed: VKLQTVHSIPLTINKEEALQRPVAS
VKLQTVHSIPMTIFKWEAIQRPVAS

SEQ ID NO: 59087 - protein, 25 aa, synthetic construct
  source 1..25: note = Seed: VKLQTVHSIPLTINKEEALQRPVAS
VKLQTVHSIPMTIFKWEALQRPVAS

SEQ ID NO: 59088 - protein, 25 aa, synthetic construct
  source 1..25: note = Seed: VKLQTVHSIPLTINKEEALQRPVAS
VKLQTVHSIPMTIFKWEAMQRPVAS

SEQ ID NO: 59089 - protein, 25 aa, synthetic construct
  source 1..25: note = Seed: VKLQTVHSIPLTINKEEALQRPVAS
VKLQTVHSIPMTIFKWEAVQRPVAS

SEQ ID NO: 59090 - protein, 25 aa, synthetic construct
  source 1..25: note = Seed: VKLQTVHSIPLTINKEEALQRPVAS
VKLQTVHSIPMTIFKWEAYQRPVAS

SEQ ID NO: 59091 - protein, 25 aa, synthetic construct
  source 1..25: note = Seed: VKLQTVHSIPLTINKEEALQRPVAS
VKLQTVHSIPMTIFKYEAAQRPVAS

SEQ ID NO: 59092 - protein, 25 aa, synthetic construct
  source 1..25: note = Seed: VKLQTVHSIPLTINKEEALQRPVAS
VKLQTVHSIPMTIFKYEAFQRPVAS

SEQ ID NO: 59093 - protein, 25 aa, synthetic construct
  source 1..25: note = Seed: VKLQTVHSIPLTINKEEALQRPVAS
VKLQTVHSIPMTIFKYEAIQRPVAS

SEQ ID NO: 59094 - protein, 25 aa, synthetic construct
  source 1..25: note = Seed: VKLQTVHSIPLTINKEEALQRPVAS
VKLQTVHSIPMTIFKYEALQRPVAS

SEQ ID NO: 59095 - protein, 25 aa, synthetic construct
  source 1..25: note = Seed: VKLQTVHSIPLTINKEEALQRPVAS
VKLQTVHSIPMTIFKYEAMQRPVAS

SEQ ID NO: 59096 - protein, 25 aa, synthetic construct
  source 1..25: note = Seed: VKLQTVHSIPLTINKEEALQRPVAS
VKLQTVHSIPMTIFKYEAVQRPVAS

SEQ ID NO: 59097 - protein, 25 aa, synthetic construct
  source 1..25: note = Seed: VKLQTVHSIPLTINKEEALQRPVAS
VKLQTVHSIPMTIFKYEAWQRPVAS

SEQ ID NO: 59098 - protein, 25 aa, synthetic construct
  source 1..25: note = Seed: VKLQTVHSIPLTINKEEALQRPVAS
VKLQTVHSIPMTIFKYEAYQRPVAS

SEQ ID NO: 59099 - protein, 25 aa, synthetic construct
  source 1..25: note = Seed: VKLQTVHSIPLTINKEEALQRPVAS
VKLQTVHSIPMTIHKFEAAQRPVAS

SEQ ID NO: 59100 - protein, 25 aa, synthetic construct
  source 1..25: note = Seed: VKLQTVHSIPLTINKEEALQRPVAS
VKLQTVHSIPMTIHKFEAFQRPVAS

SEQ ID NO: 59101 - protein, 25 aa, synthetic construct
  source 1..25: note = Seed: VKLQTVHSIPLTINKEEALQRPVAS
VKLQTVHSIPMTIHKFEAIQRPVAS

SEQ ID NO: 59102 - protein, 25 aa, synthetic construct
  source 1..25: note = Seed: VKLQTVHSIPLTINKEEALQRPVAS
VKLQTVHSIPMTIHKFEALQRPVAS

SEQ ID NO: 59103 - protein, 25 aa, synthetic construct
  source 1..25: note = Seed: VKLQTVHSIPLTINKEEALQRPVAS
VKLQTVHSIPMTIHKFEAMQRPVAS

SEQ ID NO: 59104 - protein, 25 aa, synthetic construct
  source 1..25: note = Seed: VKLQTVHSIPLTINKEEALQRPVAS
VKLQTVHSIPMTIHKFEAVQRPVAS

SEQ ID NO: 59105 - protein, 25 aa, synthetic construct
  source 1..25: note = Seed: VKLQTVHSIPLTINKEEALQRPVAS
VKLQTVHSIPMTIHKLEALQRPVAS

SEQ ID NO: 59106 - protein, 25 aa, synthetic construct
  source 1..25: note = Seed: VKLQTVHSIPLTINKEEALQRPVAS
VKLQTVHSIPMTIHKREAFQRPVAS

SEQ ID NO: 59107 - protein, 25 aa, synthetic construct
  source 1..25: note = Seed: VKLQTVHSIPLTINKEEALQRPVAS
VKLQTVHSIPMTIIKAEAAQRPVAS

SEQ ID NO: 59108 - protein, 25 aa, synthetic construct
  source 1..25: note = Seed: VKLQTVHSIPLTINKEEALQRPVAS
VKLQTVHSIPMTIIKAEAFQRPVAS

SEQ ID NO: 59109 - protein, 25 aa, synthetic construct
  source 1..25: note = Seed: VKLQTVHSIPLTINKEEALQRPVAS
VKLQTVHSIPMTIIKAEAIQRPVAS

SEQ ID NO: 59110 - protein, 25 aa, synthetic construct
  source 1..25: note = Seed: VKLQTVHSIPLTINKEEALQRPVAS
VKLQTVHSIPMTIIKAEALQRPVAS

SEQ ID NO: 59111 - protein, 25 aa, synthetic construct
  source 1..25: note = Seed: VKLQTVHSIPLTINKEEALQRPVAS
VKLQTVHSIPMTIIKAEAMQRPVAS

SEQ ID NO: 59112 - protein, 25 aa, synthetic construct
  source 1..25: note = Seed: VKLQTVHSIPLTINKEEALQRPVAS
VKLQTVHSIPMTIIKAEAVQRPVAS

SEQ ID NO: 59113 - protein, 25 aa, synthetic construct
  source 1..25: note = Seed: VKLQTVHSIPLTINKEEALQRPVAS
VKLQTVHSIPMTIIKAEAYQRPVAS

SEQ ID NO: 59114 - protein, 25 aa, synthetic construct
  source 1..25: note = Seed: VKLQTVHSIPLTINKEEALQRPVAS
VKLQTVHSIPMTIIKDEAAQRPVAS

SEQ ID NO: 59115 - protein, 25 aa, synthetic construct
  source 1..25: note = Seed: VKLQTVHSIPLTINKEEALQRPVAS
VKLQTVHSIPMTIIKDEAIQRPVAS

SEQ ID NO: 59116 - protein, 25 aa, synthetic construct
  source 1..25: note = Seed: VKLQTVHSIPLTINKEEALQRPVAS
VKLQTVHSIPMTIIKDEALQRPVAS

SEQ ID NO: 59117 - protein, 25 aa, synthetic construct
  source 1..25: note = Seed: VKLQTVHSIPLTINKEEALQRPVAS
VKLQTVHSIPMTIIKDEAMQRPVAS

SEQ ID NO: 59118 - protein, 25 aa, synthetic construct
  source 1..25: note = Seed: VKLQTVHSIPLTINKEEALQRPVAS
VKLQTVHSIPMTIIKDEAVQRPVAS

SEQ ID NO: 59119 - protein, 25 aa, synthetic construct
  source 1..25: note = Seed: VKLQTVHSIPLTINKEEALQRPVAS
VKLQTVHSIPMTIIKFEAAQRPVAS

SEQ ID NO: 59120 - protein, 25 aa, synthetic construct
  source 1..25: note = Seed: VKLQTVHSIPLTINKEEALQRPVAS
VKLQTVHSIPMTIIKFEADQRPVAS

SEQ ID NO: 59121 - protein, 25 aa, synthetic construct
  source 1..25: note = Seed: VKLQTVHSIPLTINKEEALQRPVAS
VKLQTVHSIPMTIIKFEAEQRPVAS

SEQ ID NO: 59122 - protein, 25 aa, synthetic construct
  source 1..25: note = Seed: VKLQTVHSIPLTINKEEALQRPVAS
VKLQTVHSIPMTIIKFEAFQRPVAS

SEQ ID NO: 59123 - protein, 25 aa, synthetic construct
  source 1..25: note = Seed: VKLQTVHSIPLTINKEEALQRPVAS
VKLQTVHSIPMTIIKFEAHQRPVAS

SEQ ID NO: 59124 - protein, 25 aa, synthetic construct
  source 1..25: note = Seed: VKLQTVHSIPLTINKEEALQRPVAS
VKLQTVHSIPMTIIKFEAIQRPVAS

SEQ ID NO: 59125 - protein, 25 aa, synthetic construct
  source 1..25: note = Seed: VKLQTVHSIPLTINKEEALQRPVAS
VKLQTVHSIPMTIIKFEALQRPVAS

SEQ ID NO: 59126 - protein, 25 aa, synthetic construct
  source 1..25: note = Seed: VKLQTVHSIPLTINKEEALQRPVAS
VKLQTVHSIPMTIIKFEAMQRPVAS

SEQ ID NO: 59127 - protein, 25 aa, synthetic construct
  source 1..25: note = Seed: VKLQTVHSIPLTINKEEALQRPVAS
VKLQTVHSIPMTIIKFEANQRPVAS

SEQ ID NO: 59128 - protein, 25 aa, synthetic construct
  source 1..25: note = Seed: VKLQTVHSIPLTINKEEALQRPVAS
VKLQTVHSIPMTIIKFEAPQRPVAS

SEQ ID NO: 59129 - protein, 25 aa, synthetic construct
  source 1..25: note = Seed: VKLQTVHSIPLTINKEEALQRPVAS
VKLQTVHSIPMTIIKFEAQQRPVAS

SEQ ID NO: 59130 - protein, 25 aa, synthetic construct
  source 1..25: note = Seed: VKLQTVHSIPLTINKEEALQRPVAS
VKLQTVHSIPMTIIKFEARQRPVAS

SEQ ID NO: 59131 - protein, 25 aa, synthetic construct
  source 1..25: note = Seed: VKLQTVHSIPLTINKEEALQRPVAS
VKLQTVHSIPMTIIKFEASQRPVAS

SEQ ID NO: 59132 - protein, 25 aa, synthetic construct
  source 1..25: note = Seed: VKLQTVHSIPLTINKEEALQRPVAS
VKLQTVHSIPMTIIKFEATQRPVAS

SEQ ID NO: 59133 - protein, 25 aa, synthetic construct
  source 1..25: note = Seed: VKLQTVHSIPLTINKEEALQRPVAS
VKLQTVHSIPMTIIKFEAVQRPVAS

SEQ ID NO: 59134 - protein, 25 aa, synthetic construct
  source 1..25: note = Seed: VKLQTVHSIPLTINKEEALQRPVAS
VKLQTVHSIPMTIIKFEAWQRPVAS

SEQ ID NO: 59135 - protein, 25 aa, synthetic construct
  source 1..25: note = Seed: VKLQTVHSIPLTINKEEALQRPVAS
VKLQTVHSIPMTIIKFEAYQRPVAS

SEQ ID NO: 59136 - protein, 25 aa, synthetic construct
  source 1..25: note = Seed: VKLQTVHSIPLTINKEEALQRPVAS
VKLQTVHSIPMTIIKHEARQRPVAS

SEQ ID NO: 59137 - protein, 25 aa, synthetic construct
  source 1..25: note = Seed: VKLQTVHSIPLTINKEEALQRPVAS
VKLQTVHSIPMTIIKHEAYQRPVAS

SEQ ID NO: 59138 - protein, 25 aa, synthetic construct
  source 1..25: note = Seed: VKLQTVHSIPLTINKEEALQRPVAS
VKLQTVHSIPMTIIKIEAAQRPVAS

SEQ ID NO: 59139 - protein, 25 aa, synthetic construct
  source 1..25: note = Seed: VKLQTVHSIPLTINKEEALQRPVAS
VKLQTVHSIPMTIIKIEADQRPVAS

SEQ ID NO: 59140 - protein, 25 aa, synthetic construct
  source 1..25: note = Seed: VKLQTVHSIPLTINKEEALQRPVAS
VKLQTVHSIPMTIIKIEAFQRPVAS

SEQ ID NO: 59141 - protein, 25 aa, synthetic construct
  source 1..25: note = Seed: VKLQTVHSIPLTINKEEALQRPVAS
VKLQTVHSIPMTIIKIEAIQRPVAS

SEQ ID NO: 59142 - protein, 25 aa, synthetic construct
  source 1..25: note = Seed: VKLQTVHSIPLTINKEEALQRPVAS
VKLQTVHSIPMTIIKIEALQRPVAS

SEQ ID NO: 59143 - protein, 25 aa, synthetic construct
  source 1..25: note = Seed: VKLQTVHSIPLTINKEEALQRPVAS
VKLQTVHSIPMTIIKIEAMQRPVAS

SEQ ID NO: 59144 - protein, 25 aa, synthetic construct
  source 1..25: note = Seed: VKLQTVHSIPLTINKEEALQRPVAS
VKLQTVHSIPMTIIKIEANQRPVAS

SEQ ID NO: 59145 - protein, 25 aa, synthetic construct
  source 1..25: note = Seed: VKLQTVHSIPLTINKEEALQRPVAS
VKLQTVHSIPMTIIKIEASQRPVAS

SEQ ID NO: 59146 - protein, 25 aa, synthetic construct
  source 1..25: note = Seed: VKLQTVHSIPLTINKEEALQRPVAS
VKLQTVHSIPMTIIKIEATQRPVAS

SEQ ID NO: 59147 - protein, 25 aa, synthetic construct
  source 1..25: note = Seed: VKLQTVHSIPLTINKEEALQRPVAS
VKLQTVHSIPMTIIKIEAVQRPVAS

SEQ ID NO: 59148 - protein, 25 aa, synthetic construct
  source 1..25: note = Seed: VKLQTVHSIPLTINKEEALQRPVAS
VKLQTVHSIPMTIIKIEAYQRPVAS

SEQ ID NO: 59149 - protein, 25 aa, synthetic construct
  source 1..25: note = Seed: VKLQTVHSIPLTINKEEALQRPVAS
VKLQTVHSIPMTIIKKEAFQRPVAS

SEQ ID NO: 59150 - protein, 25 aa, synthetic construct
  source 1..25: note = Seed: VKLQTVHSIPLTINKEEALQRPVAS
VKLQTVHSIPMTIIKKEAIQRPVAS

SEQ ID NO: 59151 - protein, 25 aa, synthetic construct
  source 1..25: note = Seed: VKLQTVHSIPLTINKEEALQRPVAS
VKLQTVHSIPMTIIKKEALQRPVAS

SEQ ID NO: 59152 - protein, 25 aa, synthetic construct
  source 1..25: note = Seed: VKLQTVHSIPLTINKEEALQRPVAS
VKLQTVHSIPMTIIKKEAMQRPVAS

SEQ ID NO: 59153 - protein, 25 aa, synthetic construct
  source 1..25: note = Seed: VKLQTVHSIPLTINKEEALQRPVAS
VKLQTVHSIPMTIIKKEAVQRPVAS

SEQ ID NO: 59154 - protein, 25 aa, synthetic construct
  source 1..25: note = Seed: VKLQTVHSIPLTINKEEALQRPVAS
VKLQTVHSIPMTIIKLEAAQRPVAS

SEQ ID NO: 59155 - protein, 25 aa, synthetic construct
  source 1..25: note = Seed: VKLQTVHSIPLTINKEEALQRPVAS
VKLQTVHSIPMTIIKLEAFQRPVAS

SEQ ID NO: 59156 - protein, 25 aa, synthetic construct
  source 1..25: note = Seed: VKLQTVHSIPLTINKEEALQRPVAS
VKLQTVHSIPMTIIKLEAIQRPVAS

SEQ ID NO: 59157 - protein, 25 aa, synthetic construct
  source 1..25: note = Seed: VKLQTVHSIPLTINKEEALQRPVAS
VKLQTVHSIPMTIIKLEALQRPVAS

SEQ ID NO: 59158 - protein, 25 aa, synthetic construct
  source 1..25: note = Seed: VKLQTVHSIPLTINKEEALQRPVAS
VKLQTVHSIPMTIIKLEAMQRPVAS

SEQ ID NO: 59159 - protein, 25 aa, synthetic construct
  source 1..25: note = Seed: VKLQTVHSIPLTINKEEALQRPVAS
VKLQTVHSIPMTIIKLEANQRPVAS

SEQ ID NO: 59160 - protein, 25 aa, synthetic construct
  source 1..25: note = Seed: VKLQTVHSIPLTINKEEALQRPVAS
VKLQTVHSIPMTIIKLEASQRPVAS

SEQ ID NO: 59161 - protein, 25 aa, synthetic construct
  source 1..25: note = Seed: VKLQTVHSIPLTINKEEALQRPVAS
VKLQTVHSIPMTIIKLEAVQRPVAS

SEQ ID NO: 59162 - protein, 25 aa, synthetic construct
  source 1..25: note = Seed: VKLQTVHSIPLTINKEEALQRPVAS
VKLQTVHSIPMTIIKLEAYQRPVAS

SEQ ID NO: 59163 - protein, 25 aa, synthetic construct
  source 1..25: note = Seed: VKLQTVHSIPLTINKEEALQRPVAS
VKLQTVHSIPMTIIKMEAAQRPVAS

SEQ ID NO: 59164 - protein, 25 aa, synthetic construct
  source 1..25: note = Seed: VKLQTVHSIPLTINKEEALQRPVAS
VKLQTVHSIPMTIIKMEAFQRPVAS

SEQ ID NO: 59165 - protein, 25 aa, synthetic construct
  source 1..25: note = Seed: VKLQTVHSIPLTINKEEALQRPVAS
VKLQTVHSIPMTIIKMEAIQRPVAS

SEQ ID NO: 59166 - protein, 25 aa, synthetic construct
  source 1..25: note = Seed: VKLQTVHSIPLTINKEEALQRPVAS
VKLQTVHSIPMTIIKMEALQRPVAS

SEQ ID NO: 59167 - protein, 25 aa, synthetic construct
  source 1..25: note = Seed: VKLQTVHSIPLTINKEEALQRPVAS
VKLQTVHSIPMTIIKMEAMQRPVAS

SEQ ID NO: 59168 - protein, 25 aa, synthetic construct
  source 1..25: note = Seed: VKLQTVHSIPLTINKEEALQRPVAS
VKLQTVHSIPMTIIKMEASQRPVAS

SEQ ID NO: 59169 - protein, 25 aa, synthetic construct
  source 1..25: note = Seed: VKLQTVHSIPLTINKEEALQRPVAS
VKLQTVHSIPMTIIKMEAVQRPVAS

SEQ ID NO: 59170 - protein, 25 aa, synthetic construct
  source 1..25: note = Seed: VKLQTVHSIPLTINKEEALQRPVAS
VKLQTVHSIPMTIIKNEAAQRPVAS

SEQ ID NO: 59171 - protein, 25 aa, synthetic construct
  source 1..25: note = Seed: VKLQTVHSIPLTINKEEALQRPVAS
VKLQTVHSIPMTIIKNEAIQRPVAS

SEQ ID NO: 59172 - protein, 25 aa, synthetic construct
  source 1..25: note = Seed: VKLQTVHSIPLTINKEEALQRPVAS
VKLQTVHSIPMTIIKNEALQRPVAS

SEQ ID NO: 59173 - protein, 25 aa, synthetic construct
  source 1..25: note = Seed: VKLQTVHSIPLTINKEEALQRPVAS
VKLQTVHSIPMTIIKNEAVQRPVAS

SEQ ID NO: 59174 - protein, 25 aa, synthetic construct
  source 1..25: note = Seed: VKLQTVHSIPLTINKEEALQRPVAS
VKLQTVHSIPMTIIKREAFQRPVAS

SEQ ID NO: 59175 - protein, 25 aa, synthetic construct
  source 1..25: note = Seed: VKLQTVHSIPLTINKEEALQRPVAS
VKLQTVHSIPMTIIKREAIQRPVAS

SEQ ID NO: 59176 - protein, 25 aa, synthetic construct
  source 1..25: note = Seed: VKLQTVHSIPLTINKEEALQRPVAS
VKLQTVHSIPMTIIKREALQRPVAS

SEQ ID NO: 59177 - protein, 25 aa, synthetic construct
  source 1..25: note = Seed: VKLQTVHSIPLTINKEEALQRPVAS
VKLQTVHSIPMTIIKREAMQRPVAS

SEQ ID NO: 59178 - protein, 25 aa, synthetic construct
  source 1..25: note = Seed: VKLQTVHSIPLTINKEEALQRPVAS
VKLQTVHSIPMTIIKREARQRPVAS

SEQ ID NO: 59179 - protein, 25 aa, synthetic construct
  source 1..25: note = Seed: VKLQTVHSIPLTINKEEALQRPVAS
VKLQTVHSIPMTIIKREAVQRPVAS

SEQ ID NO: 59180 - protein, 25 aa, synthetic construct
  source 1..25: note = Seed: VKLQTVHSIPLTINKEEALQRPVAS
VKLQTVHSIPMTIIKREAYQRPVAS

SEQ ID NO: 59181 - protein, 25 aa, synthetic construct
  source 1..25: note = Seed: VKLQTVHSIPLTINKEEALQRPVAS
VKLQTVHSIPMTIIKSEAIQRPVAS

SEQ ID NO: 59182 - protein, 25 aa, synthetic construct
  source 1..25: note = Seed: VKLQTVHSIPLTINKEEALQRPVAS
VKLQTVHSIPMTIIKSEALQRPVAS

SEQ ID NO: 59183 - protein, 25 aa, synthetic construct
  source 1..25: note = Seed: VKLQTVHSIPLTINKEEALQRPVAS
VKLQTVHSIPMTIIKSEAVQRPVAS

SEQ ID NO: 59184 - protein, 25 aa, synthetic construct
  source 1..25: note = Seed: VKLQTVHSIPLTINKEEALQRPVAS
VKLQTVHSIPMTIIKTEAIQRPVAS

SEQ ID NO: 59185 - protein, 25 aa, synthetic construct
  source 1..25: note = Seed: VKLQTVHSIPLTINKEEALQRPVAS
VKLQTVHSIPMTIIKTEAVQRPVAS

SEQ ID NO: 59186 - protein, 25 aa, synthetic construct
  source 1..25: note = Seed: VKLQTVHSIPLTINKEEALQRPVAS
VKLQTVHSIPMTIIKVEAAQRPVAS

SEQ ID NO: 59187 - protein, 25 aa, synthetic construct
  source 1..25: note = Seed: VKLQTVHSIPLTINKEEALQRPVAS
VKLQTVHSIPMTIIKVEAFQRPVAS

SEQ ID NO: 59188 - protein, 25 aa, synthetic construct
  source 1..25: note = Seed: VKLQTVHSIPLTINKEEALQRPVAS
VKLQTVHSIPMTIIKVEAIQRPVAS

SEQ ID NO: 59189 - protein, 25 aa, synthetic construct
  source 1..25: note = Seed: VKLQTVHSIPLTINKEEALQRPVAS
VKLQTVHSIPMTIIKVEALQRPVAS

SEQ ID NO: 59190 - protein, 25 aa, synthetic construct
  source 1..25: note = Seed: VKLQTVHSIPLTINKEEALQRPVAS
VKLQTVHSIPMTIIKVEAMQRPVAS

SEQ ID NO: 59191 - protein, 25 aa, synthetic construct
  source 1..25: note = Seed: VKLQTVHSIPLTINKEEALQRPVAS
VKLQTVHSIPMTIIKVEASQRPVAS

SEQ ID NO: 59192 - protein, 25 aa, synthetic construct
  source 1..25: note = Seed: VKLQTVHSIPLTINKEEALQRPVAS
VKLQTVHSIPMTIIKVEAVQRPVAS

SEQ ID NO: 59193 - protein, 25 aa, synthetic construct
  source 1..25: note = Seed: VKLQTVHSIPLTINKEEALQRPVAS
VKLQTVHSIPMTIIKVEAYQRPVAS

SEQ ID NO: 59194 - protein, 25 aa, synthetic construct
  source 1..25: note = Seed: VKLQTVHSIPLTINKEEALQRPVAS
VKLQTVHSIPMTIIKWEAFQRPVAS

SEQ ID NO: 59195 - protein, 25 aa, synthetic construct
  source 1..25: note = Seed: VKLQTVHSIPLTINKEEALQRPVAS
VKLQTVHSIPMTIIKWEAIQRPVAS

SEQ ID NO: 59196 - protein, 25 aa, synthetic construct
  source 1..25: note = Seed: VKLQTVHSIPLTINKEEALQRPVAS
VKLQTVHSIPMTIIKWEALQRPVAS

SEQ ID NO: 59197 - protein, 25 aa, synthetic construct
  source 1..25: note = Seed: VKLQTVHSIPLTINKEEALQRPVAS
VKLQTVHSIPMTIIKWEAMQRPVAS

SEQ ID NO: 59198 - protein, 25 aa, synthetic construct
  source 1..25: note = Seed: VKLQTVHSIPLTINKEEALQRPVAS
VKLQTVHSIPMTIIKWEAVQRPVAS

SEQ ID NO: 59199 - protein, 25 aa, synthetic construct
  source 1..25: note = Seed: VKLQTVHSIPLTINKEEALQRPVAS
VKLQTVHSIPMTIIKYEAFQRPVAS

SEQ ID NO: 59200 - protein, 25 aa, synthetic construct
  source 1..25: note = Seed: VKLQTVHSIPLTINKEEALQRPVAS
VKLQTVHSIPMTIIKYEAIQRPVAS

SEQ ID NO: 59201 - protein, 25 aa, synthetic construct
  source 1..25: note = Seed: VKLQTVHSIPLTINKEEALQRPVAS
VKLQTVHSIPMTIIKYEALQRPVAS

SEQ ID NO: 59202 - protein, 25 aa, synthetic construct
  source 1..25: note = Seed: VKLQTVHSIPLTINKEEALQRPVAS
VKLQTVHSIPMTIIKYEAMQRPVAS

SEQ ID NO: 59203 - protein, 25 aa, synthetic construct
  source 1..25: note = Seed: VKLQTVHSIPLTINKEEALQRPVAS
VKLQTVHSIPMTIIKYEAVQRPVAS

SEQ ID NO: 59204 - protein, 25 aa, synthetic construct
  source 1..25: note = Seed: VKLQTVHSIPLTINKEEALQRPVAS
VKLQTVHSIPMTIIKYEAWQRPVAS

SEQ ID NO: 59205 - protein, 25 aa, synthetic construct
  source 1..25: note = Seed: VKLQTVHSIPLTINKEEALQRPVAS
VKLQTVHSIPMTIKKFEAFQRPVAS

SEQ ID NO: 59206 - protein, 25 aa, synthetic construct
  source 1..25: note = Seed: VKLQTVHSIPLTINKEEALQRPVAS
VKLQTVHSIPMTIKKFEAIQRPVAS

SEQ ID NO: 59207 - protein, 25 aa, synthetic construct
  source 1..25: note = Seed: VKLQTVHSIPLTINKEEALQRPVAS
VKLQTVHSIPMTIKKFEALQRPVAS

SEQ ID NO: 59208 - protein, 25 aa, synthetic construct
  source 1..25: note = Seed: VKLQTVHSIPLTINKEEALQRPVAS
VKLQTVHSIPMTIKKFEAVQRPVAS

SEQ ID NO: 59209 - protein, 25 aa, synthetic construct
  source 1..25: note = Seed: VKLQTVHSIPLTINKEEALQRPVAS
VKLQTVHSIPMTILKAEAAQRPVAS

SEQ ID NO: 59210 - protein, 25 aa, synthetic construct
  source 1..25: note = Seed: VKLQTVHSIPLTINKEEALQRPVAS
VKLQTVHSIPMTILKAEAFQRPVAS

SEQ ID NO: 59211 - protein, 25 aa, synthetic construct
  source 1..25: note = Seed: VKLQTVHSIPLTINKEEALQRPVAS
VKLQTVHSIPMTILKAEAIQRPVAS

SEQ ID NO: 59212 - protein, 25 aa, synthetic construct
  source 1..25: note = Seed: VKLQTVHSIPLTINKEEALQRPVAS
VKLQTVHSIPMTILKAEALQRPVAS

SEQ ID NO: 59213 - protein, 25 aa, synthetic construct
  source 1..25: note = Seed: VKLQTVHSIPLTINKEEALQRPVAS
VKLQTVHSIPMTILKAEAMQRPVAS

SEQ ID NO: 59214 - protein, 25 aa, synthetic construct
  source 1..25: note = Seed: VKLQTVHSIPLTINKEEALQRPVAS
VKLQTVHSIPMTILKAEAVQRPVAS

SEQ ID NO: 59215 - protein, 25 aa, synthetic construct
  source 1..25: note = Seed: VKLQTVHSIPLTINKEEALQRPVAS
VKLQTVHSIPMTILKAEAYQRPVAS

SEQ ID NO: 59216 - protein, 25 aa, synthetic construct
  source 1..25: note = Seed: VKLQTVHSIPLTINKEEALQRPVAS
VKLQTVHSIPMTILKDEAIQRPVAS

SEQ ID NO: 59217 - protein, 25 aa, synthetic construct
  source 1..25: note = Seed: VKLQTVHSIPLTINKEEALQRPVAS
VKLQTVHSIPMTILKDEALQRPVAS

SEQ ID NO: 59218 - protein, 25 aa, synthetic construct
  source 1..25: note = Seed: VKLQTVHSIPLTINKEEALQRPVAS
VKLQTVHSIPMTILKDEAVQRPVAS

SEQ ID NO: 59219 - protein, 25 aa, synthetic construct
  source 1..25: note = Seed: VKLQTVHSIPLTINKEEALQRPVAS
VKLQTVHSIPMTILKFEAAQRPVAS

SEQ ID NO: 59220 - protein, 25 aa, synthetic construct
  source 1..25: note = Seed: VKLQTVHSIPLTINKEEALQRPVAS
VKLQTVHSIPMTILKFEADQRPVAS

SEQ ID NO: 59221 - protein, 25 aa, synthetic construct
  source 1..25: note = Seed: VKLQTVHSIPLTINKEEALQRPVAS
VKLQTVHSIPMTILKFEAEQRPVAS

SEQ ID NO: 59222 - protein, 25 aa, synthetic construct
  source 1..25: note = Seed: VKLQTVHSIPLTINKEEALQRPVAS
VKLQTVHSIPMTILKFEAFQRPVAS

SEQ ID NO: 59223 - protein, 25 aa, synthetic construct
  source 1..25: note = Seed: VKLQTVHSIPLTINKEEALQRPVAS
VKLQTVHSIPMTILKFEAHQRPVAS

SEQ ID NO: 59224 - protein, 25 aa, synthetic construct
  source 1..25: note = Seed: VKLQTVHSIPLTINKEEALQRPVAS
VKLQTVHSIPMTILKFEAIQRPVAS

SEQ ID NO: 59225 - protein, 25 aa, synthetic construct
  source 1..25: note = Seed: VKLQTVHSIPLTINKEEALQRPVAS
VKLQTVHSIPMTILKFEALQRPVAS

SEQ ID NO: 59226 - protein, 25 aa, synthetic construct
  source 1..25: note = Seed: VKLQTVHSIPLTINKEEALQRPVAS
VKLQTVHSIPMTILKFEAMQRPVAS

SEQ ID NO: 59227 - protein, 25 aa, synthetic construct
  source 1..25: note = Seed: VKLQTVHSIPLTINKEEALQRPVAS
VKLQTVHSIPMTILKFEANQRPVAS

SEQ ID NO: 59228 - protein, 25 aa, synthetic construct
  source 1..25: note = Seed: VKLQTVHSIPLTINKEEALQRPVAS
VKLQTVHSIPMTILKFEAQQRPVAS

SEQ ID NO: 59229 - protein, 25 aa, synthetic construct
  source 1..25: note = Seed: VKLQTVHSIPLTINKEEALQRPVAS
VKLQTVHSIPMTILKFEARQRPVAS

SEQ ID NO: 59230 - protein, 25 aa, synthetic construct
  source 1..25: note = Seed: VKLQTVHSIPLTINKEEALQRPVAS
VKLQTVHSIPMTILKFEASQRPVAS

SEQ ID NO: 59231 - protein, 25 aa, synthetic construct
  source 1..25: note = Seed: VKLQTVHSIPLTINKEEALQRPVAS
VKLQTVHSIPMTILKFEATQRPVAS

SEQ ID NO: 59232 - protein, 25 aa, synthetic construct
  source 1..25: note = Seed: VKLQTVHSIPLTINKEEALQRPVAS
VKLQTVHSIPMTILKFEAVQRPVAS

SEQ ID NO: 59233 - protein, 25 aa, synthetic construct
  source 1..25: note = Seed: VKLQTVHSIPLTINKEEALQRPVAS
VKLQTVHSIPMTILKFEAWQRPVAS

SEQ ID NO: 59234 - protein, 25 aa, synthetic construct
  source 1..25: note = Seed: VKLQTVHSIPLTINKEEALQRPVAS
VKLQTVHSIPMTILKFEAYQRPVAS

SEQ ID NO: 59235 - protein, 25 aa, synthetic construct
  source 1..25: note = Seed: VKLQTVHSIPLTINKEEALQRPVAS
VKLQTVHSIPMTILKIEAAQRPVAS

SEQ ID NO: 59236 - protein, 25 aa, synthetic construct
  source 1..25: note = Seed: VKLQTVHSIPLTINKEEALQRPVAS
VKLQTVHSIPMTILKIEAFQRPVAS

SEQ ID NO: 59237 - protein, 25 aa, synthetic construct
  source 1..25: note = Seed: VKLQTVHSIPLTINKEEALQRPVAS
VKLQTVHSIPMTILKIEAIQRPVAS

SEQ ID NO: 59238 - protein, 25 aa, synthetic construct
  source 1..25: note = Seed: VKLQTVHSIPLTINKEEALQRPVAS
VKLQTVHSIPMTILKIEALQRPVAS

SEQ ID NO: 59239 - protein, 25 aa, synthetic construct
  source 1..25: note = Seed: VKLQTVHSIPLTINKEEALQRPVAS
VKLQTVHSIPMTILKIEAMQRPVAS

SEQ ID NO: 59240 - protein, 25 aa, synthetic construct
  source 1..25: note = Seed: VKLQTVHSIPLTINKEEALQRPVAS
VKLQTVHSIPMTILKIEASQRPVAS

SEQ ID NO: 59241 - protein, 25 aa, synthetic construct
  source 1..25: note = Seed: VKLQTVHSIPLTINKEEALQRPVAS
VKLQTVHSIPMTILKIEATQRPVAS

SEQ ID NO: 59242 - protein, 25 aa, synthetic construct
  source 1..25: note = Seed: VKLQTVHSIPLTINKEEALQRPVAS
VKLQTVHSIPMTILKIEAVQRPVAS

SEQ ID NO: 59243 - protein, 25 aa, synthetic construct
  source 1..25: note = Seed: VKLQTVHSIPLTINKEEALQRPVAS
VKLQTVHSIPMTILKIEAYQRPVAS

SEQ ID NO: 59244 - protein, 25 aa, synthetic construct
  source 1..25: note = Seed: VKLQTVHSIPLTINKEEALQRPVAS
VKLQTVHSIPMTILKKEAIQRPVAS

SEQ ID NO: 59245 - protein, 25 aa, synthetic construct
  source 1..25: note = Seed: VKLQTVHSIPLTINKEEALQRPVAS
VKLQTVHSIPMTILKKEALQRPVAS

SEQ ID NO: 59246 - protein, 25 aa, synthetic construct
  source 1..25: note = Seed: VKLQTVHSIPLTINKEEALQRPVAS
VKLQTVHSIPMTILKLEAAQRPVAS

SEQ ID NO: 59247 - protein, 25 aa, synthetic construct
  source 1..25: note = Seed: VKLQTVHSIPLTINKEEALQRPVAS
VKLQTVHSIPMTILKLEAFQRPVAS

SEQ ID NO: 59248 - protein, 25 aa, synthetic construct
  source 1..25: note = Seed: VKLQTVHSIPLTINKEEALQRPVAS
VKLQTVHSIPMTILKLEAIQRPVAS

SEQ ID NO: 59249 - protein, 25 aa, synthetic construct
  source 1..25: note = Seed: VKLQTVHSIPLTINKEEALQRPVAS
VKLQTVHSIPMTILKLEALQRPVAS

SEQ ID NO: 59250 - protein, 25 aa, synthetic construct
  source 1..25: note = Seed: VKLQTVHSIPLTINKEEALQRPVAS
VKLQTVHSIPMTILKLEAMQRPVAS

SEQ ID NO: 59251 - protein, 25 aa, synthetic construct
  source 1..25: note = Seed: VKLQTVHSIPLTINKEEALQRPVAS
VKLQTVHSIPMTILKLEASQRPVAS

SEQ ID NO: 59252 - protein, 25 aa, synthetic construct
  source 1..25: note = Seed: VKLQTVHSIPLTINKEEALQRPVAS
VKLQTVHSIPMTILKLEAVQRPVAS

SEQ ID NO: 59253 - protein, 25 aa, synthetic construct
  source 1..25: note = Seed: VKLQTVHSIPLTINKEEALQRPVAS
VKLQTVHSIPMTILKLEAYQRPVAS

SEQ ID NO: 59254 - protein, 25 aa, synthetic construct
  source 1..25: note = Seed: VKLQTVHSIPLTINKEEALQRPVAS
VKLQTVHSIPMTILKMEAAQRPVAS

SEQ ID NO: 59255 - protein, 25 aa, synthetic construct
  source 1..25: note = Seed: VKLQTVHSIPLTINKEEALQRPVAS
VKLQTVHSIPMTILKMEAFQRPVAS

SEQ ID NO: 59256 - protein, 25 aa, synthetic construct
  source 1..25: note = Seed: VKLQTVHSIPLTINKEEALQRPVAS
VKLQTVHSIPMTILKMEAIQRPVAS

SEQ ID NO: 59257 - protein, 25 aa, synthetic construct
  source 1..25: note = Seed: VKLQTVHSIPLTINKEEALQRPVAS
VKLQTVHSIPMTILKMEALQRPVAS

SEQ ID NO: 59258 - protein, 25 aa, synthetic construct
  source 1..25: note = Seed: VKLQTVHSIPLTINKEEALQRPVAS
VKLQTVHSIPMTILKMEAMQRPVAS

SEQ ID NO: 59259 - protein, 25 aa, synthetic construct
  source 1..25: note = Seed: VKLQTVHSIPLTINKEEALQRPVAS
VKLQTVHSIPMTILKMEASQRPVAS

SEQ ID NO: 59260 - protein, 25 aa, synthetic construct
  source 1..25: note = Seed: VKLQTVHSIPLTINKEEALQRPVAS
VKLQTVHSIPMTILKMEAVQRPVAS

SEQ ID NO: 59261 - protein, 25 aa, synthetic construct
  source 1..25: note = Seed: VKLQTVHSIPLTINKEEALQRPVAS
VKLQTVHSIPMTILKNEAIQRPVAS

SEQ ID NO: 59262 - protein, 25 aa, synthetic construct
  source 1..25: note = Seed: VKLQTVHSIPLTINKEEALQRPVAS
VKLQTVHSIPMTILKNEAVQRPVAS

SEQ ID NO: 59263 - protein, 25 aa, synthetic construct
  source 1..25: note = Seed: VKLQTVHSIPLTINKEEALQRPVAS
VKLQTVHSIPMTILKREAFQRPVAS

SEQ ID NO: 59264 - protein, 25 aa, synthetic construct
  source 1..25: note = Seed: VKLQTVHSIPLTINKEEALQRPVAS
VKLQTVHSIPMTILKREAIQRPVAS

SEQ ID NO: 59265 - protein, 25 aa, synthetic construct
  source 1..25: note = Seed: VKLQTVHSIPLTINKEEALQRPVAS
VKLQTVHSIPMTILKREALQRPVAS

SEQ ID NO: 59266 - protein, 25 aa, synthetic construct
  source 1..25: note = Seed: VKLQTVHSIPLTINKEEALQRPVAS
VKLQTVHSIPMTILKREAMQRPVAS

SEQ ID NO: 59267 - protein, 25 aa, synthetic construct
  source 1..25: note = Seed: VKLQTVHSIPLTINKEEALQRPVAS
VKLQTVHSIPMTILKREAVQRPVAS

SEQ ID NO: 59268 - protein, 25 aa, synthetic construct
  source 1..25: note = Seed: VKLQTVHSIPLTINKEEALQRPVAS
VKLQTVHSIPMTILKREAYQRPVAS

SEQ ID NO: 59269 - protein, 25 aa, synthetic construct
  source 1..25: note = Seed: VKLQTVHSIPLTINKEEALQRPVAS
VKLQTVHSIPMTILKSEAIQRPVAS

SEQ ID NO: 59270 - protein, 25 aa, synthetic construct
  source 1..25: note = Seed: VKLQTVHSIPLTINKEEALQRPVAS
VKLQTVHSIPMTILKSEAVQRPVAS

SEQ ID NO: 59271 - protein, 25 aa, synthetic construct
  source 1..25: note = Seed: VKLQTVHSIPLTINKEEALQRPVAS
VKLQTVHSIPMTILKTEAIQRPVAS

SEQ ID NO: 59272 - protein, 25 aa, synthetic construct
  source 1..25: note = Seed: VKLQTVHSIPLTINKEEALQRPVAS
VKLQTVHSIPMTILKTEAVQRPVAS

SEQ ID NO: 59273 - protein, 25 aa, synthetic construct
  source 1..25: note = Seed: VKLQTVHSIPLTINKEEALQRPVAS
VKLQTVHSIPMTILKVEAAQRPVAS

SEQ ID NO: 59274 - protein, 25 aa, synthetic construct
  source 1..25: note = Seed: VKLQTVHSIPLTINKEEALQRPVAS
VKLQTVHSIPMTILKVEAFQRPVAS

SEQ ID NO: 59275 - protein, 25 aa, synthetic construct
  source 1..25: note = Seed: VKLQTVHSIPLTINKEEALQRPVAS
VKLQTVHSIPMTILKVEAIQRPVAS

SEQ ID NO: 59276 - protein, 25 aa, synthetic construct
  source 1..25: note = Seed: VKLQTVHSIPLTINKEEALQRPVAS
VKLQTVHSIPMTILKVEALQRPVAS

SEQ ID NO: 59277 - protein, 25 aa, synthetic construct
  source 1..25: note = Seed: VKLQTVHSIPLTINKEEALQRPVAS
VKLQTVHSIPMTILKVEAMQRPVAS

SEQ ID NO: 59278 - protein, 25 aa, synthetic construct
  source 1..25: note = Seed: VKLQTVHSIPLTINKEEALQRPVAS
VKLQTVHSIPMTILKVEASQRPVAS

SEQ ID NO: 59279 - protein, 25 aa, synthetic construct
  source 1..25: note = Seed: VKLQTVHSIPLTINKEEALQRPVAS
VKLQTVHSIPMTILKVEAVQRPVAS

SEQ ID NO: 59280 - protein, 25 aa, synthetic construct
  source 1..25: note = Seed: VKLQTVHSIPLTINKEEALQRPVAS
VKLQTVHSIPMTILKVEAYQRPVAS

SEQ ID NO: 59281 - protein, 25 aa, synthetic construct
  source 1..25: note = Seed: VKLQTVHSIPLTINKEEALQRPVAS
VKLQTVHSIPMTILKWEAFQRPVAS

SEQ ID NO: 59282 - protein, 25 aa, synthetic construct
  source 1..25: note = Seed: VKLQTVHSIPLTINKEEALQRPVAS
VKLQTVHSIPMTILKWEAIQRPVAS

SEQ ID NO: 59283 - protein, 25 aa, synthetic construct
  source 1..25: note = Seed: VKLQTVHSIPLTINKEEALQRPVAS
VKLQTVHSIPMTILKWEALQRPVAS

SEQ ID NO: 59284 - protein, 25 aa, synthetic construct
  source 1..25: note = Seed: VKLQTVHSIPLTINKEEALQRPVAS
VKLQTVHSIPMTILKWEAVQRPVAS

SEQ ID NO: 59285 - protein, 25 aa, synthetic construct
  source 1..25: note = Seed: VKLQTVHSIPLTINKEEALQRPVAS
VKLQTVHSIPMTILKWEAYQRPVAS

SEQ ID NO: 59286 - protein, 25 aa, synthetic construct
  source 1..25: note = Seed: VKLQTVHSIPLTINKEEALQRPVAS
VKLQTVHSIPMTILKYEAFQRPVAS

SEQ ID NO: 59287 - protein, 25 aa, synthetic construct
  source 1..25: note = Seed: VKLQTVHSIPLTINKEEALQRPVAS
VKLQTVHSIPMTILKYEAIQRPVAS

SEQ ID NO: 59288 - protein, 25 aa, synthetic construct
  source 1..25: note = Seed: VKLQTVHSIPLTINKEEALQRPVAS
VKLQTVHSIPMTILKYEALQRPVAS

SEQ ID NO: 59289 - protein, 25 aa, synthetic construct
  source 1..25: note = Seed: VKLQTVHSIPLTINKEEALQRPVAS
VKLQTVHSIPMTILKYEAMQRPVAS

SEQ ID NO: 59290 - protein, 25 aa, synthetic construct
  source 1..25: note = Seed: VKLQTVHSIPLTINKEEALQRPVAS
VKLQTVHSIPMTILKYEAVQRPVAS

SEQ ID NO: 59291 - protein, 25 aa, synthetic construct
  source 1..25: note = Seed: VKLQTVHSIPLTINKEEALQRPVAS
VKLQTVHSIPMTILKYEAWQRPVAS

SEQ ID NO: 59292 - protein, 25 aa, synthetic construct
  source 1..25: note = Seed: VKLQTVHSIPLTINKEEALQRPVAS
VKLQTVHSIPMTILKYEAYQRPVAS

SEQ ID NO: 59293 - protein, 25 aa, synthetic construct
  source 1..25: note = Seed: VKLQTVHSIPLTINKEEALQRPVAS
VKLQTVHSIPMTIMKAEAAQRPVAS

SEQ ID NO: 59294 - protein, 25 aa, synthetic construct
  source 1..25: note = Seed: VKLQTVHSIPLTINKEEALQRPVAS
VKLQTVHSIPMTIMKAEAFQRPVAS

SEQ ID NO: 59295 - protein, 25 aa, synthetic construct
  source 1..25: note = Seed: VKLQTVHSIPLTINKEEALQRPVAS
VKLQTVHSIPMTIMKAEAIQRPVAS

SEQ ID NO: 59296 - protein, 25 aa, synthetic construct
  source 1..25: note = Seed: VKLQTVHSIPLTINKEEALQRPVAS
VKLQTVHSIPMTIMKAEALQRPVAS

SEQ ID NO: 59297 - protein, 25 aa, synthetic construct
  source 1..25: note = Seed: VKLQTVHSIPLTINKEEALQRPVAS
VKLQTVHSIPMTIMKAEAMQRPVAS

SEQ ID NO: 59298 - protein, 25 aa, synthetic construct
  source 1..25: note = Seed: VKLQTVHSIPLTINKEEALQRPVAS
VKLQTVHSIPMTIMKAEAVQRPVAS

SEQ ID NO: 59299 - protein, 25 aa, synthetic construct
  source 1..25: note = Seed: VKLQTVHSIPLTINKEEALQRPVAS
VKLQTVHSIPMTIMKAEAYQRPVAS

SEQ ID NO: 59300 - protein, 25 aa, synthetic construct
  source 1..25: note = Seed: VKLQTVHSIPLTINKEEALQRPVAS
VKLQTVHSIPMTIMKDEAAQRPVAS

SEQ ID NO: 59301 - protein, 25 aa, synthetic construct
  source 1..25: note = Seed: VKLQTVHSIPLTINKEEALQRPVAS
VKLQTVHSIPMTIMKDEAIQRPVAS

SEQ ID NO: 59302 - protein, 25 aa, synthetic construct
  source 1..25: note = Seed: VKLQTVHSIPLTINKEEALQRPVAS
VKLQTVHSIPMTIMKDEALQRPVAS

SEQ ID NO: 59303 - protein, 25 aa, synthetic construct
  source 1..25: note = Seed: VKLQTVHSIPLTINKEEALQRPVAS
VKLQTVHSIPMTIMKDEAVQRPVAS

SEQ ID NO: 59304 - protein, 25 aa, synthetic construct
  source 1..25: note = Seed: VKLQTVHSIPLTINKEEALQRPVAS
VKLQTVHSIPMTIMKFEAAQRPVAS

SEQ ID NO: 59305 - protein, 25 aa, synthetic construct
  source 1..25: note = Seed: VKLQTVHSIPLTINKEEALQRPVAS
VKLQTVHSIPMTIMKFEAEQRPVAS

SEQ ID NO: 59306 - protein, 25 aa, synthetic construct
  source 1..25: note = Seed: VKLQTVHSIPLTINKEEALQRPVAS
VKLQTVHSIPMTIMKFEAFQRPVAS

SEQ ID NO: 59307 - protein, 25 aa, synthetic construct
  source 1..25: note = Seed: VKLQTVHSIPLTINKEEALQRPVAS
VKLQTVHSIPMTIMKFEAIQRPVAS

SEQ ID NO: 59308 - protein, 25 aa, synthetic construct
  source 1..25: note = Seed: VKLQTVHSIPLTINKEEALQRPVAS
VKLQTVHSIPMTIMKFEALQRPVAS

SEQ ID NO: 59309 - protein, 25 aa, synthetic construct
  source 1..25: note = Seed: VKLQTVHSIPLTINKEEALQRPVAS
VKLQTVHSIPMTIMKFEAMQRPVAS

SEQ ID NO: 59310 - protein, 25 aa, synthetic construct
  source 1..25: note = Seed: VKLQTVHSIPLTINKEEALQRPVAS
VKLQTVHSIPMTIMKFEATQRPVAS

SEQ ID NO: 59311 - protein, 25 aa, synthetic construct
  source 1..25: note = Seed: VKLQTVHSIPLTINKEEALQRPVAS
VKLQTVHSIPMTIMKFEAVQRPVAS

SEQ ID NO: 59312 - protein, 25 aa, synthetic construct
  source 1..25: note = Seed: VKLQTVHSIPLTINKEEALQRPVAS
VKLQTVHSIPMTIMKFEAWQRPVAS

SEQ ID NO: 59313 - protein, 25 aa, synthetic construct
  source 1..25: note = Seed: VKLQTVHSIPLTINKEEALQRPVAS
VKLQTVHSIPMTIMKFEAYQRPVAS

SEQ ID NO: 59314 - protein, 25 aa, synthetic construct
  source 1..25: note = Seed: VKLQTVHSIPLTINKEEALQRPVAS
VKLQTVHSIPMTIMKIEAAQRPVAS

SEQ ID NO: 59315 - protein, 25 aa, synthetic construct
  source 1..25: note = Seed: VKLQTVHSIPLTINKEEALQRPVAS
VKLQTVHSIPMTIMKIEACQRPVAS

SEQ ID NO: 59316 - protein, 25 aa, synthetic construct
  source 1..25: note = Seed: VKLQTVHSIPLTINKEEALQRPVAS
VKLQTVHSIPMTIMKIEADQRPVAS

SEQ ID NO: 59317 - protein, 25 aa, synthetic construct
  source 1..25: note = Seed: VKLQTVHSIPLTINKEEALQRPVAS
VKLQTVHSIPMTIMKIEAFQRPVAS

SEQ ID NO: 59318 - protein, 25 aa, synthetic construct
  source 1..25: note = Seed: VKLQTVHSIPLTINKEEALQRPVAS
VKLQTVHSIPMTIMKIEAGQRPVAS

SEQ ID NO: 59319 - protein, 25 aa, synthetic construct
  source 1..25: note = Seed: VKLQTVHSIPLTINKEEALQRPVAS
VKLQTVHSIPMTIMKIEAIQRPVAS

SEQ ID NO: 59320 - protein, 25 aa, synthetic construct
  source 1..25: note = Seed: VKLQTVHSIPLTINKEEALQRPVAS
VKLQTVHSIPMTIMKIEALQRPVAS

SEQ ID NO: 59321 - protein, 25 aa, synthetic construct
  source 1..25: note = Seed: VKLQTVHSIPLTINKEEALQRPVAS
VKLQTVHSIPMTIMKIEAMQRPVAS

SEQ ID NO: 59322 - protein, 25 aa, synthetic construct
  source 1..25: note = Seed: VKLQTVHSIPLTINKEEALQRPVAS
VKLQTVHSIPMTIMKIEANQRPVAS

SEQ ID NO: 59323 - protein, 25 aa, synthetic construct
  source 1..25: note = Seed: VKLQTVHSIPLTINKEEALQRPVAS
VKLQTVHSIPMTIMKIEAQQRPVAS

SEQ ID NO: 59324 - protein, 25 aa, synthetic construct
  source 1..25: note = Seed: VKLQTVHSIPLTINKEEALQRPVAS
VKLQTVHSIPMTIMKIEARQRPVAS

SEQ ID NO: 59325 - protein, 25 aa, synthetic construct
  source 1..25: note = Seed: VKLQTVHSIPLTINKEEALQRPVAS
VKLQTVHSIPMTIMKIEASQRPVAS

SEQ ID NO: 59326 - protein, 25 aa, synthetic construct
  source 1..25: note = Seed: VKLQTVHSIPLTINKEEALQRPVAS
VKLQTVHSIPMTIMKIEATQRPVAS

SEQ ID NO: 59327 - protein, 25 aa, synthetic construct
  source 1..25: note = Seed: VKLQTVHSIPLTINKEEALQRPVAS
VKLQTVHSIPMTIMKIEAVQRPVAS

SEQ ID NO: 59328 - protein, 25 aa, synthetic construct
  source 1..25: note = Seed: VKLQTVHSIPLTINKEEALQRPVAS
VKLQTVHSIPMTIMKIEAYQRPVAS

SEQ ID NO: 59329 - protein, 25 aa, synthetic construct
  source 1..25: note = Seed: VKLQTVHSIPLTINKEEALQRPVAS
VKLQTVHSIPMTIMKKEALQRPVAS

SEQ ID NO: 59330 - protein, 25 aa, synthetic construct
  source 1..25: note = Seed: VKLQTVHSIPLTINKEEALQRPVAS
VKLQTVHSIPMTIMKLEAAQRPVAS

SEQ ID NO: 59331 - protein, 25 aa, synthetic construct
  source 1..25: note = Seed: VKLQTVHSIPLTINKEEALQRPVAS
VKLQTVHSIPMTIMKLEAFQRPVAS

SEQ ID NO: 59332 - protein, 25 aa, synthetic construct
  source 1..25: note = Seed: VKLQTVHSIPLTINKEEALQRPVAS
VKLQTVHSIPMTIMKLEAIQRPVAS

SEQ ID NO: 59333 - protein, 25 aa, synthetic construct
  source 1..25: note = Seed: VKLQTVHSIPLTINKEEALQRPVAS
VKLQTVHSIPMTIMKLEALQRPVAS

SEQ ID NO: 59334 - protein, 25 aa, synthetic construct
  source 1..25: note = Seed: VKLQTVHSIPLTINKEEALQRPVAS
VKLQTVHSIPMTIMKLEAMQRPVAS

SEQ ID NO: 59335 - protein, 25 aa, synthetic construct
  source 1..25: note = Seed: VKLQTVHSIPLTINKEEALQRPVAS
VKLQTVHSIPMTIMKLEASQRPVAS

SEQ ID NO: 59336 - protein, 25 aa, synthetic construct
  source 1..25: note = Seed: VKLQTVHSIPLTINKEEALQRPVAS
VKLQTVHSIPMTIMKLEAVQRPVAS

SEQ ID NO: 59337 - protein, 25 aa, synthetic construct
  source 1..25: note = Seed: VKLQTVHSIPLTINKEEALQRPVAS
VKLQTVHSIPMTIMKLEAYQRPVAS

SEQ ID NO: 59338 - protein, 25 aa, synthetic construct
  source 1..25: note = Seed: VKLQTVHSIPLTINKEEALQRPVAS
VKLQTVHSIPMTIMKMEAAQRPVAS

SEQ ID NO: 59339 - protein, 25 aa, synthetic construct
  source 1..25: note = Seed: VKLQTVHSIPLTINKEEALQRPVAS
VKLQTVHSIPMTIMKMEAFQRPVAS

SEQ ID NO: 59340 - protein, 25 aa, synthetic construct
  source 1..25: note = Seed: VKLQTVHSIPLTINKEEALQRPVAS
VKLQTVHSIPMTIMKMEAIQRPVAS

SEQ ID NO: 59341 - protein, 25 aa, synthetic construct
  source 1..25: note = Seed: VKLQTVHSIPLTINKEEALQRPVAS
VKLQTVHSIPMTIMKMEALQRPVAS

SEQ ID NO: 59342 - protein, 25 aa, synthetic construct
  source 1..25: note = Seed: VKLQTVHSIPLTINKEEALQRPVAS
VKLQTVHSIPMTIMKMEAMQRPVAS

SEQ ID NO: 59343 - protein, 25 aa, synthetic construct
  source 1..25: note = Seed: VKLQTVHSIPLTINKEEALQRPVAS
VKLQTVHSIPMTIMKMEASQRPVAS

SEQ ID NO: 59344 - protein, 25 aa, synthetic construct
  source 1..25: note = Seed: VKLQTVHSIPLTINKEEALQRPVAS
VKLQTVHSIPMTIMKMEAVQRPVAS

SEQ ID NO: 59345 - protein, 25 aa, synthetic construct
  source 1..25: note = Seed: VKLQTVHSIPLTINKEEALQRPVAS
VKLQTVHSIPMTIMKMEAYQRPVAS

SEQ ID NO: 59346 - protein, 25 aa, synthetic construct
  source 1..25: note = Seed: VKLQTVHSIPLTINKEEALQRPVAS
VKLQTVHSIPMTIMKNEAAQRPVAS

SEQ ID NO: 59347 - protein, 25 aa, synthetic construct
  source 1..25: note = Seed: VKLQTVHSIPLTINKEEALQRPVAS
VKLQTVHSIPMTIMKNEAIQRPVAS

SEQ ID NO: 59348 - protein, 25 aa, synthetic construct
  source 1..25: note = Seed: VKLQTVHSIPLTINKEEALQRPVAS
VKLQTVHSIPMTIMKNEALQRPVAS

SEQ ID NO: 59349 - protein, 25 aa, synthetic construct
  source 1..25: note = Seed: VKLQTVHSIPLTINKEEALQRPVAS
VKLQTVHSIPMTIMKNEAVQRPVAS

SEQ ID NO: 59350 - protein, 25 aa, synthetic construct
  source 1..25: note = Seed: VKLQTVHSIPLTINKEEALQRPVAS
VKLQTVHSIPMTIMKREAFQRPVAS

SEQ ID NO: 59351 - protein, 25 aa, synthetic construct
  source 1..25: note = Seed: VKLQTVHSIPLTINKEEALQRPVAS
VKLQTVHSIPMTIMKREAIQRPVAS

SEQ ID NO: 59352 - protein, 25 aa, synthetic construct
  source 1..25: note = Seed: VKLQTVHSIPLTINKEEALQRPVAS
VKLQTVHSIPMTIMKREALQRPVAS

SEQ ID NO: 59353 - protein, 25 aa, synthetic construct
  source 1..25: note = Seed: VKLQTVHSIPLTINKEEALQRPVAS
VKLQTVHSIPMTIMKREAMQRPVAS

SEQ ID NO: 59354 - protein, 25 aa, synthetic construct
  source 1..25: note = Seed: VKLQTVHSIPLTINKEEALQRPVAS
VKLQTVHSIPMTIMKREAVQRPVAS

SEQ ID NO: 59355 - protein, 25 aa, synthetic construct
  source 1..25: note = Seed: VKLQTVHSIPLTINKEEALQRPVAS
VKLQTVHSIPMTIMKREAYQRPVAS

SEQ ID NO: 59356 - protein, 25 aa, synthetic construct
  source 1..25: note = Seed: VKLQTVHSIPLTINKEEALQRPVAS
VKLQTVHSIPMTIMKSEAIQRPVAS

SEQ ID NO: 59357 - protein, 25 aa, synthetic construct
  source 1..25: note = Seed: VKLQTVHSIPLTINKEEALQRPVAS
VKLQTVHSIPMTIMKSEALQRPVAS

SEQ ID NO: 59358 - protein, 25 aa, synthetic construct
  source 1..25: note = Seed: VKLQTVHSIPLTINKEEALQRPVAS
VKLQTVHSIPMTIMKSEAVQRPVAS

SEQ ID NO: 59359 - protein, 25 aa, synthetic construct
  source 1..25: note = Seed: VKLQTVHSIPLTINKEEALQRPVAS
VKLQTVHSIPMTIMKTEAIQRPVAS

SEQ ID NO: 59360 - protein, 25 aa, synthetic construct
  source 1..25: note = Seed: VKLQTVHSIPLTINKEEALQRPVAS
VKLQTVHSIPMTIMKTEALQRPVAS

SEQ ID NO: 59361 - protein, 25 aa, synthetic construct
  source 1..25: note = Seed: VKLQTVHSIPLTINKEEALQRPVAS
VKLQTVHSIPMTIMKTEAVQRPVAS

SEQ ID NO: 59362 - protein, 25 aa, synthetic construct
  source 1..25: note = Seed: VKLQTVHSIPLTINKEEALQRPVAS
VKLQTVHSIPMTIMKVEAAQRPVAS

SEQ ID NO: 59363 - protein, 25 aa, synthetic construct
  source 1..25: note = Seed: VKLQTVHSIPLTINKEEALQRPVAS
VKLQTVHSIPMTIMKVEAFQRPVAS

SEQ ID NO: 59364 - protein, 25 aa, synthetic construct
  source 1..25: note = Seed: VKLQTVHSIPLTINKEEALQRPVAS
VKLQTVHSIPMTIMKVEAIQRPVAS

SEQ ID NO: 59365 - protein, 25 aa, synthetic construct
  source 1..25: note = Seed: VKLQTVHSIPLTINKEEALQRPVAS
VKLQTVHSIPMTIMKVEALQRPVAS

SEQ ID NO: 59366 - protein, 25 aa, synthetic construct
  source 1..25: note = Seed: VKLQTVHSIPLTINKEEALQRPVAS
VKLQTVHSIPMTIMKVEAMQRPVAS

SEQ ID NO: 59367 - protein, 25 aa, synthetic construct
  source 1..25: note = Seed: VKLQTVHSIPLTINKEEALQRPVAS
VKLQTVHSIPMTIMKVEASQRPVAS

SEQ ID NO: 59368 - protein, 25 aa, synthetic construct
  source 1..25: note = Seed: VKLQTVHSIPLTINKEEALQRPVAS
VKLQTVHSIPMTIMKVEATQRPVAS

SEQ ID NO: 59369 - protein, 25 aa, synthetic construct
  source 1..25: note = Seed: VKLQTVHSIPLTINKEEALQRPVAS
VKLQTVHSIPMTIMKVEAVQRPVAS

SEQ ID NO: 59370 - protein, 25 aa, synthetic construct
  source 1..25: note = Seed: VKLQTVHSIPLTINKEEALQRPVAS
VKLQTVHSIPMTIMKVEAYQRPVAS

SEQ ID NO: 59371 - protein, 25 aa, synthetic construct
  source 1..25: note = Seed: VKLQTVHSIPLTINKEEALQRPVAS
VKLQTVHSIPMTIMKWEAFQRPVAS

SEQ ID NO: 59372 - protein, 25 aa, synthetic construct
  source 1..25: note = Seed: VKLQTVHSIPLTINKEEALQRPVAS
VKLQTVHSIPMTIMKWEALQRPVAS

SEQ ID NO: 59373 - protein, 25 aa, synthetic construct
  source 1..25: note = Seed: VKLQTVHSIPLTINKEEALQRPVAS
VKLQTVHSIPMTIMKYEAFQRPVAS

SEQ ID NO: 59374 - protein, 25 aa, synthetic construct
  source 1..25: note = Seed: VKLQTVHSIPLTINKEEALQRPVAS
VKLQTVHSIPMTIMKYEAIQRPVAS

SEQ ID NO: 59375 - protein, 25 aa, synthetic construct
  source 1..25: note = Seed: VKLQTVHSIPLTINKEEALQRPVAS
VKLQTVHSIPMTIMKYEALQRPVAS

SEQ ID NO: 59376 - protein, 25 aa, synthetic construct
  source 1..25: note = Seed: VKLQTVHSIPLTINKEEALQRPVAS
VKLQTVHSIPMTINKAEAFQRPVAS

SEQ ID NO: 59377 - protein, 25 aa, synthetic construct
  source 1..25: note = Seed: VKLQTVHSIPLTINKEEALQRPVAS
VKLQTVHSIPMTINKAEAIQRPVAS

SEQ ID NO: 59378 - protein, 25 aa, synthetic construct
  source 1..25: note = Seed: VKLQTVHSIPLTINKEEALQRPVAS
VKLQTVHSIPMTINKAEALQRPVAS

SEQ ID NO: 59379 - protein, 25 aa, synthetic construct
  source 1..25: note = Seed: VKLQTVHSIPLTINKEEALQRPVAS
VKLQTVHSIPMTINKAEAMQRPVAS

SEQ ID NO: 59380 - protein, 25 aa, synthetic construct
  source 1..25: note = Seed: VKLQTVHSIPLTINKEEALQRPVAS
VKLQTVHSIPMTINKAEAVQRPVAS

SEQ ID NO: 59381 - protein, 25 aa, synthetic construct
  source 1..25: note = Seed: VKLQTVHSIPLTINKEEALQRPVAS
VKLQTVHSIPMTINKAEAYQRPVAS

SEQ ID NO: 59382 - protein, 25 aa, synthetic construct
  source 1..25: note = Seed: VKLQTVHSIPLTINKEEALQRPVAS
VKLQTVHSIPMTINKFEAFQRPVAS

SEQ ID NO: 59383 - protein, 25 aa, synthetic construct
  source 1..25: note = Seed: VKLQTVHSIPLTINKEEALQRPVAS
VKLQTVHSIPMTINKFEAIQRPVAS

SEQ ID NO: 59384 - protein, 25 aa, synthetic construct
  source 1..25: note = Seed: VKLQTVHSIPLTINKEEALQRPVAS
VKLQTVHSIPMTINKFEALQRPVAS

SEQ ID NO: 59385 - protein, 25 aa, synthetic construct
  source 1..25: note = Seed: VKLQTVHSIPLTINKEEALQRPVAS
VKLQTVHSIPMTINKFEAVQRPVAS

SEQ ID NO: 59386 - protein, 25 aa, synthetic construct
  source 1..25: note = Seed: VKLQTVHSIPLTINKEEALQRPVAS
VKLQTVHSIPMTINKGEAIQRPVAS

SEQ ID NO: 59387 - protein, 25 aa, synthetic construct
  source 1..25: note = Seed: VKLQTVHSIPLTINKEEALQRPVAS
VKLQTVHSIPMTINKGEALQRPVAS

SEQ ID NO: 59388 - protein, 25 aa, synthetic construct
  source 1..25: note = Seed: VKLQTVHSIPLTINKEEALQRPVAS
VKLQTVHSIPMTINKGEAVQRPVAS

SEQ ID NO: 59389 - protein, 25 aa, synthetic construct
  source 1..25: note = Seed: VKLQTVHSIPLTINKEEALQRPVAS
VKLQTVHSIPMTINKIEAFQRPVAS

SEQ ID NO: 59390 - protein, 25 aa, synthetic construct
  source 1..25: note = Seed: VKLQTVHSIPLTINKEEALQRPVAS
VKLQTVHSIPMTINKIEAIQRPVAS

SEQ ID NO: 59391 - protein, 25 aa, synthetic construct
  source 1..25: note = Seed: VKLQTVHSIPLTINKEEALQRPVAS
VKLQTVHSIPMTINKIEALQRPVAS

SEQ ID NO: 59392 - protein, 25 aa, synthetic construct
  source 1..25: note = Seed: VKLQTVHSIPLTINKEEALQRPVAS
VKLQTVHSIPMTINKIEAVQRPVAS

SEQ ID NO: 59393 - protein, 25 aa, synthetic construct
  source 1..25: note = Seed: VKLQTVHSIPLTINKEEALQRPVAS
VKLQTVHSIPMTINKLEAIQRPVAS

SEQ ID NO: 59394 - protein, 25 aa, synthetic construct
  source 1..25: note = Seed: VKLQTVHSIPLTINKEEALQRPVAS
VKLQTVHSIPMTINKNEAFQRPVAS

SEQ ID NO: 59395 - protein, 25 aa, synthetic construct
  source 1..25: note = Seed: VKLQTVHSIPLTINKEEALQRPVAS
VKLQTVHSIPMTINKNEAIQRPVAS

SEQ ID NO: 59396 - protein, 25 aa, synthetic construct
  source 1..25: note = Seed: VKLQTVHSIPLTINKEEALQRPVAS
VKLQTVHSIPMTINKNEALQRPVAS

SEQ ID NO: 59397 - protein, 25 aa, synthetic construct
  source 1..25: note = Seed: VKLQTVHSIPLTINKEEALQRPVAS
VKLQTVHSIPMTINKNEAMQRPVAS

SEQ ID NO: 59398 - protein, 25 aa, synthetic construct
  source 1..25: note = Seed: VKLQTVHSIPLTINKEEALQRPVAS
VKLQTVHSIPMTINKNEAVQRPVAS

SEQ ID NO: 59399 - protein, 25 aa, synthetic construct
  source 1..25: note = Seed: VKLQTVHSIPLTINKEEALQRPVAS
VKLQTVHSIPMTINKNEAYQRPVAS

SEQ ID NO: 59400 - protein, 25 aa, synthetic construct
  source 1..25: note = Seed: VKLQTVHSIPLTINKEEALQRPVAS
VKLQTVHSIPMTINKPEAIQRPVAS

SEQ ID NO: 59401 - protein, 25 aa, synthetic construct
  source 1..25: note = Seed: VKLQTVHSIPLTINKEEALQRPVAS
VKLQTVHSIPMTINKPEAVQRPVAS

SEQ ID NO: 59402 - protein, 25 aa, synthetic construct
  source 1..25: note = Seed: VKLQTVHSIPLTINKEEALQRPVAS
VKLQTVHSIPMTINKSEAFQRPVAS

SEQ ID NO: 59403 - protein, 25 aa, synthetic construct
  source 1..25: note = Seed: VKLQTVHSIPLTINKEEALQRPVAS
VKLQTVHSIPMTINKSEAIQRPVAS

SEQ ID NO: 59404 - protein, 25 aa, synthetic construct
  source 1..25: note = Seed: VKLQTVHSIPLTINKEEALQRPVAS
VKLQTVHSIPMTINKSEALQRPVAS

SEQ ID NO: 59405 - protein, 25 aa, synthetic construct
  source 1..25: note = Seed: VKLQTVHSIPLTINKEEALQRPVAS
VKLQTVHSIPMTINKSEAMQRPVAS

SEQ ID NO: 59406 - protein, 25 aa, synthetic construct
  source 1..25: note = Seed: VKLQTVHSIPLTINKEEALQRPVAS
VKLQTVHSIPMTINKSEAVQRPVAS

SEQ ID NO: 59407 - protein, 25 aa, synthetic construct
  source 1..25: note = Seed: VKLQTVHSIPLTINKEEALQRPVAS
VKLQTVHSIPMTINKSEAYQRPVAS

SEQ ID NO: 59408 - protein, 25 aa, synthetic construct
  source 1..25: note = Seed: VKLQTVHSIPLTINKEEALQRPVAS
VKLQTVHSIPMTINKTEAIQRPVAS

SEQ ID NO: 59409 - protein, 25 aa, synthetic construct
  source 1..25: note = Seed: VKLQTVHSIPLTINKEEALQRPVAS
VKLQTVHSIPMTINKTEALQRPVAS

SEQ ID NO: 59410 - protein, 25 aa, synthetic construct
  source 1..25: note = Seed: VKLQTVHSIPLTINKEEALQRPVAS
VKLQTVHSIPMTINKTEAVQRPVAS

SEQ ID NO: 59411 - protein, 25 aa, synthetic construct
  source 1..25: note = Seed: VKLQTVHSIPLTINKEEALQRPVAS
VKLQTVHSIPMTINKVEAFQRPVAS

SEQ ID NO: 59412 - protein, 25 aa, synthetic construct
  source 1..25: note = Seed: VKLQTVHSIPLTINKEEALQRPVAS
VKLQTVHSIPMTINKVEAIQRPVAS

SEQ ID NO: 59413 - protein, 25 aa, synthetic construct
  source 1..25: note = Seed: VKLQTVHSIPLTINKEEALQRPVAS
VKLQTVHSIPMTINKVEALQRPVAS

SEQ ID NO: 59414 - protein, 25 aa, synthetic construct
  source 1..25: note = Seed: VKLQTVHSIPLTINKEEALQRPVAS
VKLQTVHSIPMTINKVEAVQRPVAS

SEQ ID NO: 59415 - protein, 25 aa, synthetic construct
  source 1..25: note = Seed: VKLQTVHSIPLTINKEEALQRPVAS
VKLQTVHSIPMTIQKFEAFQRPVAS

SEQ ID NO: 59416 - protein, 25 aa, synthetic construct
  source 1..25: note = Seed: VKLQTVHSIPLTINKEEALQRPVAS
VKLQTVHSIPMTIQKFEAIQRPVAS

SEQ ID NO: 59417 - protein, 25 aa, synthetic construct
  source 1..25: note = Seed: VKLQTVHSIPLTINKEEALQRPVAS
VKLQTVHSIPMTIQKFEALQRPVAS

SEQ ID NO: 59418 - protein, 25 aa, synthetic construct
  source 1..25: note = Seed: VKLQTVHSIPLTINKEEALQRPVAS
VKLQTVHSIPMTIQKFEAMQRPVAS

SEQ ID NO: 59419 - protein, 25 aa, synthetic construct
  source 1..25: note = Seed: VKLQTVHSIPLTINKEEALQRPVAS
VKLQTVHSIPMTIQKFEAVQRPVAS

SEQ ID NO: 59420 - protein, 25 aa, synthetic construct
  source 1..25: note = Seed: VKLQTVHSIPLTINKEEALQRPVAS
VKLQTVHSIPMTIQKIEAIQRPVAS

SEQ ID NO: 59421 - protein, 25 aa, synthetic construct
  source 1..25: note = Seed: VKLQTVHSIPLTINKEEALQRPVAS
VKLQTVHSIPMTIRKREAFQRPVAS

SEQ ID NO: 59422 - protein, 25 aa, synthetic construct
  source 1..25: note = Seed: VKLQTVHSIPLTINKEEALQRPVAS
VKLQTVHSIPMTISKFEAAQRPVAS

SEQ ID NO: 59423 - protein, 25 aa, synthetic construct
  source 1..25: note = Seed: VKLQTVHSIPLTINKEEALQRPVAS
VKLQTVHSIPMTISKFEAFQRPVAS

SEQ ID NO: 59424 - protein, 25 aa, synthetic construct
  source 1..25: note = Seed: VKLQTVHSIPLTINKEEALQRPVAS
VKLQTVHSIPMTISKFEAIQRPVAS

SEQ ID NO: 59425 - protein, 25 aa, synthetic construct
  source 1..25: note = Seed: VKLQTVHSIPLTINKEEALQRPVAS
VKLQTVHSIPMTISKFEALQRPVAS

SEQ ID NO: 59426 - protein, 25 aa, synthetic construct
  source 1..25: note = Seed: VKLQTVHSIPLTINKEEALQRPVAS
VKLQTVHSIPMTISKFEAMQRPVAS

SEQ ID NO: 59427 - protein, 25 aa, synthetic construct
  source 1..25: note = Seed: VKLQTVHSIPLTINKEEALQRPVAS
VKLQTVHSIPMTISKFEATQRPVAS

SEQ ID NO: 59428 - protein, 25 aa, synthetic construct
  source 1..25: note = Seed: VKLQTVHSIPLTINKEEALQRPVAS
VKLQTVHSIPMTISKFEAVQRPVAS

SEQ ID NO: 59429 - protein, 25 aa, synthetic construct
  source 1..25: note = Seed: VKLQTVHSIPLTINKEEALQRPVAS
VKLQTVHSIPMTISKFEAYQRPVAS

SEQ ID NO: 59430 - protein, 25 aa, synthetic construct
  source 1..25: note = Seed: VKLQTVHSIPLTINKEEALQRPVAS
VKLQTVHSIPMTISKIEAAQRPVAS

SEQ ID NO: 59431 - protein, 25 aa, synthetic construct
  source 1..25: note = Seed: VKLQTVHSIPLTINKEEALQRPVAS
VKLQTVHSIPMTISKIEAFQRPVAS

SEQ ID NO: 59432 - protein, 25 aa, synthetic construct
  source 1..25: note = Seed: VKLQTVHSIPLTINKEEALQRPVAS
VKLQTVHSIPMTISKIEAIQRPVAS

SEQ ID NO: 59433 - protein, 25 aa, synthetic construct
  source 1..25: note = Seed: VKLQTVHSIPLTINKEEALQRPVAS
VKLQTVHSIPMTISKIEALQRPVAS

SEQ ID NO: 59434 - protein, 25 aa, synthetic construct
  source 1..25: note = Seed: VKLQTVHSIPLTINKEEALQRPVAS
VKLQTVHSIPMTISKIEAMQRPVAS

SEQ ID NO: 59435 - protein, 25 aa, synthetic construct
  source 1..25: note = Seed: VKLQTVHSIPLTINKEEALQRPVAS
VKLQTVHSIPMTISKIEAVQRPVAS

SEQ ID NO: 59436 - protein, 25 aa, synthetic construct
  source 1..25: note = Seed: VKLQTVHSIPLTINKEEALQRPVAS
VKLQTVHSIPMTISKLEAIQRPVAS

SEQ ID NO: 59437 - protein, 25 aa, synthetic construct
  source 1..25: note = Seed: VKLQTVHSIPLTINKEEALQRPVAS
VKLQTVHSIPMTISKVEAIQRPVAS

SEQ ID NO: 59438 - protein, 25 aa, synthetic construct
  source 1..25: note = Seed: VKLQTVHSIPLTINKEEALQRPVAS
VKLQTVHSIPMTISKVEAVQRPVAS

SEQ ID NO: 59439 - protein, 25 aa, synthetic construct
  source 1..25: note = Seed: VKLQTVHSIPLTINKEEALQRPVAS
VKLQTVHSIPMTITKFEAAQRPVAS

SEQ ID NO: 59440 - protein, 25 aa, synthetic construct
  source 1..25: note = Seed: VKLQTVHSIPLTINKEEALQRPVAS
VKLQTVHSIPMTITKFEAFQRPVAS

SEQ ID NO: 59441 - protein, 25 aa, synthetic construct
  source 1..25: note = Seed: VKLQTVHSIPLTINKEEALQRPVAS
VKLQTVHSIPMTITKFEAIQRPVAS

SEQ ID NO: 59442 - protein, 25 aa, synthetic construct
  source 1..25: note = Seed: VKLQTVHSIPLTINKEEALQRPVAS
VKLQTVHSIPMTITKFEALQRPVAS

SEQ ID NO: 59443 - protein, 25 aa, synthetic construct
  source 1..25: note = Seed: VKLQTVHSIPLTINKEEALQRPVAS
VKLQTVHSIPMTITKFEAMQRPVAS

SEQ ID NO: 59444 - protein, 25 aa, synthetic construct
  source 1..25: note = Seed: VKLQTVHSIPLTINKEEALQRPVAS
VKLQTVHSIPMTITKFEATQRPVAS

SEQ ID NO: 59445 - protein, 25 aa, synthetic construct
  source 1..25: note = Seed: VKLQTVHSIPLTINKEEALQRPVAS
VKLQTVHSIPMTITKFEAVQRPVAS

SEQ ID NO: 59446 - protein, 25 aa, synthetic construct
  source 1..25: note = Seed: VKLQTVHSIPLTINKEEALQRPVAS
VKLQTVHSIPMTITKFEAYQRPVAS

SEQ ID NO: 59447 - protein, 25 aa, synthetic construct
  source 1..25: note = Seed: VKLQTVHSIPLTINKEEALQRPVAS
VKLQTVHSIPMTITKYEALQRPVAS

SEQ ID NO: 59448 - protein, 25 aa, synthetic construct
  source 1..25: note = Seed: VKLQTVHSIPLTINKEEALQRPVAS
VKLQTVHSIPMTIVKAEAAQRPVAS

SEQ ID NO: 59449 - protein, 25 aa, synthetic construct
  source 1..25: note = Seed: VKLQTVHSIPLTINKEEALQRPVAS
VKLQTVHSIPMTIVKAEAFQRPVAS

SEQ ID NO: 59450 - protein, 25 aa, synthetic construct
  source 1..25: note = Seed: VKLQTVHSIPLTINKEEALQRPVAS
VKLQTVHSIPMTIVKAEAIQRPVAS

SEQ ID NO: 59451 - protein, 25 aa, synthetic construct
  source 1..25: note = Seed: VKLQTVHSIPLTINKEEALQRPVAS
VKLQTVHSIPMTIVKAEALQRPVAS

SEQ ID NO: 59452 - protein, 25 aa, synthetic construct
  source 1..25: note = Seed: VKLQTVHSIPLTINKEEALQRPVAS
VKLQTVHSIPMTIVKAEAMQRPVAS

SEQ ID NO: 59453 - protein, 25 aa, synthetic construct
  source 1..25: note = Seed: VKLQTVHSIPLTINKEEALQRPVAS
VKLQTVHSIPMTIVKAEAVQRPVAS

SEQ ID NO: 59454 - protein, 25 aa, synthetic construct
  source 1..25: note = Seed: VKLQTVHSIPLTINKEEALQRPVAS
VKLQTVHSIPMTIVKDEAAQRPVAS

SEQ ID NO: 59455 - protein, 25 aa, synthetic construct
  source 1..25: note = Seed: VKLQTVHSIPLTINKEEALQRPVAS
VKLQTVHSIPMTIVKDEAIQRPVAS

SEQ ID NO: 59456 - protein, 25 aa, synthetic construct
  source 1..25: note = Seed: VKLQTVHSIPLTINKEEALQRPVAS
VKLQTVHSIPMTIVKDEALQRPVAS

SEQ ID NO: 59457 - protein, 25 aa, synthetic construct
  source 1..25: note = Seed: VKLQTVHSIPLTINKEEALQRPVAS
VKLQTVHSIPMTIVKDEAVQRPVAS

SEQ ID NO: 59458 - protein, 25 aa, synthetic construct
  source 1..25: note = Seed: VKLQTVHSIPLTINKEEALQRPVAS
VKLQTVHSIPMTIVKFEAAQRPVAS

SEQ ID NO: 59459 - protein, 25 aa, synthetic construct
  source 1..25: note = Seed: VKLQTVHSIPLTINKEEALQRPVAS
VKLQTVHSIPMTIVKFEADQRPVAS

SEQ ID NO: 59460 - protein, 25 aa, synthetic construct
  source 1..25: note = Seed: VKLQTVHSIPLTINKEEALQRPVAS
VKLQTVHSIPMTIVKFEAEQRPVAS

SEQ ID NO: 59461 - protein, 25 aa, synthetic construct
  source 1..25: note = Seed: VKLQTVHSIPLTINKEEALQRPVAS
VKLQTVHSIPMTIVKFEAFQRPVAS

SEQ ID NO: 59462 - protein, 25 aa, synthetic construct
  source 1..25: note = Seed: VKLQTVHSIPLTINKEEALQRPVAS
VKLQTVHSIPMTIVKFEAIQRPVAS

SEQ ID NO: 59463 - protein, 25 aa, synthetic construct
  source 1..25: note = Seed: VKLQTVHSIPLTINKEEALQRPVAS
VKLQTVHSIPMTIVKFEALQRPVAS

SEQ ID NO: 59464 - protein, 25 aa, synthetic construct
  source 1..25: note = Seed: VKLQTVHSIPLTINKEEALQRPVAS
VKLQTVHSIPMTIVKFEAMQRPVAS

SEQ ID NO: 59465 - protein, 25 aa, synthetic construct
  source 1..25: note = Seed: VKLQTVHSIPLTINKEEALQRPVAS
VKLQTVHSIPMTIVKFEANQRPVAS

SEQ ID NO: 59466 - protein, 25 aa, synthetic construct
  source 1..25: note = Seed: VKLQTVHSIPLTINKEEALQRPVAS
VKLQTVHSIPMTIVKFEASQRPVAS

SEQ ID NO: 59467 - protein, 25 aa, synthetic construct
  source 1..25: note = Seed: VKLQTVHSIPLTINKEEALQRPVAS
VKLQTVHSIPMTIVKFEATQRPVAS

SEQ ID NO: 59468 - protein, 25 aa, synthetic construct
  source 1..25: note = Seed: VKLQTVHSIPLTINKEEALQRPVAS
VKLQTVHSIPMTIVKFEAVQRPVAS

SEQ ID NO: 59469 - protein, 25 aa, synthetic construct
  source 1..25: note = Seed: VKLQTVHSIPLTINKEEALQRPVAS
VKLQTVHSIPMTIVKFEAWQRPVAS

SEQ ID NO: 59470 - protein, 25 aa, synthetic construct
  source 1..25: note = Seed: VKLQTVHSIPLTINKEEALQRPVAS
VKLQTVHSIPMTIVKFEAYQRPVAS

SEQ ID NO: 59471 - protein, 25 aa, synthetic construct
  source 1..25: note = Seed: VKLQTVHSIPLTINKEEALQRPVAS
VKLQTVHSIPMTIVKIEAAQRPVAS

SEQ ID NO: 59472 - protein, 25 aa, synthetic construct
  source 1..25: note = Seed: VKLQTVHSIPLTINKEEALQRPVAS
VKLQTVHSIPMTIVKIEAFQRPVAS

SEQ ID NO: 59473 - protein, 25 aa, synthetic construct
  source 1..25: note = Seed: VKLQTVHSIPLTINKEEALQRPVAS
VKLQTVHSIPMTIVKIEAIQRPVAS

SEQ ID NO: 59474 - protein, 25 aa, synthetic construct
  source 1..25: note = Seed: VKLQTVHSIPLTINKEEALQRPVAS
VKLQTVHSIPMTIVKIEALQRPVAS

SEQ ID NO: 59475 - protein, 25 aa, synthetic construct
  source 1..25: note = Seed: VKLQTVHSIPLTINKEEALQRPVAS
VKLQTVHSIPMTIVKIEAMQRPVAS

SEQ ID NO: 59476 - protein, 25 aa, synthetic construct
  source 1..25: note = Seed: VKLQTVHSIPLTINKEEALQRPVAS
VKLQTVHSIPMTIVKIEASQRPVAS

SEQ ID NO: 59477 - protein, 25 aa, synthetic construct
  source 1..25: note = Seed: VKLQTVHSIPLTINKEEALQRPVAS
VKLQTVHSIPMTIVKIEATQRPVAS

SEQ ID NO: 59478 - protein, 25 aa, synthetic construct
  source 1..25: note = Seed: VKLQTVHSIPLTINKEEALQRPVAS
VKLQTVHSIPMTIVKIEAVQRPVAS

SEQ ID NO: 59479 - protein, 25 aa, synthetic construct
  source 1..25: note = Seed: VKLQTVHSIPLTINKEEALQRPVAS
VKLQTVHSIPMTIVKIEAYQRPVAS

SEQ ID NO: 59480 - protein, 25 aa, synthetic construct
  source 1..25: note = Seed: VKLQTVHSIPLTINKEEALQRPVAS
VKLQTVHSIPMTIVKKEALQRPVAS

SEQ ID NO: 59481 - protein, 25 aa, synthetic construct
  source 1..25: note = Seed: VKLQTVHSIPLTINKEEALQRPVAS
VKLQTVHSIPMTIVKLEAAQRPVAS

SEQ ID NO: 59482 - protein, 25 aa, synthetic construct
  source 1..25: note = Seed: VKLQTVHSIPLTINKEEALQRPVAS
VKLQTVHSIPMTIVKLEAFQRPVAS

SEQ ID NO: 59483 - protein, 25 aa, synthetic construct
  source 1..25: note = Seed: VKLQTVHSIPLTINKEEALQRPVAS
VKLQTVHSIPMTIVKLEAIQRPVAS

SEQ ID NO: 59484 - protein, 25 aa, synthetic construct
  source 1..25: note = Seed: VKLQTVHSIPLTINKEEALQRPVAS
VKLQTVHSIPMTIVKLEALQRPVAS

SEQ ID NO: 59485 - protein, 25 aa, synthetic construct
  source 1..25: note = Seed: VKLQTVHSIPLTINKEEALQRPVAS
VKLQTVHSIPMTIVKLEAMQRPVAS

SEQ ID NO: 59486 - protein, 25 aa, synthetic construct
  source 1..25: note = Seed: VKLQTVHSIPLTINKEEALQRPVAS
VKLQTVHSIPMTIVKLEASQRPVAS

SEQ ID NO: 59487 - protein, 25 aa, synthetic construct
  source 1..25: note = Seed: VKLQTVHSIPLTINKEEALQRPVAS
VKLQTVHSIPMTIVKLEAVQRPVAS

SEQ ID NO: 59488 - protein, 25 aa, synthetic construct
  source 1..25: note = Seed: VKLQTVHSIPLTINKEEALQRPVAS
VKLQTVHSIPMTIVKMEAAQRPVAS

SEQ ID NO: 59489 - protein, 25 aa, synthetic construct
  source 1..25: note = Seed: VKLQTVHSIPLTINKEEALQRPVAS
VKLQTVHSIPMTIVKMEAFQRPVAS

SEQ ID NO: 59490 - protein, 25 aa, synthetic construct
  source 1..25: note = Seed: VKLQTVHSIPLTINKEEALQRPVAS
VKLQTVHSIPMTIVKMEAIQRPVAS

SEQ ID NO: 59491 - protein, 25 aa, synthetic construct
  source 1..25: note = Seed: VKLQTVHSIPLTINKEEALQRPVAS
VKLQTVHSIPMTIVKMEALQRPVAS

SEQ ID NO: 59492 - protein, 25 aa, synthetic construct
  source 1..25: note = Seed: VKLQTVHSIPLTINKEEALQRPVAS
VKLQTVHSIPMTIVKMEAMQRPVAS

SEQ ID NO: 59493 - protein, 25 aa, synthetic construct
  source 1..25: note = Seed: VKLQTVHSIPLTINKEEALQRPVAS
VKLQTVHSIPMTIVKMEAVQRPVAS

SEQ ID NO: 59494 - protein, 25 aa, synthetic construct
  source 1..25: note = Seed: VKLQTVHSIPLTINKEEALQRPVAS
VKLQTVHSIPMTIVKNEAIQRPVAS

SEQ ID NO: 59495 - protein, 25 aa, synthetic construct
  source 1..25: note = Seed: VKLQTVHSIPLTINKEEALQRPVAS
VKLQTVHSIPMTIVKNEAVQRPVAS

SEQ ID NO: 59496 - protein, 25 aa, synthetic construct
  source 1..25: note = Seed: VKLQTVHSIPLTINKEEALQRPVAS
VKLQTVHSIPMTIVKREAFQRPVAS

SEQ ID NO: 59497 - protein, 25 aa, synthetic construct
  source 1..25: note = Seed: VKLQTVHSIPLTINKEEALQRPVAS
VKLQTVHSIPMTIVKREAIQRPVAS

SEQ ID NO: 59498 - protein, 25 aa, synthetic construct
  source 1..25: note = Seed: VKLQTVHSIPLTINKEEALQRPVAS
VKLQTVHSIPMTIVKREALQRPVAS

SEQ ID NO: 59499 - protein, 25 aa, synthetic construct
  source 1..25: note = Seed: VKLQTVHSIPLTINKEEALQRPVAS
VKLQTVHSIPMTIVKREAVQRPVAS

SEQ ID NO: 59500 - protein, 25 aa, synthetic construct
  source 1..25: note = Seed: VKLQTVHSIPLTINKEEALQRPVAS
VKLQTVHSIPMTIVKREAYQRPVAS

SEQ ID NO: 59501 - protein, 25 aa, synthetic construct
  source 1..25: note = Seed: VKLQTVHSIPLTINKEEALQRPVAS
VKLQTVHSIPMTIVKSEAIQRPVAS

SEQ ID NO: 59502 - protein, 25 aa, synthetic construct
  source 1..25: note = Seed: VKLQTVHSIPLTINKEEALQRPVAS
VKLQTVHSIPMTIVKSEAVQRPVAS

SEQ ID NO: 59503 - protein, 25 aa, synthetic construct
  source 1..25: note = Seed: VKLQTVHSIPLTINKEEALQRPVAS
VKLQTVHSIPMTIVKVEAAQRPVAS

SEQ ID NO: 59504 - protein, 25 aa, synthetic construct
  source 1..25: note = Seed: VKLQTVHSIPLTINKEEALQRPVAS
VKLQTVHSIPMTIVKVEAFQRPVAS

SEQ ID NO: 59505 - protein, 25 aa, synthetic construct
  source 1..25: note = Seed: VKLQTVHSIPLTINKEEALQRPVAS
VKLQTVHSIPMTIVKVEAIQRPVAS

SEQ ID NO: 59506 - protein, 25 aa, synthetic construct
  source 1..25: note = Seed: VKLQTVHSIPLTINKEEALQRPVAS
VKLQTVHSIPMTIVKVEALQRPVAS

SEQ ID NO: 59507 - protein, 25 aa, synthetic construct
  source 1..25: note = Seed: VKLQTVHSIPLTINKEEALQRPVAS
VKLQTVHSIPMTIVKVEAMQRPVAS

SEQ ID NO: 59508 - protein, 25 aa, synthetic construct
  source 1..25: note = Seed: VKLQTVHSIPLTINKEEALQRPVAS
VKLQTVHSIPMTIVKVEASQRPVAS

SEQ ID NO: 59509 - protein, 25 aa, synthetic construct
  source 1..25: note = Seed: VKLQTVHSIPLTINKEEALQRPVAS
VKLQTVHSIPMTIVKVEAVQRPVAS

SEQ ID NO: 59510 - protein, 25 aa, synthetic construct
  source 1..25: note = Seed: VKLQTVHSIPLTINKEEALQRPVAS
VKLQTVHSIPMTIVKVEAYQRPVAS

SEQ ID NO: 59511 - protein, 25 aa, synthetic construct
  source 1..25: note = Seed: VKLQTVHSIPLTINKEEALQRPVAS
VKLQTVHSIPMTIVKWEAFQRPVAS

SEQ ID NO: 59512 - protein, 25 aa, synthetic construct
  source 1..25: note = Seed: VKLQTVHSIPLTINKEEALQRPVAS
VKLQTVHSIPMTIVKWEAIQRPVAS

SEQ ID NO: 59513 - protein, 25 aa, synthetic construct
  source 1..25: note = Seed: VKLQTVHSIPLTINKEEALQRPVAS
VKLQTVHSIPMTIVKWEALQRPVAS

SEQ ID NO: 59514 - protein, 25 aa, synthetic construct
  source 1..25: note = Seed: VKLQTVHSIPLTINKEEALQRPVAS
VKLQTVHSIPMTIVKWEAVQRPVAS

SEQ ID NO: 59515 - protein, 25 aa, synthetic construct
  source 1..25: note = Seed: VKLQTVHSIPLTINKEEALQRPVAS
VKLQTVHSIPMTIVKYEAFQRPVAS

SEQ ID NO: 59516 - protein, 25 aa, synthetic construct
  source 1..25: note = Seed: VKLQTVHSIPLTINKEEALQRPVAS
VKLQTVHSIPMTIVKYEAIQRPVAS

SEQ ID NO: 59517 - protein, 25 aa, synthetic construct
  source 1..25: note = Seed: VKLQTVHSIPLTINKEEALQRPVAS
VKLQTVHSIPMTIVKYEALQRPVAS

SEQ ID NO: 59518 - protein, 25 aa, synthetic construct
  source 1..25: note = Seed: VKLQTVHSIPLTINKEEALQRPVAS
VKLQTVHSIPMTIVKYEAMQRPVAS

SEQ ID NO: 59519 - protein, 25 aa, synthetic construct
  source 1..25: note = Seed: VKLQTVHSIPLTINKEEALQRPVAS
VKLQTVHSIPMTIVKYEAVQRPVAS

SEQ ID NO: 59520 - protein, 25 aa, synthetic construct
  source 1..25: note = Seed: VKLQTVHSIPLTINKEEALQRPVAS
VKLQTVHSIPMTIVKYEAYQRPVAS

SEQ ID NO: 59521 - protein, 25 aa, synthetic construct
  source 1..25: note = Seed: VKLQTVHSIPLTINKEEALQRPVAS
VKLQTVHSIPMTIWKAEAAQRPVAS

SEQ ID NO: 59522 - protein, 25 aa, synthetic construct
  source 1..25: note = Seed: VKLQTVHSIPLTINKEEALQRPVAS
VKLQTVHSIPMTIWKAEAFQRPVAS

SEQ ID NO: 59523 - protein, 25 aa, synthetic construct
  source 1..25: note = Seed: VKLQTVHSIPLTINKEEALQRPVAS
VKLQTVHSIPMTIWKAEAIQRPVAS

SEQ ID NO: 59524 - protein, 25 aa, synthetic construct
  source 1..25: note = Seed: VKLQTVHSIPLTINKEEALQRPVAS
VKLQTVHSIPMTIWKAEALQRPVAS

SEQ ID NO: 59525 - protein, 25 aa, synthetic construct
  source 1..25: note = Seed: VKLQTVHSIPLTINKEEALQRPVAS
VKLQTVHSIPMTIWKAEAMQRPVAS

SEQ ID NO: 59526 - protein, 25 aa, synthetic construct
  source 1..25: note = Seed: VKLQTVHSIPLTINKEEALQRPVAS
VKLQTVHSIPMTIWKAEAVQRPVAS

SEQ ID NO: 59527 - protein, 25 aa, synthetic construct
  source 1..25: note = Seed: VKLQTVHSIPLTINKEEALQRPVAS
VKLQTVHSIPMTIWKDEAAQRPVAS

SEQ ID NO: 59528 - protein, 25 aa, synthetic construct
  source 1..25: note = Seed: VKLQTVHSIPLTINKEEALQRPVAS
VKLQTVHSIPMTIWKDEAFQRPVAS

SEQ ID NO: 59529 - protein, 25 aa, synthetic construct
  source 1..25: note = Seed: VKLQTVHSIPLTINKEEALQRPVAS
VKLQTVHSIPMTIWKDEAIQRPVAS

SEQ ID NO: 59530 - protein, 25 aa, synthetic construct
  source 1..25: note = Seed: VKLQTVHSIPLTINKEEALQRPVAS
VKLQTVHSIPMTIWKDEALQRPVAS

SEQ ID NO: 59531 - protein, 25 aa, synthetic construct
  source 1..25: note = Seed: VKLQTVHSIPLTINKEEALQRPVAS
VKLQTVHSIPMTIWKDEAMQRPVAS

SEQ ID NO: 59532 - protein, 25 aa, synthetic construct
  source 1..25: note = Seed: VKLQTVHSIPLTINKEEALQRPVAS
VKLQTVHSIPMTIWKDEAVQRPVAS

SEQ ID NO: 59533 - protein, 25 aa, synthetic construct
  source 1..25: note = Seed: VKLQTVHSIPLTINKEEALQRPVAS
VKLQTVHSIPMTIWKFEAFQRPVAS

SEQ ID NO: 59534 - protein, 25 aa, synthetic construct
  source 1..25: note = Seed: VKLQTVHSIPLTINKEEALQRPVAS
VKLQTVHSIPMTIWKFEAIQRPVAS

SEQ ID NO: 59535 - protein, 25 aa, synthetic construct
  source 1..25: note = Seed: VKLQTVHSIPLTINKEEALQRPVAS
VKLQTVHSIPMTIWKFEALQRPVAS

SEQ ID NO: 59536 - protein, 25 aa, synthetic construct
  source 1..25: note = Seed: VKLQTVHSIPLTINKEEALQRPVAS
VKLQTVHSIPMTIWKFEAMQRPVAS

SEQ ID NO: 59537 - protein, 25 aa, synthetic construct
  source 1..25: note = Seed: VKLQTVHSIPLTINKEEALQRPVAS
VKLQTVHSIPMTIWKFEAVQRPVAS

SEQ ID NO: 59538 - protein, 25 aa, synthetic construct
  source 1..25: note = Seed: VKLQTVHSIPLTINKEEALQRPVAS
VKLQTVHSIPMTIWKFEAYQRPVAS

SEQ ID NO: 59539 - protein, 25 aa, synthetic construct
  source 1..25: note = Seed: VKLQTVHSIPLTINKEEALQRPVAS
VKLQTVHSIPMTIWKIEAAQRPVAS

SEQ ID NO: 59540 - protein, 25 aa, synthetic construct
  source 1..25: note = Seed: VKLQTVHSIPLTINKEEALQRPVAS
VKLQTVHSIPMTIWKIEAFQRPVAS

SEQ ID NO: 59541 - protein, 25 aa, synthetic construct
  source 1..25: note = Seed: VKLQTVHSIPLTINKEEALQRPVAS
VKLQTVHSIPMTIWKIEAIQRPVAS

SEQ ID NO: 59542 - protein, 25 aa, synthetic construct
  source 1..25: note = Seed: VKLQTVHSIPLTINKEEALQRPVAS
VKLQTVHSIPMTIWKIEALQRPVAS

SEQ ID NO: 59543 - protein, 25 aa, synthetic construct
  source 1..25: note = Seed: VKLQTVHSIPLTINKEEALQRPVAS
VKLQTVHSIPMTIWKIEAMQRPVAS

SEQ ID NO: 59544 - protein, 25 aa, synthetic construct
  source 1..25: note = Seed: VKLQTVHSIPLTINKEEALQRPVAS
VKLQTVHSIPMTIWKIEASQRPVAS

SEQ ID NO: 59545 - protein, 25 aa, synthetic construct
  source 1..25: note = Seed: VKLQTVHSIPLTINKEEALQRPVAS
VKLQTVHSIPMTIWKIEATQRPVAS

SEQ ID NO: 59546 - protein, 25 aa, synthetic construct
  source 1..25: note = Seed: VKLQTVHSIPLTINKEEALQRPVAS
VKLQTVHSIPMTIWKIEAVQRPVAS

SEQ ID NO: 59547 - protein, 25 aa, synthetic construct
  source 1..25: note = Seed: VKLQTVHSIPLTINKEEALQRPVAS
VKLQTVHSIPMTIWKIEAWQRPVAS

SEQ ID NO: 59548 - protein, 25 aa, synthetic construct
  source 1..25: note = Seed: VKLQTVHSIPLTINKEEALQRPVAS
VKLQTVHSIPMTIWKIEAYQRPVAS

SEQ ID NO: 59549 - protein, 25 aa, synthetic construct
  source 1..25: note = Seed: VKLQTVHSIPLTINKEEALQRPVAS
VKLQTVHSIPMTIWKLEAAQRPVAS

SEQ ID NO: 59550 - protein, 25 aa, synthetic construct
  source 1..25: note = Seed: VKLQTVHSIPLTINKEEALQRPVAS
VKLQTVHSIPMTIWKLEAFQRPVAS

SEQ ID NO: 59551 - protein, 25 aa, synthetic construct
  source 1..25: note = Seed: VKLQTVHSIPLTINKEEALQRPVAS
VKLQTVHSIPMTIWKLEAIQRPVAS

SEQ ID NO: 59552 - protein, 25 aa, synthetic construct
  source 1..25: note = Seed: VKLQTVHSIPLTINKEEALQRPVAS
VKLQTVHSIPMTIWKLEALQRPVAS

SEQ ID NO: 59553 - protein, 25 aa, synthetic construct
  source 1..25: note = Seed: VKLQTVHSIPLTINKEEALQRPVAS
VKLQTVHSIPMTIWKLEAMQRPVAS

SEQ ID NO: 59554 - protein, 25 aa, synthetic construct
  source 1..25: note = Seed: VKLQTVHSIPLTINKEEALQRPVAS
VKLQTVHSIPMTIWKLEASQRPVAS

SEQ ID NO: 59555 - protein, 25 aa, synthetic construct
  source 1..25: note = Seed: VKLQTVHSIPLTINKEEALQRPVAS
VKLQTVHSIPMTIWKLEAVQRPVAS

SEQ ID NO: 59556 - protein, 25 aa, synthetic construct
  source 1..25: note = Seed: VKLQTVHSIPLTINKEEALQRPVAS
VKLQTVHSIPMTIWKMEAAQRPVAS

SEQ ID NO: 59557 - protein, 25 aa, synthetic construct
  source 1..25: note = Seed: VKLQTVHSIPLTINKEEALQRPVAS
VKLQTVHSIPMTIWKMEAFQRPVAS

SEQ ID NO: 59558 - protein, 25 aa, synthetic construct
  source 1..25: note = Seed: VKLQTVHSIPLTINKEEALQRPVAS
VKLQTVHSIPMTIWKMEAIQRPVAS

SEQ ID NO: 59559 - protein, 25 aa, synthetic construct
  source 1..25: note = Seed: VKLQTVHSIPLTINKEEALQRPVAS
VKLQTVHSIPMTIWKMEALQRPVAS

SEQ ID NO: 59560 - protein, 25 aa, synthetic construct
  source 1..25: note = Seed: VKLQTVHSIPLTINKEEALQRPVAS
VKLQTVHSIPMTIWKMEAMQRPVAS

SEQ ID NO: 59561 - protein, 25 aa, synthetic construct
  source 1..25: note = Seed: VKLQTVHSIPLTINKEEALQRPVAS
VKLQTVHSIPMTIWKMEAVQRPVAS

SEQ ID NO: 59562 - protein, 25 aa, synthetic construct
  source 1..25: note = Seed: VKLQTVHSIPLTINKEEALQRPVAS
VKLQTVHSIPMTIWKNEAAQRPVAS

SEQ ID NO: 59563 - protein, 25 aa, synthetic construct
  source 1..25: note = Seed: VKLQTVHSIPLTINKEEALQRPVAS
VKLQTVHSIPMTIWKNEAFQRPVAS

SEQ ID NO: 59564 - protein, 25 aa, synthetic construct
  source 1..25: note = Seed: VKLQTVHSIPLTINKEEALQRPVAS
VKLQTVHSIPMTIWKNEAIQRPVAS

SEQ ID NO: 59565 - protein, 25 aa, synthetic construct
  source 1..25: note = Seed: VKLQTVHSIPLTINKEEALQRPVAS
VKLQTVHSIPMTIWKNEALQRPVAS

SEQ ID NO: 59566 - protein, 25 aa, synthetic construct
  source 1..25: note = Seed: VKLQTVHSIPLTINKEEALQRPVAS
VKLQTVHSIPMTIWKNEAMQRPVAS

SEQ ID NO: 59567 - protein, 25 aa, synthetic construct
  source 1..25: note = Seed: VKLQTVHSIPLTINKEEALQRPVAS
VKLQTVHSIPMTIWKNEAVQRPVAS

SEQ ID NO: 59568 - protein, 25 aa, synthetic construct
  source 1..25: note = Seed: VKLQTVHSIPLTINKEEALQRPVAS
VKLQTVHSIPMTIWKREAFQRPVAS

SEQ ID NO: 59569 - protein, 25 aa, synthetic construct
  source 1..25: note = Seed: VKLQTVHSIPLTINKEEALQRPVAS
VKLQTVHSIPMTIWKREAIQRPVAS

SEQ ID NO: 59570 - protein, 25 aa, synthetic construct
  source 1..25: note = Seed: VKLQTVHSIPLTINKEEALQRPVAS
VKLQTVHSIPMTIWKREALQRPVAS

SEQ ID NO: 59571 - protein, 25 aa, synthetic construct
  source 1..25: note = Seed: VKLQTVHSIPLTINKEEALQRPVAS
VKLQTVHSIPMTIWKREAYQRPVAS

SEQ ID NO: 59572 - protein, 25 aa, synthetic construct
  source 1..25: note = Seed: VKLQTVHSIPLTINKEEALQRPVAS
VKLQTVHSIPMTIWKSEAAQRPVAS

SEQ ID NO: 59573 - protein, 25 aa, synthetic construct
  source 1..25: note = Seed: VKLQTVHSIPLTINKEEALQRPVAS
VKLQTVHSIPMTIWKSEAIQRPVAS

SEQ ID NO: 59574 - protein, 25 aa, synthetic construct
  source 1..25: note = Seed: VKLQTVHSIPLTINKEEALQRPVAS
VKLQTVHSIPMTIWKSEALQRPVAS

SEQ ID NO: 59575 - protein, 25 aa, synthetic construct
  source 1..25: note = Seed: VKLQTVHSIPLTINKEEALQRPVAS
VKLQTVHSIPMTIWKSEAVQRPVAS

SEQ ID NO: 59576 - protein, 25 aa, synthetic construct
  source 1..25: note = Seed: VKLQTVHSIPLTINKEEALQRPVAS
VKLQTVHSIPMTIWKTEAIQRPVAS

SEQ ID NO: 59577 - protein, 25 aa, synthetic construct
  source 1..25: note = Seed: VKLQTVHSIPLTINKEEALQRPVAS
VKLQTVHSIPMTIWKTEALQRPVAS

SEQ ID NO: 59578 - protein, 25 aa, synthetic construct
  source 1..25: note = Seed: VKLQTVHSIPLTINKEEALQRPVAS
VKLQTVHSIPMTIWKTEAVQRPVAS

SEQ ID NO: 59579 - protein, 25 aa, synthetic construct
  source 1..25: note = Seed: VKLQTVHSIPLTINKEEALQRPVAS
VKLQTVHSIPMTIWKVEAAQRPVAS

SEQ ID NO: 59580 - protein, 25 aa, synthetic construct
  source 1..25: note = Seed: VKLQTVHSIPLTINKEEALQRPVAS
VKLQTVHSIPMTIWKVEAFQRPVAS

SEQ ID NO: 59581 - protein, 25 aa, synthetic construct
  source 1..25: note = Seed: VKLQTVHSIPLTINKEEALQRPVAS
VKLQTVHSIPMTIWKVEAIQRPVAS

SEQ ID NO: 59582 - protein, 25 aa, synthetic construct
  source 1..25: note = Seed: VKLQTVHSIPLTINKEEALQRPVAS
VKLQTVHSIPMTIWKVEALQRPVAS

SEQ ID NO: 59583 - protein, 25 aa, synthetic construct
  source 1..25: note = Seed: VKLQTVHSIPLTINKEEALQRPVAS
VKLQTVHSIPMTIWKVEAMQRPVAS

SEQ ID NO: 59584 - protein, 25 aa, synthetic construct
  source 1..25: note = Seed: VKLQTVHSIPLTINKEEALQRPVAS
VKLQTVHSIPMTIWKVEASQRPVAS

SEQ ID NO: 59585 - protein, 25 aa, synthetic construct
  source 1..25: note = Seed: VKLQTVHSIPLTINKEEALQRPVAS
VKLQTVHSIPMTIWKVEAVQRPVAS

SEQ ID NO: 59586 - protein, 25 aa, synthetic construct
  source 1..25: note = Seed: VKLQTVHSIPLTINKEEALQRPVAS
VKLQTVHSIPMTIWKVEAYQRPVAS

SEQ ID NO: 59587 - protein, 25 aa, synthetic construct
  source 1..25: note = Seed: VKLQTVHSIPLTINKEEALQRPVAS
VKLQTVHSIPMTIWKWEAFQRPVAS

SEQ ID NO: 59588 - protein, 25 aa, synthetic construct
  source 1..25: note = Seed: VKLQTVHSIPLTINKEEALQRPVAS
VKLQTVHSIPMTIWKWEALQRPVAS

SEQ ID NO: 59589 - protein, 25 aa, synthetic construct
  source 1..25: note = Seed: VKLQTVHSIPLTINKEEALQRPVAS
VKLQTVHSIPMTIWKYEAFQRPVAS

SEQ ID NO: 59590 - protein, 25 aa, synthetic construct
  source 1..25: note = Seed: VKLQTVHSIPLTINKEEALQRPVAS
VKLQTVHSIPMTIWKYEALQRPVAS

SEQ ID NO: 59591 - protein, 25 aa, synthetic construct
  source 1..25: note = Seed: VKLQTVHSIPLTINKEEALQRPVAS
VKLQTVHSIPMTIYKAEAAQRPVAS

SEQ ID NO: 59592 - protein, 25 aa, synthetic construct
  source 1..25: note = Seed: VKLQTVHSIPLTINKEEALQRPVAS
VKLQTVHSIPMTIYKAEAFQRPVAS

SEQ ID NO: 59593 - protein, 25 aa, synthetic construct
  source 1..25: note = Seed: VKLQTVHSIPLTINKEEALQRPVAS
VKLQTVHSIPMTIYKAEAIQRPVAS

SEQ ID NO: 59594 - protein, 25 aa, synthetic construct
  source 1..25: note = Seed: VKLQTVHSIPLTINKEEALQRPVAS
VKLQTVHSIPMTIYKAEALQRPVAS

SEQ ID NO: 59595 - protein, 25 aa, synthetic construct
  source 1..25: note = Seed: VKLQTVHSIPLTINKEEALQRPVAS
VKLQTVHSIPMTIYKAEAMQRPVAS

SEQ ID NO: 59596 - protein, 25 aa, synthetic construct
  source 1..25: note = Seed: VKLQTVHSIPLTINKEEALQRPVAS
VKLQTVHSIPMTIYKAEASQRPVAS

SEQ ID NO: 59597 - protein, 25 aa, synthetic construct
  source 1..25: note = Seed: VKLQTVHSIPLTINKEEALQRPVAS
VKLQTVHSIPMTIYKAEATQRPVAS

SEQ ID NO: 59598 - protein, 25 aa, synthetic construct
  source 1..25: note = Seed: VKLQTVHSIPLTINKEEALQRPVAS
VKLQTVHSIPMTIYKAEAVQRPVAS

SEQ ID NO: 59599 - protein, 25 aa, synthetic construct
  source 1..25: note = Seed: VKLQTVHSIPLTINKEEALQRPVAS
VKLQTVHSIPMTIYKAEAYQRPVAS

SEQ ID NO: 59600 - protein, 25 aa, synthetic construct
  source 1..25: note = Seed: VKLQTVHSIPLTINKEEALQRPVAS
VKLQTVHSIPMTIYKDEAAQRPVAS

SEQ ID NO: 59601 - protein, 25 aa, synthetic construct
  source 1..25: note = Seed: VKLQTVHSIPLTINKEEALQRPVAS
VKLQTVHSIPMTIYKDEACQRPVAS

SEQ ID NO: 59602 - protein, 25 aa, synthetic construct
  source 1..25: note = Seed: VKLQTVHSIPLTINKEEALQRPVAS
VKLQTVHSIPMTIYKDEAFQRPVAS

SEQ ID NO: 59603 - protein, 25 aa, synthetic construct
  source 1..25: note = Seed: VKLQTVHSIPLTINKEEALQRPVAS
VKLQTVHSIPMTIYKDEAGQRPVAS

SEQ ID NO: 59604 - protein, 25 aa, synthetic construct
  source 1..25: note = Seed: VKLQTVHSIPLTINKEEALQRPVAS
VKLQTVHSIPMTIYKDEAIQRPVAS

SEQ ID NO: 59605 - protein, 25 aa, synthetic construct
  source 1..25: note = Seed: VKLQTVHSIPLTINKEEALQRPVAS
VKLQTVHSIPMTIYKDEALQRPVAS

SEQ ID NO: 59606 - protein, 25 aa, synthetic construct
  source 1..25: note = Seed: VKLQTVHSIPLTINKEEALQRPVAS
VKLQTVHSIPMTIYKDEAMQRPVAS

SEQ ID NO: 59607 - protein, 25 aa, synthetic construct
  source 1..25: note = Seed: VKLQTVHSIPLTINKEEALQRPVAS
VKLQTVHSIPMTIYKDEAQQRPVAS

SEQ ID NO: 59608 - protein, 25 aa, synthetic construct
  source 1..25: note = Seed: VKLQTVHSIPLTINKEEALQRPVAS
VKLQTVHSIPMTIYKDEASQRPVAS

SEQ ID NO: 59609 - protein, 25 aa, synthetic construct
  source 1..25: note = Seed: VKLQTVHSIPLTINKEEALQRPVAS
VKLQTVHSIPMTIYKDEATQRPVAS

SEQ ID NO: 59610 - protein, 25 aa, synthetic construct
  source 1..25: note = Seed: VKLQTVHSIPLTINKEEALQRPVAS
VKLQTVHSIPMTIYKDEAVQRPVAS

SEQ ID NO: 59611 - protein, 25 aa, synthetic construct
  source 1..25: note = Seed: VKLQTVHSIPLTINKEEALQRPVAS
VKLQTVHSIPMTIYKDEAYQRPVAS

SEQ ID NO: 59612 - protein, 25 aa, synthetic construct
  source 1..25: note = Seed: VKLQTVHSIPLTINKEEALQRPVAS
VKLQTVHSIPMTIYKFEAAQRPVAS

SEQ ID NO: 59613 - protein, 25 aa, synthetic construct
  source 1..25: note = Seed: VKLQTVHSIPLTINKEEALQRPVAS
VKLQTVHSIPMTIYKFEAFQRPVAS

SEQ ID NO: 59614 - protein, 25 aa, synthetic construct
  source 1..25: note = Seed: VKLQTVHSIPLTINKEEALQRPVAS
VKLQTVHSIPMTIYKFEAIQRPVAS

SEQ ID NO: 59615 - protein, 25 aa, synthetic construct
  source 1..25: note = Seed: VKLQTVHSIPLTINKEEALQRPVAS
VKLQTVHSIPMTIYKFEALQRPVAS

SEQ ID NO: 59616 - protein, 25 aa, synthetic construct
  source 1..25: note = Seed: VKLQTVHSIPLTINKEEALQRPVAS
VKLQTVHSIPMTIYKFEAMQRPVAS

SEQ ID NO: 59617 - protein, 25 aa, synthetic construct
  source 1..25: note = Seed: VKLQTVHSIPLTINKEEALQRPVAS
VKLQTVHSIPMTIYKFEAVQRPVAS

SEQ ID NO: 59618 - protein, 25 aa, synthetic construct
  source 1..25: note = Seed: VKLQTVHSIPLTINKEEALQRPVAS
VKLQTVHSIPMTIYKFEAWQRPVAS

SEQ ID NO: 59619 - protein, 25 aa, synthetic construct
  source 1..25: note = Seed: VKLQTVHSIPLTINKEEALQRPVAS
VKLQTVHSIPMTIYKFEAYQRPVAS

SEQ ID NO: 59620 - protein, 25 aa, synthetic construct
  source 1..25: note = Seed: VKLQTVHSIPLTINKEEALQRPVAS
VKLQTVHSIPMTIYKHEAFQRPVAS

SEQ ID NO: 59621 - protein, 25 aa, synthetic construct
  source 1..25: note = Seed: VKLQTVHSIPLTINKEEALQRPVAS
VKLQTVHSIPMTIYKHEALQRPVAS

SEQ ID NO: 59622 - protein, 25 aa, synthetic construct
  source 1..25: note = Seed: VKLQTVHSIPLTINKEEALQRPVAS
VKLQTVHSIPMTIYKIEAAQRPVAS

SEQ ID NO: 59623 - protein, 25 aa, synthetic construct
  source 1..25: note = Seed: VKLQTVHSIPLTINKEEALQRPVAS
VKLQTVHSIPMTIYKIEACQRPVAS

SEQ ID NO: 59624 - protein, 25 aa, synthetic construct
  source 1..25: note = Seed: VKLQTVHSIPLTINKEEALQRPVAS
VKLQTVHSIPMTIYKIEADQRPVAS

SEQ ID NO: 59625 - protein, 25 aa, synthetic construct
  source 1..25: note = Seed: VKLQTVHSIPLTINKEEALQRPVAS
VKLQTVHSIPMTIYKIEAEQRPVAS

SEQ ID NO: 59626 - protein, 25 aa, synthetic construct
  source 1..25: note = Seed: VKLQTVHSIPLTINKEEALQRPVAS
VKLQTVHSIPMTIYKIEAFQRPVAS

SEQ ID NO: 59627 - protein, 25 aa, synthetic construct
  source 1..25: note = Seed: VKLQTVHSIPLTINKEEALQRPVAS
VKLQTVHSIPMTIYKIEAGQRPVAS

SEQ ID NO: 59628 - protein, 25 aa, synthetic construct
  source 1..25: note = Seed: VKLQTVHSIPLTINKEEALQRPVAS
VKLQTVHSIPMTIYKIEAHQRPVAS

SEQ ID NO: 59629 - protein, 25 aa, synthetic construct
  source 1..25: note = Seed: VKLQTVHSIPLTINKEEALQRPVAS
VKLQTVHSIPMTIYKIEAIQRPVAS

SEQ ID NO: 59630 - protein, 25 aa, synthetic construct
  source 1..25: note = Seed: VKLQTVHSIPLTINKEEALQRPVAS
VKLQTVHSIPMTIYKIEALQRPVAS

SEQ ID NO: 59631 - protein, 25 aa, synthetic construct
  source 1..25: note = Seed: VKLQTVHSIPLTINKEEALQRPVAS
VKLQTVHSIPMTIYKIEAMQRPVAS

SEQ ID NO: 59632 - protein, 25 aa, synthetic construct
  source 1..25: note = Seed: VKLQTVHSIPLTINKEEALQRPVAS
VKLQTVHSIPMTIYKIEANQRPVAS

SEQ ID NO: 59633 - protein, 25 aa, synthetic construct
  source 1..25: note = Seed: VKLQTVHSIPLTINKEEALQRPVAS
VKLQTVHSIPMTIYKIEAQQRPVAS

SEQ ID NO: 59634 - protein, 25 aa, synthetic construct
  source 1..25: note = Seed: VKLQTVHSIPLTINKEEALQRPVAS
VKLQTVHSIPMTIYKIEARQRPVAS

SEQ ID NO: 59635 - protein, 25 aa, synthetic construct
  source 1..25: note = Seed: VKLQTVHSIPLTINKEEALQRPVAS
VKLQTVHSIPMTIYKIEASQRPVAS

SEQ ID NO: 59636 - protein, 25 aa, synthetic construct
  source 1..25: note = Seed: VKLQTVHSIPLTINKEEALQRPVAS
VKLQTVHSIPMTIYKIEATQRPVAS

SEQ ID NO: 59637 - protein, 25 aa, synthetic construct
  source 1..25: note = Seed: VKLQTVHSIPLTINKEEALQRPVAS
VKLQTVHSIPMTIYKIEAVQRPVAS

SEQ ID NO: 59638 - protein, 25 aa, synthetic construct
  source 1..25: note = Seed: VKLQTVHSIPLTINKEEALQRPVAS
VKLQTVHSIPMTIYKIEAWQRPVAS

SEQ ID NO: 59639 - protein, 25 aa, synthetic construct
  source 1..25: note = Seed: VKLQTVHSIPLTINKEEALQRPVAS
VKLQTVHSIPMTIYKIEAYQRPVAS

SEQ ID NO: 59640 - protein, 25 aa, synthetic construct
  source 1..25: note = Seed: VKLQTVHSIPLTINKEEALQRPVAS
VKLQTVHSIPMTIYKLEAAQRPVAS

SEQ ID NO: 59641 - protein, 25 aa, synthetic construct
  source 1..25: note = Seed: VKLQTVHSIPLTINKEEALQRPVAS
VKLQTVHSIPMTIYKLEAFQRPVAS

SEQ ID NO: 59642 - protein, 25 aa, synthetic construct
  source 1..25: note = Seed: VKLQTVHSIPLTINKEEALQRPVAS
VKLQTVHSIPMTIYKLEAIQRPVAS

SEQ ID NO: 59643 - protein, 25 aa, synthetic construct
  source 1..25: note = Seed: VKLQTVHSIPLTINKEEALQRPVAS
VKLQTVHSIPMTIYKLEALQRPVAS

SEQ ID NO: 59644 - protein, 25 aa, synthetic construct
  source 1..25: note = Seed: VKLQTVHSIPLTINKEEALQRPVAS
VKLQTVHSIPMTIYKLEAMQRPVAS

SEQ ID NO: 59645 - protein, 25 aa, synthetic construct
  source 1..25: note = Seed: VKLQTVHSIPLTINKEEALQRPVAS
VKLQTVHSIPMTIYKLEASQRPVAS

SEQ ID NO: 59646 - protein, 25 aa, synthetic construct
  source 1..25: note = Seed: VKLQTVHSIPLTINKEEALQRPVAS
VKLQTVHSIPMTIYKLEATQRPVAS

SEQ ID NO: 59647 - protein, 25 aa, synthetic construct
  source 1..25: note = Seed: VKLQTVHSIPLTINKEEALQRPVAS
VKLQTVHSIPMTIYKLEAVQRPVAS

SEQ ID NO: 59648 - protein, 25 aa, synthetic construct
  source 1..25: note = Seed: VKLQTVHSIPLTINKEEALQRPVAS
VKLQTVHSIPMTIYKLEAYQRPVAS

SEQ ID NO: 59649 - protein, 25 aa, synthetic construct
  source 1..25: note = Seed: VKLQTVHSIPLTINKEEALQRPVAS
VKLQTVHSIPMTIYKMEAAQRPVAS

SEQ ID NO: 59650 - protein, 25 aa, synthetic construct
  source 1..25: note = Seed: VKLQTVHSIPLTINKEEALQRPVAS
VKLQTVHSIPMTIYKMEAFQRPVAS

SEQ ID NO: 59651 - protein, 25 aa, synthetic construct
  source 1..25: note = Seed: VKLQTVHSIPLTINKEEALQRPVAS
VKLQTVHSIPMTIYKMEAIQRPVAS

SEQ ID NO: 59652 - protein, 25 aa, synthetic construct
  source 1..25: note = Seed: VKLQTVHSIPLTINKEEALQRPVAS
VKLQTVHSIPMTIYKMEALQRPVAS

SEQ ID NO: 59653 - protein, 25 aa, synthetic construct
  source 1..25: note = Seed: VKLQTVHSIPLTINKEEALQRPVAS
VKLQTVHSIPMTIYKMEAMQRPVAS

SEQ ID NO: 59654 - protein, 25 aa, synthetic construct
  source 1..25: note = Seed: VKLQTVHSIPLTINKEEALQRPVAS
VKLQTVHSIPMTIYKMEASQRPVAS

SEQ ID NO: 59655 - protein, 25 aa, synthetic construct
  source 1..25: note = Seed: VKLQTVHSIPLTINKEEALQRPVAS
VKLQTVHSIPMTIYKMEAVQRPVAS

SEQ ID NO: 59656 - protein, 25 aa, synthetic construct
  source 1..25: note = Seed: VKLQTVHSIPLTINKEEALQRPVAS
VKLQTVHSIPMTIYKMEAYQRPVAS

SEQ ID NO: 59657 - protein, 25 aa, synthetic construct
  source 1..25: note = Seed: VKLQTVHSIPLTINKEEALQRPVAS
VKLQTVHSIPMTIYKNEAAQRPVAS

SEQ ID NO: 59658 - protein, 25 aa, synthetic construct
  source 1..25: note = Seed: VKLQTVHSIPLTINKEEALQRPVAS
VKLQTVHSIPMTIYKNEAFQRPVAS

SEQ ID NO: 59659 - protein, 25 aa, synthetic construct
  source 1..25: note = Seed: VKLQTVHSIPLTINKEEALQRPVAS
VKLQTVHSIPMTIYKNEAIQRPVAS

SEQ ID NO: 59660 - protein, 25 aa, synthetic construct
  source 1..25: note = Seed: VKLQTVHSIPLTINKEEALQRPVAS
VKLQTVHSIPMTIYKNEALQRPVAS

SEQ ID NO: 59661 - protein, 25 aa, synthetic construct
  source 1..25: note = Seed: VKLQTVHSIPLTINKEEALQRPVAS
VKLQTVHSIPMTIYKNEAMQRPVAS

SEQ ID NO: 59662 - protein, 25 aa, synthetic construct
  source 1..25: note = Seed: VKLQTVHSIPLTINKEEALQRPVAS
VKLQTVHSIPMTIYKNEAVQRPVAS

SEQ ID NO: 59663 - protein, 25 aa, synthetic construct
  source 1..25: note = Seed: VKLQTVHSIPLTINKEEALQRPVAS
VKLQTVHSIPMTIYKPEAIQRPVAS

SEQ ID NO: 59664 - protein, 25 aa, synthetic construct
  source 1..25: note = Seed: VKLQTVHSIPLTINKEEALQRPVAS
VKLQTVHSIPMTIYKREAFQRPVAS

SEQ ID NO: 59665 - protein, 25 aa, synthetic construct
  source 1..25: note = Seed: VKLQTVHSIPLTINKEEALQRPVAS
VKLQTVHSIPMTIYKREALQRPVAS

SEQ ID NO: 59666 - protein, 25 aa, synthetic construct
  source 1..25: note = Seed: VKLQTVHSIPLTINKEEALQRPVAS
VKLQTVHSIPMTIYKREAYQRPVAS

SEQ ID NO: 59667 - protein, 25 aa, synthetic construct
  source 1..25: note = Seed: VKLQTVHSIPLTINKEEALQRPVAS
VKLQTVHSIPMTIYKSEAAQRPVAS

SEQ ID NO: 59668 - protein, 25 aa, synthetic construct
  source 1..25: note = Seed: VKLQTVHSIPLTINKEEALQRPVAS
VKLQTVHSIPMTIYKSEAIQRPVAS

SEQ ID NO: 59669 - protein, 25 aa, synthetic construct
  source 1..25: note = Seed: VKLQTVHSIPLTINKEEALQRPVAS
VKLQTVHSIPMTIYKSEALQRPVAS

SEQ ID NO: 59670 - protein, 25 aa, synthetic construct
  source 1..25: note = Seed: VKLQTVHSIPLTINKEEALQRPVAS
VKLQTVHSIPMTIYKSEAMQRPVAS

SEQ ID NO: 59671 - protein, 25 aa, synthetic construct
  source 1..25: note = Seed: VKLQTVHSIPLTINKEEALQRPVAS
VKLQTVHSIPMTIYKSEAVQRPVAS

SEQ ID NO: 59672 - protein, 25 aa, synthetic construct
  source 1..25: note = Seed: VKLQTVHSIPLTINKEEALQRPVAS
VKLQTVHSIPMTIYKTEAAQRPVAS

SEQ ID NO: 59673 - protein, 25 aa, synthetic construct
  source 1..25: note = Seed: VKLQTVHSIPLTINKEEALQRPVAS
VKLQTVHSIPMTIYKTEAIQRPVAS

SEQ ID NO: 59674 - protein, 25 aa, synthetic construct
  source 1..25: note = Seed: VKLQTVHSIPLTINKEEALQRPVAS
VKLQTVHSIPMTIYKTEALQRPVAS

SEQ ID NO: 59675 - protein, 25 aa, synthetic construct
  source 1..25: note = Seed: VKLQTVHSIPLTINKEEALQRPVAS
VKLQTVHSIPMTIYKTEAVQRPVAS

SEQ ID NO: 59676 - protein, 25 aa, synthetic construct
  source 1..25: note = Seed: VKLQTVHSIPLTINKEEALQRPVAS
VKLQTVHSIPMTIYKVEAAQRPVAS

SEQ ID NO: 59677 - protein, 25 aa, synthetic construct
  source 1..25: note = Seed: VKLQTVHSIPLTINKEEALQRPVAS
VKLQTVHSIPMTIYKVEACQRPVAS

SEQ ID NO: 59678 - protein, 25 aa, synthetic construct
  source 1..25: note = Seed: VKLQTVHSIPLTINKEEALQRPVAS
VKLQTVHSIPMTIYKVEAFQRPVAS

SEQ ID NO: 59679 - protein, 25 aa, synthetic construct
  source 1..25: note = Seed: VKLQTVHSIPLTINKEEALQRPVAS
VKLQTVHSIPMTIYKVEAGQRPVAS

SEQ ID NO: 59680 - protein, 25 aa, synthetic construct
  source 1..25: note = Seed: VKLQTVHSIPLTINKEEALQRPVAS
VKLQTVHSIPMTIYKVEAIQRPVAS

SEQ ID NO: 59681 - protein, 25 aa, synthetic construct
  source 1..25: note = Seed: VKLQTVHSIPLTINKEEALQRPVAS
VKLQTVHSIPMTIYKVEALQRPVAS

SEQ ID NO: 59682 - protein, 25 aa, synthetic construct
  source 1..25: note = Seed: VKLQTVHSIPLTINKEEALQRPVAS
VKLQTVHSIPMTIYKVEAMQRPVAS

SEQ ID NO: 59683 - protein, 25 aa, synthetic construct
  source 1..25: note = Seed: VKLQTVHSIPLTINKEEALQRPVAS
VKLQTVHSIPMTIYKVEAQQRPVAS

SEQ ID NO: 59684 - protein, 25 aa, synthetic construct
  source 1..25: note = Seed: VKLQTVHSIPLTINKEEALQRPVAS
VKLQTVHSIPMTIYKVEASQRPVAS

SEQ ID NO: 59685 - protein, 25 aa, synthetic construct
  source 1..25: note = Seed: VKLQTVHSIPLTINKEEALQRPVAS
VKLQTVHSIPMTIYKVEATQRPVAS

SEQ ID NO: 59686 - protein, 25 aa, synthetic construct
  source 1..25: note = Seed: VKLQTVHSIPLTINKEEALQRPVAS
VKLQTVHSIPMTIYKVEAVQRPVAS

SEQ ID NO: 59687 - protein, 25 aa, synthetic construct
  source 1..25: note = Seed: VKLQTVHSIPLTINKEEALQRPVAS
VKLQTVHSIPMTIYKVEAYQRPVAS

SEQ ID NO: 59688 - protein, 25 aa, synthetic construct
  source 1..25: note = Seed: VKLQTVHSIPLTINKEEALQRPVAS
VKLQTVHSIPMTIYKWEAFQRPVAS

SEQ ID NO: 59689 - protein, 25 aa, synthetic construct
  source 1..25: note = Seed: VKLQTVHSIPLTINKEEALQRPVAS
VKLQTVHSIPMTIYKWEAIQRPVAS

SEQ ID NO: 59690 - protein, 25 aa, synthetic construct
  source 1..25: note = Seed: VKLQTVHSIPLTINKEEALQRPVAS
VKLQTVHSIPMTIYKWEALQRPVAS

SEQ ID NO: 59691 - protein, 25 aa, synthetic construct
  source 1..25: note = Seed: VKLQTVHSIPLTINKEEALQRPVAS
VKLQTVHSIPMTIYKYEAFQRPVAS

SEQ ID NO: 59692 - protein, 25 aa, synthetic construct
  source 1..25: note = Seed: VKLQTVHSIPLTINKEEALQRPVAS
VKLQTVHSIPMTIYKYEAIQRPVAS

SEQ ID NO: 59693 - protein, 25 aa, synthetic construct
  source 1..25: note = Seed: VKLQTVHSIPLTINKEEALQRPVAS
VKLQTVHSIPMTIYKYEALQRPVAS

SEQ ID NO: 59694 - protein, 25 aa, synthetic construct
  source 1..25: note = Seed: VKLQTVHSIPLTINKEEALQRPVAS
VKLQTVHSIPMTIYKYEAMQRPVAS

SEQ ID NO: 59695 - protein, 25 aa, synthetic construct
  source 1..25: note = Seed: VKLQTVHSIPLTINKEEALQRPVAS
VKLQTVHSIPNTIFKIEAAQRPVAS

SEQ ID NO: 59696 - protein, 25 aa, synthetic construct
  source 1..25: note = Seed: VKLQTVHSIPLTINKEEALQRPVAS
VKLQTVHSIPNTIFKIEAIQRPVAS

SEQ ID NO: 59697 - protein, 25 aa, synthetic construct
  source 1..25: note = Seed: VKLQTVHSIPLTINKEEALQRPVAS
VKLQTVHSIPNTIFKIEAVQRPVAS

SEQ ID NO: 59698 - protein, 25 aa, synthetic construct
  source 1..25: note = Seed: VKLQTVHSIPLTINKEEALQRPVAS
VKLQTVHSIPQTIFKFEAIQRPVAS

SEQ ID NO: 59699 - protein, 25 aa, synthetic construct
  source 1..25: note = Seed: VKLQTVHSIPLTINKEEALQRPVAS
VKLQTVHSIPQTIFKFEALQRPVAS

SEQ ID NO: 59700 - protein, 25 aa, synthetic construct
  source 1..25: note = Seed: VKLQTVHSIPLTINKEEALQRPVAS
VKLQTVHSIPQTIFKFEAMQRPVAS

SEQ ID NO: 59701 - protein, 25 aa, synthetic construct
  source 1..25: note = Seed: VKLQTVHSIPLTINKEEALQRPVAS
VKLQTVHSIPQTIFKFEAVQRPVAS

SEQ ID NO: 59702 - protein, 25 aa, synthetic construct
  source 1..25: note = Seed: VKLQTVHSIPLTINKEEALQRPVAS
VKLQTVHSIPQTIIKFEAIQRPVAS

SEQ ID NO: 59703 - protein, 25 aa, synthetic construct
  source 1..25: note = Seed: VKLQTVHSIPLTINKEEALQRPVAS
VKLQTVHSIPQTIIKFEALQRPVAS

SEQ ID NO: 59704 - protein, 25 aa, synthetic construct
  source 1..25: note = Seed: VKLQTVHSIPLTINKEEALQRPVAS
VKLQTVHSIPQTILKFEALQRPVAS

SEQ ID NO: 59705 - protein, 25 aa, synthetic construct
  source 1..25: note = Seed: VKLQTVHSIPLTINKEEALQRPVAS
VKLQTVHSIPQTIVKFEALQRPVAS

SEQ ID NO: 59706 - protein, 25 aa, synthetic construct
  source 1..25: note = Seed: VKLQTVHSIPLTINKEEALQRPVAS
VKLQTVHSIPRTIFKFEAIQRPVAS

SEQ ID NO: 59707 - protein, 25 aa, synthetic construct
  source 1..25: note = Seed: VKLQTVHSIPLTINKEEALQRPVAS
VKLQTVHSIPRTIFKFEALQRPVAS

SEQ ID NO: 59708 - protein, 25 aa, synthetic construct
  source 1..25: note = Seed: VKLQTVHSIPLTINKEEALQRPVAS
VKLQTVHSIPRTIFKFEAMQRPVAS

SEQ ID NO: 59709 - protein, 25 aa, synthetic construct
  source 1..25: note = Seed: VKLQTVHSIPLTINKEEALQRPVAS
VKLQTVHSIPRTIFKFEAVQRPVAS

SEQ ID NO: 59710 - protein, 25 aa, synthetic construct
  source 1..25: note = Seed: VKLQTVHSIPLTINKEEALQRPVAS
VKLQTVHSIPRTIFKLEALQRPVAS

SEQ ID NO: 59711 - protein, 25 aa, synthetic construct
  source 1..25: note = Seed: VKLQTVHSIPLTINKEEALQRPVAS
VKLQTVHSIPRTIIKFEAIQRPVAS

SEQ ID NO: 59712 - protein, 25 aa, synthetic construct
  source 1..25: note = Seed: VKLQTVHSIPLTINKEEALQRPVAS
VKLQTVHSIPRTIIKFEALQRPVAS

SEQ ID NO: 59713 - protein, 25 aa, synthetic construct
  source 1..25: note = Seed: VKLQTVHSIPLTINKEEALQRPVAS
VKLQTVHSIPRTIIKFEAVQRPVAS

SEQ ID NO: 59714 - protein, 25 aa, synthetic construct
  source 1..25: note = Seed: VKLQTVHSIPLTINKEEALQRPVAS
VKLQTVHSIPRTILKFEAFQRPVAS

SEQ ID NO: 59715 - protein, 25 aa, synthetic construct
  source 1..25: note = Seed: VKLQTVHSIPLTINKEEALQRPVAS
VKLQTVHSIPRTILKFEAIQRPVAS

SEQ ID NO: 59716 - protein, 25 aa, synthetic construct
  source 1..25: note = Seed: VKLQTVHSIPLTINKEEALQRPVAS
VKLQTVHSIPRTILKFEALQRPVAS

SEQ ID NO: 59717 - protein, 25 aa, synthetic construct
  source 1..25: note = Seed: VKLQTVHSIPLTINKEEALQRPVAS
VKLQTVHSIPRTIMKFEALQRPVAS

SEQ ID NO: 59718 - protein, 25 aa, synthetic construct
  source 1..25: note = Seed: VKLQTVHSIPLTINKEEALQRPVAS
VKLQTVHSIPRTIVKFEAIQRPVAS

SEQ ID NO: 59719 - protein, 25 aa, synthetic construct
  source 1..25: note = Seed: VKLQTVHSIPLTINKEEALQRPVAS
VKLQTVHSIPRTIVKFEALQRPVAS

SEQ ID NO: 59720 - protein, 25 aa, synthetic construct
  source 1..25: note = Seed: VKLQTVHSIPLTINKEEALQRPVAS
VKLQTVHSIPRTIWKFEALQRPVAS

SEQ ID NO: 59721 - protein, 25 aa, synthetic construct
  source 1..25: note = Seed: VKLQTVHSIPLTINKEEALQRPVAS
VKLQTVHSIPSTIFKFEAIQRPVAS

SEQ ID NO: 59722 - protein, 25 aa, synthetic construct
  source 1..25: note = Seed: VKLQTVHSIPLTINKEEALQRPVAS
VKLQTVHSIPSTIFKFEALQRPVAS

SEQ ID NO: 59723 - protein, 25 aa, synthetic construct
  source 1..25: note = Seed: VKLQTVHSIPLTINKEEALQRPVAS
VKLQTVHSIPSTIFKFEAVQRPVAS

SEQ ID NO: 59724 - protein, 25 aa, synthetic construct
  source 1..25: note = Seed: VKLQTVHSIPLTINKEEALQRPVAS
VKLQTVHSIPSTILKFEALQRPVAS

SEQ ID NO: 59725 - protein, 25 aa, synthetic construct
  source 1..25: note = Seed: VKLQTVHSIPLTINKEEALQRPVAS
VKLQTVHSIPTTIFKFEAIQRPVAS

SEQ ID NO: 59726 - protein, 25 aa, synthetic construct
  source 1..25: note = Seed: VKLQTVHSIPLTINKEEALQRPVAS
VKLQTVHSIPTTIFKFEALQRPVAS

SEQ ID NO: 59727 - protein, 25 aa, synthetic construct
  source 1..25: note = Seed: VKLQTVHSIPLTINKEEALQRPVAS
VKLQTVHSIPTTIFKFEAVQRPVAS

SEQ ID NO: 59728 - protein, 25 aa, synthetic construct
  source 1..25: note = Seed: VKLQTVHSIPLTINKEEALQRPVAS
VKLQTVHSIPTTIIKFEAIQRPVAS

SEQ ID NO: 59729 - protein, 25 aa, synthetic construct
  source 1..25: note = Seed: VKLQTVHSIPLTINKEEALQRPVAS
VKLQTVHSIPTTIIKFEALQRPVAS

SEQ ID NO: 59730 - protein, 25 aa, synthetic construct
  source 1..25: note = Seed: VKLQTVHSIPLTINKEEALQRPVAS
VKLQTVHSIPTTILKFEALQRPVAS

SEQ ID NO: 59731 - protein, 25 aa, synthetic construct
  source 1..25: note = Seed: VKLQTVHSIPLTINKEEALQRPVAS
VKLQTVHSIPTTIVKFEALQRPVAS

SEQ ID NO: 59732 - protein, 25 aa, synthetic construct
  source 1..25: note = Seed: VKLQTVHSIPLTINKEEALQRPVAS
VKLQTVHSIPVTIAKFEAFQRPVAS

SEQ ID NO: 59733 - protein, 25 aa, synthetic construct
  source 1..25: note = Seed: VKLQTVHSIPLTINKEEALQRPVAS
VKLQTVHSIPVTIAKFEAIQRPVAS

SEQ ID NO: 59734 - protein, 25 aa, synthetic construct
  source 1..25: note = Seed: VKLQTVHSIPLTINKEEALQRPVAS
VKLQTVHSIPVTIAKFEALQRPVAS

SEQ ID NO: 59735 - protein, 25 aa, synthetic construct
  source 1..25: note = Seed: VKLQTVHSIPLTINKEEALQRPVAS
VKLQTVHSIPVTIAKFEAMQRPVAS

SEQ ID NO: 59736 - protein, 25 aa, synthetic construct
  source 1..25: note = Seed: VKLQTVHSIPLTINKEEALQRPVAS
VKLQTVHSIPVTIAKFEAVQRPVAS

SEQ ID NO: 59737 - protein, 25 aa, synthetic construct
  source 1..25: note = Seed: VKLQTVHSIPLTINKEEALQRPVAS
VKLQTVHSIPVTIAKIEAAQRPVAS

SEQ ID NO: 59738 - protein, 25 aa, synthetic construct
  source 1..25: note = Seed: VKLQTVHSIPLTINKEEALQRPVAS
VKLQTVHSIPVTIAKIEAFQRPVAS

SEQ ID NO: 59739 - protein, 25 aa, synthetic construct
  source 1..25: note = Seed: VKLQTVHSIPLTINKEEALQRPVAS
VKLQTVHSIPVTIAKIEAIQRPVAS

SEQ ID NO: 59740 - protein, 25 aa, synthetic construct
  source 1..25: note = Seed: VKLQTVHSIPLTINKEEALQRPVAS
VKLQTVHSIPVTIAKIEALQRPVAS

SEQ ID NO: 59741 - protein, 25 aa, synthetic construct
  source 1..25: note = Seed: VKLQTVHSIPLTINKEEALQRPVAS
VKLQTVHSIPVTIAKIEAMQRPVAS

SEQ ID NO: 59742 - protein, 25 aa, synthetic construct
  source 1..25: note = Seed: VKLQTVHSIPLTINKEEALQRPVAS
VKLQTVHSIPVTIAKIEAVQRPVAS

SEQ ID NO: 59743 - protein, 25 aa, synthetic construct
  source 1..25: note = Seed: VKLQTVHSIPLTINKEEALQRPVAS
VKLQTVHSIPVTIAKNEAVQRPVAS

SEQ ID NO: 59744 - protein, 25 aa, synthetic construct
  source 1..25: note = Seed: VKLQTVHSIPLTINKEEALQRPVAS
VKLQTVHSIPVTICKFEAFQRPVAS

SEQ ID NO: 59745 - protein, 25 aa, synthetic construct
  source 1..25: note = Seed: VKLQTVHSIPLTINKEEALQRPVAS
VKLQTVHSIPVTICKFEAIQRPVAS

SEQ ID NO: 59746 - protein, 25 aa, synthetic construct
  source 1..25: note = Seed: VKLQTVHSIPLTINKEEALQRPVAS
VKLQTVHSIPVTICKFEALQRPVAS

SEQ ID NO: 59747 - protein, 25 aa, synthetic construct
  source 1..25: note = Seed: VKLQTVHSIPLTINKEEALQRPVAS
VKLQTVHSIPVTIEKFEAFQRPVAS

SEQ ID NO: 59748 - protein, 25 aa, synthetic construct
  source 1..25: note = Seed: VKLQTVHSIPLTINKEEALQRPVAS
VKLQTVHSIPVTIEKFEAIQRPVAS

SEQ ID NO: 59749 - protein, 25 aa, synthetic construct
  source 1..25: note = Seed: VKLQTVHSIPLTINKEEALQRPVAS
VKLQTVHSIPVTIEKFEALQRPVAS

SEQ ID NO: 59750 - protein, 25 aa, synthetic construct
  source 1..25: note = Seed: VKLQTVHSIPLTINKEEALQRPVAS
VKLQTVHSIPVTIEKFEAMQRPVAS

SEQ ID NO: 59751 - protein, 25 aa, synthetic construct
  source 1..25: note = Seed: VKLQTVHSIPLTINKEEALQRPVAS
VKLQTVHSIPVTIEKFEAVQRPVAS

SEQ ID NO: 59752 - protein, 25 aa, synthetic construct
  source 1..25: note = Seed: VKLQTVHSIPLTINKEEALQRPVAS
VKLQTVHSIPVTIFKAEAAQRPVAS

SEQ ID NO: 59753 - protein, 25 aa, synthetic construct
  source 1..25: note = Seed: VKLQTVHSIPLTINKEEALQRPVAS
VKLQTVHSIPVTIFKAEAFQRPVAS

SEQ ID NO: 59754 - protein, 25 aa, synthetic construct
  source 1..25: note = Seed: VKLQTVHSIPLTINKEEALQRPVAS
VKLQTVHSIPVTIFKAEAIQRPVAS

SEQ ID NO: 59755 - protein, 25 aa, synthetic construct
  source 1..25: note = Seed: VKLQTVHSIPLTINKEEALQRPVAS
VKLQTVHSIPVTIFKAEALQRPVAS

SEQ ID NO: 59756 - protein, 25 aa, synthetic construct
  source 1..25: note = Seed: VKLQTVHSIPLTINKEEALQRPVAS
VKLQTVHSIPVTIFKAEAMQRPVAS

SEQ ID NO: 59757 - protein, 25 aa, synthetic construct
  source 1..25: note = Seed: VKLQTVHSIPLTINKEEALQRPVAS
VKLQTVHSIPVTIFKAEASQRPVAS

SEQ ID NO: 59758 - protein, 25 aa, synthetic construct
  source 1..25: note = Seed: VKLQTVHSIPLTINKEEALQRPVAS
VKLQTVHSIPVTIFKAEATQRPVAS

SEQ ID NO: 59759 - protein, 25 aa, synthetic construct
  source 1..25: note = Seed: VKLQTVHSIPLTINKEEALQRPVAS
VKLQTVHSIPVTIFKAEAVQRPVAS

SEQ ID NO: 59760 - protein, 25 aa, synthetic construct
  source 1..25: note = Seed: VKLQTVHSIPLTINKEEALQRPVAS
VKLQTVHSIPVTIFKAEAYQRPVAS

SEQ ID NO: 59761 - protein, 25 aa, synthetic construct
  source 1..25: note = Seed: VKLQTVHSIPLTINKEEALQRPVAS
VKLQTVHSIPVTIFKDEAAQRPVAS

SEQ ID NO: 59762 - protein, 25 aa, synthetic construct
  source 1..25: note = Seed: VKLQTVHSIPLTINKEEALQRPVAS
VKLQTVHSIPVTIFKDEAFQRPVAS

SEQ ID NO: 59763 - protein, 25 aa, synthetic construct
  source 1..25: note = Seed: VKLQTVHSIPLTINKEEALQRPVAS
VKLQTVHSIPVTIFKDEAIQRPVAS

SEQ ID NO: 59764 - protein, 25 aa, synthetic construct
  source 1..25: note = Seed: VKLQTVHSIPLTINKEEALQRPVAS
VKLQTVHSIPVTIFKDEALQRPVAS

SEQ ID NO: 59765 - protein, 25 aa, synthetic construct
  source 1..25: note = Seed: VKLQTVHSIPLTINKEEALQRPVAS
VKLQTVHSIPVTIFKDEAMQRPVAS

SEQ ID NO: 59766 - protein, 25 aa, synthetic construct
  source 1..25: note = Seed: VKLQTVHSIPLTINKEEALQRPVAS
VKLQTVHSIPVTIFKDEASQRPVAS

SEQ ID NO: 59767 - protein, 25 aa, synthetic construct
  source 1..25: note = Seed: VKLQTVHSIPLTINKEEALQRPVAS
VKLQTVHSIPVTIFKDEATQRPVAS

SEQ ID NO: 59768 - protein, 25 aa, synthetic construct
  source 1..25: note = Seed: VKLQTVHSIPLTINKEEALQRPVAS
VKLQTVHSIPVTIFKDEAVQRPVAS

SEQ ID NO: 59769 - protein, 25 aa, synthetic construct
  source 1..25: note = Seed: VKLQTVHSIPLTINKEEALQRPVAS
VKLQTVHSIPVTIFKDEAYQRPVAS

SEQ ID NO: 59770 - protein, 25 aa, synthetic construct
  source 1..25: note = Seed: VKLQTVHSIPLTINKEEALQRPVAS
VKLQTVHSIPVTIFKFEAAQRPVAS

SEQ ID NO: 59771 - protein, 25 aa, synthetic construct
  source 1..25: note = Seed: VKLQTVHSIPLTINKEEALQRPVAS
VKLQTVHSIPVTIFKFEAEQRPVAS

SEQ ID NO: 59772 - protein, 25 aa, synthetic construct
  source 1..25: note = Seed: VKLQTVHSIPLTINKEEALQRPVAS
VKLQTVHSIPVTIFKFEAFQRPVAS

SEQ ID NO: 59773 - protein, 25 aa, synthetic construct
  source 1..25: note = Seed: VKLQTVHSIPLTINKEEALQRPVAS
VKLQTVHSIPVTIFKFEAHQRPVAS

SEQ ID NO: 59774 - protein, 25 aa, synthetic construct
  source 1..25: note = Seed: VKLQTVHSIPLTINKEEALQRPVAS
VKLQTVHSIPVTIFKFEAIQRPVAS

SEQ ID NO: 59775 - protein, 25 aa, synthetic construct
  source 1..25: note = Seed: VKLQTVHSIPLTINKEEALQRPVAS
VKLQTVHSIPVTIFKFEALQRPVAS

SEQ ID NO: 59776 - protein, 25 aa, synthetic construct
  source 1..25: note = Seed: VKLQTVHSIPLTINKEEALQRPVAS
VKLQTVHSIPVTIFKFEAMQRPVAS

SEQ ID NO: 59777 - protein, 25 aa, synthetic construct
  source 1..25: note = Seed: VKLQTVHSIPLTINKEEALQRPVAS
VKLQTVHSIPVTIFKFEANQRPVAS

SEQ ID NO: 59778 - protein, 25 aa, synthetic construct
  source 1..25: note = Seed: VKLQTVHSIPLTINKEEALQRPVAS
VKLQTVHSIPVTIFKFEASQRPVAS

SEQ ID NO: 59779 - protein, 25 aa, synthetic construct
  source 1..25: note = Seed: VKLQTVHSIPLTINKEEALQRPVAS
VKLQTVHSIPVTIFKFEATQRPVAS

SEQ ID NO: 59780 - protein, 25 aa, synthetic construct
  source 1..25: note = Seed: VKLQTVHSIPLTINKEEALQRPVAS
VKLQTVHSIPVTIFKFEAVQRPVAS

SEQ ID NO: 59781 - protein, 25 aa, synthetic construct
  source 1..25: note = Seed: VKLQTVHSIPLTINKEEALQRPVAS
VKLQTVHSIPVTIFKFEAWQRPVAS

SEQ ID NO: 59782 - protein, 25 aa, synthetic construct
  source 1..25: note = Seed: VKLQTVHSIPLTINKEEALQRPVAS
VKLQTVHSIPVTIFKFEAYQRPVAS

SEQ ID NO: 59783 - protein, 25 aa, synthetic construct
  source 1..25: note = Seed: VKLQTVHSIPLTINKEEALQRPVAS
VKLQTVHSIPVTIFKHEAFQRPVAS

SEQ ID NO: 59784 - protein, 25 aa, synthetic construct
  source 1..25: note = Seed: VKLQTVHSIPLTINKEEALQRPVAS
VKLQTVHSIPVTIFKHEAIQRPVAS

SEQ ID NO: 59785 - protein, 25 aa, synthetic construct
  source 1..25: note = Seed: VKLQTVHSIPLTINKEEALQRPVAS
VKLQTVHSIPVTIFKHEALQRPVAS

SEQ ID NO: 59786 - protein, 25 aa, synthetic construct
  source 1..25: note = Seed: VKLQTVHSIPLTINKEEALQRPVAS
VKLQTVHSIPVTIFKHEAYQRPVAS

SEQ ID NO: 59787 - protein, 25 aa, synthetic construct
  source 1..25: note = Seed: VKLQTVHSIPLTINKEEALQRPVAS
VKLQTVHSIPVTIFKIEAAQRPVAS

SEQ ID NO: 59788 - protein, 25 aa, synthetic construct
  source 1..25: note = Seed: VKLQTVHSIPLTINKEEALQRPVAS
VKLQTVHSIPVTIFKIEADQRPVAS

SEQ ID NO: 59789 - protein, 25 aa, synthetic construct
  source 1..25: note = Seed: VKLQTVHSIPLTINKEEALQRPVAS
VKLQTVHSIPVTIFKIEAEQRPVAS

SEQ ID NO: 59790 - protein, 25 aa, synthetic construct
  source 1..25: note = Seed: VKLQTVHSIPLTINKEEALQRPVAS
VKLQTVHSIPVTIFKIEAFQRPVAS

SEQ ID NO: 59791 - protein, 25 aa, synthetic construct
  source 1..25: note = Seed: VKLQTVHSIPLTINKEEALQRPVAS
VKLQTVHSIPVTIFKIEAGQRPVAS

SEQ ID NO: 59792 - protein, 25 aa, synthetic construct
  source 1..25: note = Seed: VKLQTVHSIPLTINKEEALQRPVAS
VKLQTVHSIPVTIFKIEAHQRPVAS

SEQ ID NO: 59793 - protein, 25 aa, synthetic construct
  source 1..25: note = Seed: VKLQTVHSIPLTINKEEALQRPVAS
VKLQTVHSIPVTIFKIEAIQRPVAS

SEQ ID NO: 59794 - protein, 25 aa, synthetic construct
  source 1..25: note = Seed: VKLQTVHSIPLTINKEEALQRPVAS
VKLQTVHSIPVTIFKIEALQRPVAS

SEQ ID NO: 59795 - protein, 25 aa, synthetic construct
  source 1..25: note = Seed: VKLQTVHSIPLTINKEEALQRPVAS
VKLQTVHSIPVTIFKIEAMQRPVAS

SEQ ID NO: 59796 - protein, 25 aa, synthetic construct
  source 1..25: note = Seed: VKLQTVHSIPLTINKEEALQRPVAS
VKLQTVHSIPVTIFKIEANQRPVAS

SEQ ID NO: 59797 - protein, 25 aa, synthetic construct
  source 1..25: note = Seed: VKLQTVHSIPLTINKEEALQRPVAS
VKLQTVHSIPVTIFKIEAQQRPVAS

SEQ ID NO: 59798 - protein, 25 aa, synthetic construct
  source 1..25: note = Seed: VKLQTVHSIPLTINKEEALQRPVAS
VKLQTVHSIPVTIFKIEARQRPVAS

SEQ ID NO: 59799 - protein, 25 aa, synthetic construct
  source 1..25: note = Seed: VKLQTVHSIPLTINKEEALQRPVAS
VKLQTVHSIPVTIFKIEASQRPVAS

SEQ ID NO: 59800 - protein, 25 aa, synthetic construct
  source 1..25: note = Seed: VKLQTVHSIPLTINKEEALQRPVAS
VKLQTVHSIPVTIFKIEATQRPVAS

SEQ ID NO: 59801 - protein, 25 aa, synthetic construct
  source 1..25: note = Seed: VKLQTVHSIPLTINKEEALQRPVAS
VKLQTVHSIPVTIFKIEAVQRPVAS

SEQ ID NO: 59802 - protein, 25 aa, synthetic construct
  source 1..25: note = Seed: VKLQTVHSIPLTINKEEALQRPVAS
VKLQTVHSIPVTIFKIEAYQRPVAS

SEQ ID NO: 59803 - protein, 25 aa, synthetic construct
  source 1..25: note = Seed: VKLQTVHSIPLTINKEEALQRPVAS
VKLQTVHSIPVTIFKKEAFQRPVAS

SEQ ID NO: 59804 - protein, 25 aa, synthetic construct
  source 1..25: note = Seed: VKLQTVHSIPLTINKEEALQRPVAS
VKLQTVHSIPVTIFKKEAIQRPVAS

SEQ ID NO: 59805 - protein, 25 aa, synthetic construct
  source 1..25: note = Seed: VKLQTVHSIPLTINKEEALQRPVAS
VKLQTVHSIPVTIFKKEALQRPVAS

SEQ ID NO: 59806 - protein, 25 aa, synthetic construct
  source 1..25: note = Seed: VKLQTVHSIPLTINKEEALQRPVAS
VKLQTVHSIPVTIFKLEAAQRPVAS

SEQ ID NO: 59807 - protein, 25 aa, synthetic construct
  source 1..25: note = Seed: VKLQTVHSIPLTINKEEALQRPVAS
VKLQTVHSIPVTIFKLEAFQRPVAS

SEQ ID NO: 59808 - protein, 25 aa, synthetic construct
  source 1..25: note = Seed: VKLQTVHSIPLTINKEEALQRPVAS
VKLQTVHSIPVTIFKLEAGQRPVAS

SEQ ID NO: 59809 - protein, 25 aa, synthetic construct
  source 1..25: note = Seed: VKLQTVHSIPLTINKEEALQRPVAS
VKLQTVHSIPVTIFKLEAIQRPVAS

SEQ ID NO: 59810 - protein, 25 aa, synthetic construct
  source 1..25: note = Seed: VKLQTVHSIPLTINKEEALQRPVAS
VKLQTVHSIPVTIFKLEALQRPVAS

SEQ ID NO: 59811 - protein, 25 aa, synthetic construct
  source 1..25: note = Seed: VKLQTVHSIPLTINKEEALQRPVAS
VKLQTVHSIPVTIFKLEAMQRPVAS

SEQ ID NO: 59812 - protein, 25 aa, synthetic construct
  source 1..25: note = Seed: VKLQTVHSIPLTINKEEALQRPVAS
VKLQTVHSIPVTIFKLEASQRPVAS

SEQ ID NO: 59813 - protein, 25 aa, synthetic construct
  source 1..25: note = Seed: VKLQTVHSIPLTINKEEALQRPVAS
VKLQTVHSIPVTIFKLEATQRPVAS

SEQ ID NO: 59814 - protein, 25 aa, synthetic construct
  source 1..25: note = Seed: VKLQTVHSIPLTINKEEALQRPVAS
VKLQTVHSIPVTIFKLEAVQRPVAS

SEQ ID NO: 59815 - protein, 25 aa, synthetic construct
  source 1..25: note = Seed: VKLQTVHSIPLTINKEEALQRPVAS
VKLQTVHSIPVTIFKLEAWQRPVAS

SEQ ID NO: 59816 - protein, 25 aa, synthetic construct
  source 1..25: note = Seed: VKLQTVHSIPLTINKEEALQRPVAS
VKLQTVHSIPVTIFKLEAYQRPVAS

SEQ ID NO: 59817 - protein, 25 aa, synthetic construct
  source 1..25: note = Seed: VKLQTVHSIPLTINKEEALQRPVAS
VKLQTVHSIPVTIFKMEAAQRPVAS

SEQ ID NO: 59818 - protein, 25 aa, synthetic construct
  source 1..25: note = Seed: VKLQTVHSIPLTINKEEALQRPVAS
VKLQTVHSIPVTIFKMEAFQRPVAS

SEQ ID NO: 59819 - protein, 25 aa, synthetic construct
  source 1..25: note = Seed: VKLQTVHSIPLTINKEEALQRPVAS
VKLQTVHSIPVTIFKMEAIQRPVAS

SEQ ID NO: 59820 - protein, 25 aa, synthetic construct
  source 1..25: note = Seed: VKLQTVHSIPLTINKEEALQRPVAS
VKLQTVHSIPVTIFKMEALQRPVAS

SEQ ID NO: 59821 - protein, 25 aa, synthetic construct
  source 1..25: note = Seed: VKLQTVHSIPLTINKEEALQRPVAS
VKLQTVHSIPVTIFKMEAMQRPVAS

SEQ ID NO: 59822 - protein, 25 aa, synthetic construct
  source 1..25: note = Seed: VKLQTVHSIPLTINKEEALQRPVAS
VKLQTVHSIPVTIFKMEASQRPVAS

SEQ ID NO: 59823 - protein, 25 aa, synthetic construct
  source 1..25: note = Seed: VKLQTVHSIPLTINKEEALQRPVAS
VKLQTVHSIPVTIFKMEAVQRPVAS

SEQ ID NO: 59824 - protein, 25 aa, synthetic construct
  source 1..25: note = Seed: VKLQTVHSIPLTINKEEALQRPVAS
VKLQTVHSIPVTIFKMEAYQRPVAS

SEQ ID NO: 59825 - protein, 25 aa, synthetic construct
  source 1..25: note = Seed: VKLQTVHSIPLTINKEEALQRPVAS
VKLQTVHSIPVTIFKNEAAQRPVAS

SEQ ID NO: 59826 - protein, 25 aa, synthetic construct
  source 1..25: note = Seed: VKLQTVHSIPLTINKEEALQRPVAS
VKLQTVHSIPVTIFKNEAFQRPVAS

SEQ ID NO: 59827 - protein, 25 aa, synthetic construct
  source 1..25: note = Seed: VKLQTVHSIPLTINKEEALQRPVAS
VKLQTVHSIPVTIFKNEAIQRPVAS

SEQ ID NO: 59828 - protein, 25 aa, synthetic construct
  source 1..25: note = Seed: VKLQTVHSIPLTINKEEALQRPVAS
VKLQTVHSIPVTIFKNEALQRPVAS

SEQ ID NO: 59829 - protein, 25 aa, synthetic construct
  source 1..25: note = Seed: VKLQTVHSIPLTINKEEALQRPVAS
VKLQTVHSIPVTIFKNEAMQRPVAS

SEQ ID NO: 59830 - protein, 25 aa, synthetic construct
  source 1..25: note = Seed: VKLQTVHSIPLTINKEEALQRPVAS
VKLQTVHSIPVTIFKNEAVQRPVAS

SEQ ID NO: 59831 - protein, 25 aa, synthetic construct
  source 1..25: note = Seed: VKLQTVHSIPLTINKEEALQRPVAS
VKLQTVHSIPVTIFKPEAAQRPVAS

SEQ ID NO: 59832 - protein, 25 aa, synthetic construct
  source 1..25: note = Seed: VKLQTVHSIPLTINKEEALQRPVAS
VKLQTVHSIPVTIFKPEAIQRPVAS

SEQ ID NO: 59833 - protein, 25 aa, synthetic construct
  source 1..25: note = Seed: VKLQTVHSIPLTINKEEALQRPVAS
VKLQTVHSIPVTIFKREAFQRPVAS

SEQ ID NO: 59834 - protein, 25 aa, synthetic construct
  source 1..25: note = Seed: VKLQTVHSIPLTINKEEALQRPVAS
VKLQTVHSIPVTIFKREAHQRPVAS

SEQ ID NO: 59835 - protein, 25 aa, synthetic construct
  source 1..25: note = Seed: VKLQTVHSIPLTINKEEALQRPVAS
VKLQTVHSIPVTIFKREAIQRPVAS

SEQ ID NO: 59836 - protein, 25 aa, synthetic construct
  source 1..25: note = Seed: VKLQTVHSIPLTINKEEALQRPVAS
VKLQTVHSIPVTIFKREALQRPVAS

SEQ ID NO: 59837 - protein, 25 aa, synthetic construct
  source 1..25: note = Seed: VKLQTVHSIPLTINKEEALQRPVAS
VKLQTVHSIPVTIFKREAMQRPVAS

SEQ ID NO: 59838 - protein, 25 aa, synthetic construct
  source 1..25: note = Seed: VKLQTVHSIPLTINKEEALQRPVAS
VKLQTVHSIPVTIFKREARQRPVAS

SEQ ID NO: 59839 - protein, 25 aa, synthetic construct
  source 1..25: note = Seed: VKLQTVHSIPLTINKEEALQRPVAS
VKLQTVHSIPVTIFKREAVQRPVAS

SEQ ID NO: 59840 - protein, 25 aa, synthetic construct
  source 1..25: note = Seed: VKLQTVHSIPLTINKEEALQRPVAS
VKLQTVHSIPVTIFKREAYQRPVAS

SEQ ID NO: 59841 - protein, 25 aa, synthetic construct
  source 1..25: note = Seed: VKLQTVHSIPLTINKEEALQRPVAS
VKLQTVHSIPVTIFKSEAAQRPVAS

SEQ ID NO: 59842 - protein, 25 aa, synthetic construct
  source 1..25: note = Seed: VKLQTVHSIPLTINKEEALQRPVAS
VKLQTVHSIPVTIFKSEAIQRPVAS

SEQ ID NO: 59843 - protein, 25 aa, synthetic construct
  source 1..25: note = Seed: VKLQTVHSIPLTINKEEALQRPVAS
VKLQTVHSIPVTIFKSEALQRPVAS

SEQ ID NO: 59844 - protein, 25 aa, synthetic construct
  source 1..25: note = Seed: VKLQTVHSIPLTINKEEALQRPVAS
VKLQTVHSIPVTIFKSEAMQRPVAS

SEQ ID NO: 59845 - protein, 25 aa, synthetic construct
  source 1..25: note = Seed: VKLQTVHSIPLTINKEEALQRPVAS
VKLQTVHSIPVTIFKSEAVQRPVAS

SEQ ID NO: 59846 - protein, 25 aa, synthetic construct
  source 1..25: note = Seed: VKLQTVHSIPLTINKEEALQRPVAS
VKLQTVHSIPVTIFKTEAAQRPVAS

SEQ ID NO: 59847 - protein, 25 aa, synthetic construct
  source 1..25: note = Seed: VKLQTVHSIPLTINKEEALQRPVAS
VKLQTVHSIPVTIFKTEAFQRPVAS

SEQ ID NO: 59848 - protein, 25 aa, synthetic construct
  source 1..25: note = Seed: VKLQTVHSIPLTINKEEALQRPVAS
VKLQTVHSIPVTIFKTEAIQRPVAS

SEQ ID NO: 59849 - protein, 25 aa, synthetic construct
  source 1..25: note = Seed: VKLQTVHSIPLTINKEEALQRPVAS
VKLQTVHSIPVTIFKTEALQRPVAS

SEQ ID NO: 59850 - protein, 25 aa, synthetic construct
  source 1..25: note = Seed: VKLQTVHSIPLTINKEEALQRPVAS
VKLQTVHSIPVTIFKTEAVQRPVAS

SEQ ID NO: 59851 - protein, 25 aa, synthetic construct
  source 1..25: note = Seed: VKLQTVHSIPLTINKEEALQRPVAS
VKLQTVHSIPVTIFKVEAAQRPVAS

SEQ ID NO: 59852 - protein, 25 aa, synthetic construct
  source 1..25: note = Seed: VKLQTVHSIPLTINKEEALQRPVAS
VKLQTVHSIPVTIFKVEAFQRPVAS

SEQ ID NO: 59853 - protein, 25 aa, synthetic construct
  source 1..25: note = Seed: VKLQTVHSIPLTINKEEALQRPVAS
VKLQTVHSIPVTIFKVEAGQRPVAS

SEQ ID NO: 59854 - protein, 25 aa, synthetic construct
  source 1..25: note = Seed: VKLQTVHSIPLTINKEEALQRPVAS
VKLQTVHSIPVTIFKVEAIQRPVAS

SEQ ID NO: 59855 - protein, 25 aa, synthetic construct
  source 1..25: note = Seed: VKLQTVHSIPLTINKEEALQRPVAS
VKLQTVHSIPVTIFKVEALQRPVAS

SEQ ID NO: 59856 - protein, 25 aa, synthetic construct
  source 1..25: note = Seed: VKLQTVHSIPLTINKEEALQRPVAS
VKLQTVHSIPVTIFKVEAMQRPVAS

SEQ ID NO: 59857 - protein, 25 aa, synthetic construct
  source 1..25: note = Seed: VKLQTVHSIPLTINKEEALQRPVAS
VKLQTVHSIPVTIFKVEAQQRPVAS

SEQ ID NO: 59858 - protein, 25 aa, synthetic construct
  source 1..25: note = Seed: VKLQTVHSIPLTINKEEALQRPVAS
VKLQTVHSIPVTIFKVEASQRPVAS

SEQ ID NO: 59859 - protein, 25 aa, synthetic construct
  source 1..25: note = Seed: VKLQTVHSIPLTINKEEALQRPVAS
VKLQTVHSIPVTIFKVEATQRPVAS

SEQ ID NO: 59860 - protein, 25 aa, synthetic construct
  source 1..25: note = Seed: VKLQTVHSIPLTINKEEALQRPVAS
VKLQTVHSIPVTIFKVEAVQRPVAS

SEQ ID NO: 59861 - protein, 25 aa, synthetic construct
  source 1..25: note = Seed: VKLQTVHSIPLTINKEEALQRPVAS
VKLQTVHSIPVTIFKVEAYQRPVAS

SEQ ID NO: 59862 - protein, 25 aa, synthetic construct
  source 1..25: note = Seed: VKLQTVHSIPLTINKEEALQRPVAS
VKLQTVHSIPVTIFKWEAFQRPVAS

SEQ ID NO: 59863 - protein, 25 aa, synthetic construct
  source 1..25: note = Seed: VKLQTVHSIPLTINKEEALQRPVAS
VKLQTVHSIPVTIFKWEAIQRPVAS

SEQ ID NO: 59864 - protein, 25 aa, synthetic construct
  source 1..25: note = Seed: VKLQTVHSIPLTINKEEALQRPVAS
VKLQTVHSIPVTIFKWEALQRPVAS

SEQ ID NO: 59865 - protein, 25 aa, synthetic construct
  source 1..25: note = Seed: VKLQTVHSIPLTINKEEALQRPVAS
VKLQTVHSIPVTIFKWEAMQRPVAS

SEQ ID NO: 59866 - protein, 25 aa, synthetic construct
  source 1..25: note = Seed: VKLQTVHSIPLTINKEEALQRPVAS
VKLQTVHSIPVTIFKWEAVQRPVAS

SEQ ID NO: 59867 - protein, 25 aa, synthetic construct
  source 1..25: note = Seed: VKLQTVHSIPLTINKEEALQRPVAS
VKLQTVHSIPVTIFKWEAYQRPVAS

SEQ ID NO: 59868 - protein, 25 aa, synthetic construct
  source 1..25: note = Seed: VKLQTVHSIPLTINKEEALQRPVAS
VKLQTVHSIPVTIFKYEAFQRPVAS

SEQ ID NO: 59869 - protein, 25 aa, synthetic construct
  source 1..25: note = Seed: VKLQTVHSIPLTINKEEALQRPVAS
VKLQTVHSIPVTIFKYEAIQRPVAS

SEQ ID NO: 59870 - protein, 25 aa, synthetic construct
  source 1..25: note = Seed: VKLQTVHSIPLTINKEEALQRPVAS
VKLQTVHSIPVTIFKYEALQRPVAS

SEQ ID NO: 59871 - protein, 25 aa, synthetic construct
  source 1..25: note = Seed: VKLQTVHSIPLTINKEEALQRPVAS
VKLQTVHSIPVTIFKYEAMQRPVAS

SEQ ID NO: 59872 - protein, 25 aa, synthetic construct
  source 1..25: note = Seed: VKLQTVHSIPLTINKEEALQRPVAS
VKLQTVHSIPVTIFKYEAVQRPVAS

SEQ ID NO: 59873 - protein, 25 aa, synthetic construct
  source 1..25: note = Seed: VKLQTVHSIPLTINKEEALQRPVAS
VKLQTVHSIPVTIFKYEAWQRPVAS

SEQ ID NO: 59874 - protein, 25 aa, synthetic construct
  source 1..25: note = Seed: VKLQTVHSIPLTINKEEALQRPVAS
VKLQTVHSIPVTIFKYEAYQRPVAS

SEQ ID NO: 59875 - protein, 25 aa, synthetic construct
  source 1..25: note = Seed: VKLQTVHSIPLTINKEEALQRPVAS
VKLQTVHSIPVTIHKFEAFQRPVAS

SEQ ID NO: 59876 - protein, 25 aa, synthetic construct
  source 1..25: note = Seed: VKLQTVHSIPLTINKEEALQRPVAS
VKLQTVHSIPVTIHKFEAIQRPVAS

SEQ ID NO: 59877 - protein, 25 aa, synthetic construct
  source 1..25: note = Seed: VKLQTVHSIPLTINKEEALQRPVAS
VKLQTVHSIPVTIHKFEALQRPVAS

SEQ ID NO: 59878 - protein, 25 aa, synthetic construct
  source 1..25: note = Seed: VKLQTVHSIPLTINKEEALQRPVAS
VKLQTVHSIPVTIHKFEAMQRPVAS

SEQ ID NO: 59879 - protein, 25 aa, synthetic construct
  source 1..25: note = Seed: VKLQTVHSIPLTINKEEALQRPVAS
VKLQTVHSIPVTIHKFEAVQRPVAS

SEQ ID NO: 59880 - protein, 25 aa, synthetic construct
  source 1..25: note = Seed: VKLQTVHSIPLTINKEEALQRPVAS
VKLQTVHSIPVTIHKIEAMQRPVAS

SEQ ID NO: 59881 - protein, 25 aa, synthetic construct
  source 1..25: note = Seed: VKLQTVHSIPLTINKEEALQRPVAS
VKLQTVHSIPVTIHKNEAIQRPVAS

SEQ ID NO: 59882 - protein, 25 aa, synthetic construct
  source 1..25: note = Seed: VKLQTVHSIPLTINKEEALQRPVAS
VKLQTVHSIPVTIIKAEAAQRPVAS

SEQ ID NO: 59883 - protein, 25 aa, synthetic construct
  source 1..25: note = Seed: VKLQTVHSIPLTINKEEALQRPVAS
VKLQTVHSIPVTIIKAEAFQRPVAS

SEQ ID NO: 59884 - protein, 25 aa, synthetic construct
  source 1..25: note = Seed: VKLQTVHSIPLTINKEEALQRPVAS
VKLQTVHSIPVTIIKAEAIQRPVAS

SEQ ID NO: 59885 - protein, 25 aa, synthetic construct
  source 1..25: note = Seed: VKLQTVHSIPLTINKEEALQRPVAS
VKLQTVHSIPVTIIKAEALQRPVAS

SEQ ID NO: 59886 - protein, 25 aa, synthetic construct
  source 1..25: note = Seed: VKLQTVHSIPLTINKEEALQRPVAS
VKLQTVHSIPVTIIKAEAMQRPVAS

SEQ ID NO: 59887 - protein, 25 aa, synthetic construct
  source 1..25: note = Seed: VKLQTVHSIPLTINKEEALQRPVAS
VKLQTVHSIPVTIIKAEAVQRPVAS

SEQ ID NO: 59888 - protein, 25 aa, synthetic construct
  source 1..25: note = Seed: VKLQTVHSIPLTINKEEALQRPVAS
VKLQTVHSIPVTIIKAEAYQRPVAS

SEQ ID NO: 59889 - protein, 25 aa, synthetic construct
  source 1..25: note = Seed: VKLQTVHSIPLTINKEEALQRPVAS
VKLQTVHSIPVTIIKDEAAQRPVAS

SEQ ID NO: 59890 - protein, 25 aa, synthetic construct
  source 1..25: note = Seed: VKLQTVHSIPLTINKEEALQRPVAS
VKLQTVHSIPVTIIKDEAIQRPVAS

SEQ ID NO: 59891 - protein, 25 aa, synthetic construct
  source 1..25: note = Seed: VKLQTVHSIPLTINKEEALQRPVAS
VKLQTVHSIPVTIIKDEALQRPVAS

SEQ ID NO: 59892 - protein, 25 aa, synthetic construct
  source 1..25: note = Seed: VKLQTVHSIPLTINKEEALQRPVAS
VKLQTVHSIPVTIIKDEAMQRPVAS

SEQ ID NO: 59893 - protein, 25 aa, synthetic construct
  source 1..25: note = Seed: VKLQTVHSIPLTINKEEALQRPVAS
VKLQTVHSIPVTIIKDEAVQRPVAS

SEQ ID NO: 59894 - protein, 25 aa, synthetic construct
  source 1..25: note = Seed: VKLQTVHSIPLTINKEEALQRPVAS
VKLQTVHSIPVTIIKFEAAQRPVAS

SEQ ID NO: 59895 - protein, 25 aa, synthetic construct
  source 1..25: note = Seed: VKLQTVHSIPLTINKEEALQRPVAS
VKLQTVHSIPVTIIKFEAEQRPVAS

SEQ ID NO: 59896 - protein, 25 aa, synthetic construct
  source 1..25: note = Seed: VKLQTVHSIPLTINKEEALQRPVAS
VKLQTVHSIPVTIIKFEAFQRPVAS

SEQ ID NO: 59897 - protein, 25 aa, synthetic construct
  source 1..25: note = Seed: VKLQTVHSIPLTINKEEALQRPVAS
VKLQTVHSIPVTIIKFEAIQRPVAS

SEQ ID NO: 59898 - protein, 25 aa, synthetic construct
  source 1..25: note = Seed: VKLQTVHSIPLTINKEEALQRPVAS
VKLQTVHSIPVTIIKFEALQRPVAS

SEQ ID NO: 59899 - protein, 25 aa, synthetic construct
  source 1..25: note = Seed: VKLQTVHSIPLTINKEEALQRPVAS
VKLQTVHSIPVTIIKFEAMQRPVAS

SEQ ID NO: 59900 - protein, 25 aa, synthetic construct
  source 1..25: note = Seed: VKLQTVHSIPLTINKEEALQRPVAS
VKLQTVHSIPVTIIKFEANQRPVAS

SEQ ID NO: 59901 - protein, 25 aa, synthetic construct
  source 1..25: note = Seed: VKLQTVHSIPLTINKEEALQRPVAS
VKLQTVHSIPVTIIKFEASQRPVAS

SEQ ID NO: 59902 - protein, 25 aa, synthetic construct
  source 1..25: note = Seed: VKLQTVHSIPLTINKEEALQRPVAS
VKLQTVHSIPVTIIKFEATQRPVAS

SEQ ID NO: 59903 - protein, 25 aa, synthetic construct
  source 1..25: note = Seed: VKLQTVHSIPLTINKEEALQRPVAS
VKLQTVHSIPVTIIKFEAVQRPVAS

SEQ ID NO: 59904 - protein, 25 aa, synthetic construct
  source 1..25: note = Seed: VKLQTVHSIPLTINKEEALQRPVAS
VKLQTVHSIPVTIIKFEAWQRPVAS

SEQ ID NO: 59905 - protein, 25 aa, synthetic construct
  source 1..25: note = Seed: VKLQTVHSIPLTINKEEALQRPVAS
VKLQTVHSIPVTIIKFEAYQRPVAS

SEQ ID NO: 59906 - protein, 25 aa, synthetic construct
  source 1..25: note = Seed: VKLQTVHSIPLTINKEEALQRPVAS
VKLQTVHSIPVTIIKHEAFQRPVAS

SEQ ID NO: 59907 - protein, 25 aa, synthetic construct
  source 1..25: note = Seed: VKLQTVHSIPLTINKEEALQRPVAS
VKLQTVHSIPVTIIKHEAMQRPVAS

SEQ ID NO: 59908 - protein, 25 aa, synthetic construct
  source 1..25: note = Seed: VKLQTVHSIPLTINKEEALQRPVAS
VKLQTVHSIPVTIIKHEARQRPVAS

SEQ ID NO: 59909 - protein, 25 aa, synthetic construct
  source 1..25: note = Seed: VKLQTVHSIPLTINKEEALQRPVAS
VKLQTVHSIPVTIIKIEAAQRPVAS

SEQ ID NO: 59910 - protein, 25 aa, synthetic construct
  source 1..25: note = Seed: VKLQTVHSIPLTINKEEALQRPVAS
VKLQTVHSIPVTIIKIEAFQRPVAS

SEQ ID NO: 59911 - protein, 25 aa, synthetic construct
  source 1..25: note = Seed: VKLQTVHSIPLTINKEEALQRPVAS
VKLQTVHSIPVTIIKIEAIQRPVAS

SEQ ID NO: 59912 - protein, 25 aa, synthetic construct
  source 1..25: note = Seed: VKLQTVHSIPLTINKEEALQRPVAS
VKLQTVHSIPVTIIKIEALQRPVAS

SEQ ID NO: 59913 - protein, 25 aa, synthetic construct
  source 1..25: note = Seed: VKLQTVHSIPLTINKEEALQRPVAS
VKLQTVHSIPVTIIKIEAMQRPVAS

SEQ ID NO: 59914 - protein, 25 aa, synthetic construct
  source 1..25: note = Seed: VKLQTVHSIPLTINKEEALQRPVAS
VKLQTVHSIPVTIIKIEASQRPVAS

SEQ ID NO: 59915 - protein, 25 aa, synthetic construct
  source 1..25: note = Seed: VKLQTVHSIPLTINKEEALQRPVAS
VKLQTVHSIPVTIIKIEAVQRPVAS

SEQ ID NO: 59916 - protein, 25 aa, synthetic construct
  source 1..25: note = Seed: VKLQTVHSIPLTINKEEALQRPVAS
VKLQTVHSIPVTIIKIEAYQRPVAS

SEQ ID NO: 59917 - protein, 25 aa, synthetic construct
  source 1..25: note = Seed: VKLQTVHSIPLTINKEEALQRPVAS
VKLQTVHSIPVTIIKKEAIQRPVAS

SEQ ID NO: 59918 - protein, 25 aa, synthetic construct
  source 1..25: note = Seed: VKLQTVHSIPLTINKEEALQRPVAS
VKLQTVHSIPVTIIKKEALQRPVAS

SEQ ID NO: 59919 - protein, 25 aa, synthetic construct
  source 1..25: note = Seed: VKLQTVHSIPLTINKEEALQRPVAS
VKLQTVHSIPVTIIKLEAAQRPVAS

SEQ ID NO: 59920 - protein, 25 aa, synthetic construct
  source 1..25: note = Seed: VKLQTVHSIPLTINKEEALQRPVAS
VKLQTVHSIPVTIIKLEAFQRPVAS

SEQ ID NO: 59921 - protein, 25 aa, synthetic construct
  source 1..25: note = Seed: VKLQTVHSIPLTINKEEALQRPVAS
VKLQTVHSIPVTIIKLEAIQRPVAS

SEQ ID NO: 59922 - protein, 25 aa, synthetic construct
  source 1..25: note = Seed: VKLQTVHSIPLTINKEEALQRPVAS
VKLQTVHSIPVTIIKLEALQRPVAS

SEQ ID NO: 59923 - protein, 25 aa, synthetic construct
  source 1..25: note = Seed: VKLQTVHSIPLTINKEEALQRPVAS
VKLQTVHSIPVTIIKLEAMQRPVAS

SEQ ID NO: 59924 - protein, 25 aa, synthetic construct
  source 1..25: note = Seed: VKLQTVHSIPLTINKEEALQRPVAS
VKLQTVHSIPVTIIKLEAVQRPVAS

SEQ ID NO: 59925 - protein, 25 aa, synthetic construct
  source 1..25: note = Seed: VKLQTVHSIPLTINKEEALQRPVAS
VKLQTVHSIPVTIIKLEAYQRPVAS

SEQ ID NO: 59926 - protein, 25 aa, synthetic construct
  source 1..25: note = Seed: VKLQTVHSIPLTINKEEALQRPVAS
VKLQTVHSIPVTIIKMEAAQRPVAS

SEQ ID NO: 59927 - protein, 25 aa, synthetic construct
  source 1..25: note = Seed: VKLQTVHSIPLTINKEEALQRPVAS
VKLQTVHSIPVTIIKMEAFQRPVAS

SEQ ID NO: 59928 - protein, 25 aa, synthetic construct
  source 1..25: note = Seed: VKLQTVHSIPLTINKEEALQRPVAS
VKLQTVHSIPVTIIKMEAIQRPVAS

SEQ ID NO: 59929 - protein, 25 aa, synthetic construct
  source 1..25: note = Seed: VKLQTVHSIPLTINKEEALQRPVAS
VKLQTVHSIPVTIIKMEALQRPVAS

SEQ ID NO: 59930 - protein, 25 aa, synthetic construct
  source 1..25: note = Seed: VKLQTVHSIPLTINKEEALQRPVAS
VKLQTVHSIPVTIIKMEAMQRPVAS

SEQ ID NO: 59931 - protein, 25 aa, synthetic construct
  source 1..25: note = Seed: VKLQTVHSIPLTINKEEALQRPVAS
VKLQTVHSIPVTIIKMEAVQRPVAS

SEQ ID NO: 59932 - protein, 25 aa, synthetic construct
  source 1..25: note = Seed: VKLQTVHSIPLTINKEEALQRPVAS
VKLQTVHSIPVTIIKNEAIQRPVAS

SEQ ID NO: 59933 - protein, 25 aa, synthetic construct
  source 1..25: note = Seed: VKLQTVHSIPLTINKEEALQRPVAS
VKLQTVHSIPVTIIKNEAVQRPVAS

SEQ ID NO: 59934 - protein, 25 aa, synthetic construct
  source 1..25: note = Seed: VKLQTVHSIPLTINKEEALQRPVAS
VKLQTVHSIPVTIIKREAFQRPVAS

SEQ ID NO: 59935 - protein, 25 aa, synthetic construct
  source 1..25: note = Seed: VKLQTVHSIPLTINKEEALQRPVAS
VKLQTVHSIPVTIIKREAIQRPVAS

SEQ ID NO: 59936 - protein, 25 aa, synthetic construct
  source 1..25: note = Seed: VKLQTVHSIPLTINKEEALQRPVAS
VKLQTVHSIPVTIIKREALQRPVAS

SEQ ID NO: 59937 - protein, 25 aa, synthetic construct
  source 1..25: note = Seed: VKLQTVHSIPLTINKEEALQRPVAS
VKLQTVHSIPVTIIKREAMQRPVAS

SEQ ID NO: 59938 - protein, 25 aa, synthetic construct
  source 1..25: note = Seed: VKLQTVHSIPLTINKEEALQRPVAS
VKLQTVHSIPVTIIKREARQRPVAS

SEQ ID NO: 59939 - protein, 25 aa, synthetic construct
  source 1..25: note = Seed: VKLQTVHSIPLTINKEEALQRPVAS
VKLQTVHSIPVTIIKREAVQRPVAS

SEQ ID NO: 59940 - protein, 25 aa, synthetic construct
  source 1..25: note = Seed: VKLQTVHSIPLTINKEEALQRPVAS
VKLQTVHSIPVTIIKREAYQRPVAS

SEQ ID NO: 59941 - protein, 25 aa, synthetic construct
  source 1..25: note = Seed: VKLQTVHSIPLTINKEEALQRPVAS
VKLQTVHSIPVTIIKSEAIQRPVAS

SEQ ID NO: 59942 - protein, 25 aa, synthetic construct
  source 1..25: note = Seed: VKLQTVHSIPLTINKEEALQRPVAS
VKLQTVHSIPVTIIKVEAAQRPVAS

SEQ ID NO: 59943 - protein, 25 aa, synthetic construct
  source 1..25: note = Seed: VKLQTVHSIPLTINKEEALQRPVAS
VKLQTVHSIPVTIIKVEAFQRPVAS

SEQ ID NO: 59944 - protein, 25 aa, synthetic construct
  source 1..25: note = Seed: VKLQTVHSIPLTINKEEALQRPVAS
VKLQTVHSIPVTIIKVEAIQRPVAS

SEQ ID NO: 59945 - protein, 25 aa, synthetic construct
  source 1..25: note = Seed: VKLQTVHSIPLTINKEEALQRPVAS
VKLQTVHSIPVTIIKVEALQRPVAS

SEQ ID NO: 59946 - protein, 25 aa, synthetic construct
  source 1..25: note = Seed: VKLQTVHSIPLTINKEEALQRPVAS
VKLQTVHSIPVTIIKVEAMQRPVAS

SEQ ID NO: 59947 - protein, 25 aa, synthetic construct
  source 1..25: note = Seed: VKLQTVHSIPLTINKEEALQRPVAS
VKLQTVHSIPVTIIKVEAVQRPVAS

SEQ ID NO: 59948 - protein, 25 aa, synthetic construct
  source 1..25: note = Seed: VKLQTVHSIPLTINKEEALQRPVAS
VKLQTVHSIPVTIIKVEAYQRPVAS

SEQ ID NO: 59949 - protein, 25 aa, synthetic construct
  source 1..25: note = Seed: VKLQTVHSIPLTINKEEALQRPVAS
VKLQTVHSIPVTIIKWEAIQRPVAS

SEQ ID NO: 59950 - protein, 25 aa, synthetic construct
  source 1..25: note = Seed: VKLQTVHSIPLTINKEEALQRPVAS
VKLQTVHSIPVTIIKWEALQRPVAS

SEQ ID NO: 59951 - protein, 25 aa, synthetic construct
  source 1..25: note = Seed: VKLQTVHSIPLTINKEEALQRPVAS
VKLQTVHSIPVTIIKWEAVQRPVAS

SEQ ID NO: 59952 - protein, 25 aa, synthetic construct
  source 1..25: note = Seed: VKLQTVHSIPLTINKEEALQRPVAS
VKLQTVHSIPVTIIKYEAFQRPVAS

SEQ ID NO: 59953 - protein, 25 aa, synthetic construct
  source 1..25: note = Seed: VKLQTVHSIPLTINKEEALQRPVAS
VKLQTVHSIPVTIIKYEAIQRPVAS

SEQ ID NO: 59954 - protein, 25 aa, synthetic construct
  source 1..25: note = Seed: VKLQTVHSIPLTINKEEALQRPVAS
VKLQTVHSIPVTIIKYEALQRPVAS

SEQ ID NO: 59955 - protein, 25 aa, synthetic construct
  source 1..25: note = Seed: VKLQTVHSIPLTINKEEALQRPVAS
VKLQTVHSIPVTIIKYEAMQRPVAS

SEQ ID NO: 59956 - protein, 25 aa, synthetic construct
  source 1..25: note = Seed: VKLQTVHSIPLTINKEEALQRPVAS
VKLQTVHSIPVTIIKYEAVQRPVAS

SEQ ID NO: 59957 - protein, 25 aa, synthetic construct
  source 1..25: note = Seed: VKLQTVHSIPLTINKEEALQRPVAS
VKLQTVHSIPVTIKKFEAIQRPVAS

SEQ ID NO: 59958 - protein, 25 aa, synthetic construct
  source 1..25: note = Seed: VKLQTVHSIPLTINKEEALQRPVAS
VKLQTVHSIPVTIKKFEALQRPVAS

SEQ ID NO: 59959 - protein, 25 aa, synthetic construct
  source 1..25: note = Seed: VKLQTVHSIPLTINKEEALQRPVAS
VKLQTVHSIPVTIKKFEAVQRPVAS

SEQ ID NO: 59960 - protein, 25 aa, synthetic construct
  source 1..25: note = Seed: VKLQTVHSIPLTINKEEALQRPVAS
VKLQTVHSIPVTIKKVEAFQRPVAS

SEQ ID NO: 59961 - protein, 25 aa, synthetic construct
  source 1..25: note = Seed: VKLQTVHSIPLTINKEEALQRPVAS
VKLQTVHSIPVTILKAEAAQRPVAS

SEQ ID NO: 59962 - protein, 25 aa, synthetic construct
  source 1..25: note = Seed: VKLQTVHSIPLTINKEEALQRPVAS
VKLQTVHSIPVTILKAEAFQRPVAS

SEQ ID NO: 59963 - protein, 25 aa, synthetic construct
  source 1..25: note = Seed: VKLQTVHSIPLTINKEEALQRPVAS
VKLQTVHSIPVTILKAEAIQRPVAS

SEQ ID NO: 59964 - protein, 25 aa, synthetic construct
  source 1..25: note = Seed: VKLQTVHSIPLTINKEEALQRPVAS
VKLQTVHSIPVTILKAEALQRPVAS

SEQ ID NO: 59965 - protein, 25 aa, synthetic construct
  source 1..25: note = Seed: VKLQTVHSIPLTINKEEALQRPVAS
VKLQTVHSIPVTILKAEAMQRPVAS

SEQ ID NO: 59966 - protein, 25 aa, synthetic construct
  source 1..25: note = Seed: VKLQTVHSIPLTINKEEALQRPVAS
VKLQTVHSIPVTILKAEAVQRPVAS

SEQ ID NO: 59967 - protein, 25 aa, synthetic construct
  source 1..25: note = Seed: VKLQTVHSIPLTINKEEALQRPVAS
VKLQTVHSIPVTILKDEAIQRPVAS

SEQ ID NO: 59968 - protein, 25 aa, synthetic construct
  source 1..25: note = Seed: VKLQTVHSIPLTINKEEALQRPVAS
VKLQTVHSIPVTILKDEAVQRPVAS

SEQ ID NO: 59969 - protein, 25 aa, synthetic construct
  source 1..25: note = Seed: VKLQTVHSIPLTINKEEALQRPVAS
VKLQTVHSIPVTILKFEAAQRPVAS

SEQ ID NO: 59970 - protein, 25 aa, synthetic construct
  source 1..25: note = Seed: VKLQTVHSIPLTINKEEALQRPVAS
VKLQTVHSIPVTILKFEAEQRPVAS

SEQ ID NO: 59971 - protein, 25 aa, synthetic construct
  source 1..25: note = Seed: VKLQTVHSIPLTINKEEALQRPVAS
VKLQTVHSIPVTILKFEAFQRPVAS

SEQ ID NO: 59972 - protein, 25 aa, synthetic construct
  source 1..25: note = Seed: VKLQTVHSIPLTINKEEALQRPVAS
VKLQTVHSIPVTILKFEAIQRPVAS

SEQ ID NO: 59973 - protein, 25 aa, synthetic construct
  source 1..25: note = Seed: VKLQTVHSIPLTINKEEALQRPVAS
VKLQTVHSIPVTILKFEALQRPVAS

SEQ ID NO: 59974 - protein, 25 aa, synthetic construct
  source 1..25: note = Seed: VKLQTVHSIPLTINKEEALQRPVAS
VKLQTVHSIPVTILKFEAMQRPVAS

SEQ ID NO: 59975 - protein, 25 aa, synthetic construct
  source 1..25: note = Seed: VKLQTVHSIPLTINKEEALQRPVAS
VKLQTVHSIPVTILKFEANQRPVAS

SEQ ID NO: 59976 - protein, 25 aa, synthetic construct
  source 1..25: note = Seed: VKLQTVHSIPLTINKEEALQRPVAS
VKLQTVHSIPVTILKFEASQRPVAS

SEQ ID NO: 59977 - protein, 25 aa, synthetic construct
  source 1..25: note = Seed: VKLQTVHSIPLTINKEEALQRPVAS
VKLQTVHSIPVTILKFEATQRPVAS

SEQ ID NO: 59978 - protein, 25 aa, synthetic construct
  source 1..25: note = Seed: VKLQTVHSIPLTINKEEALQRPVAS
VKLQTVHSIPVTILKFEAVQRPVAS

SEQ ID NO: 59979 - protein, 25 aa, synthetic construct
  source 1..25: note = Seed: VKLQTVHSIPLTINKEEALQRPVAS
VKLQTVHSIPVTILKFEAWQRPVAS

SEQ ID NO: 59980 - protein, 25 aa, synthetic construct
  source 1..25: note = Seed: VKLQTVHSIPLTINKEEALQRPVAS
VKLQTVHSIPVTILKFEAYQRPVAS

SEQ ID NO: 59981 - protein, 25 aa, synthetic construct
  source 1..25: note = Seed: VKLQTVHSIPLTINKEEALQRPVAS
VKLQTVHSIPVTILKIEAAQRPVAS

SEQ ID NO: 59982 - protein, 25 aa, synthetic construct
  source 1..25: note = Seed: VKLQTVHSIPLTINKEEALQRPVAS
VKLQTVHSIPVTILKIEAFQRPVAS

SEQ ID NO: 59983 - protein, 25 aa, synthetic construct
  source 1..25: note = Seed: VKLQTVHSIPLTINKEEALQRPVAS
VKLQTVHSIPVTILKIEAIQRPVAS

SEQ ID NO: 59984 - protein, 25 aa, synthetic construct
  source 1..25: note = Seed: VKLQTVHSIPLTINKEEALQRPVAS
VKLQTVHSIPVTILKIEALQRPVAS

SEQ ID NO: 59985 - protein, 25 aa, synthetic construct
  source 1..25: note = Seed: VKLQTVHSIPLTINKEEALQRPVAS
VKLQTVHSIPVTILKIEAMQRPVAS

SEQ ID NO: 59986 - protein, 25 aa, synthetic construct
  source 1..25: note = Seed: VKLQTVHSIPLTINKEEALQRPVAS
VKLQTVHSIPVTILKIEASQRPVAS

SEQ ID NO: 59987 - protein, 25 aa, synthetic construct
  source 1..25: note = Seed: VKLQTVHSIPLTINKEEALQRPVAS
VKLQTVHSIPVTILKIEAVQRPVAS

SEQ ID NO: 59988 - protein, 25 aa, synthetic construct
  source 1..25: note = Seed: VKLQTVHSIPLTINKEEALQRPVAS
VKLQTVHSIPVTILKIEAYQRPVAS

SEQ ID NO: 59989 - protein, 25 aa, synthetic construct
  source 1..25: note = Seed: VKLQTVHSIPLTINKEEALQRPVAS
VKLQTVHSIPVTILKLEAAQRPVAS

SEQ ID NO: 59990 - protein, 25 aa, synthetic construct
  source 1..25: note = Seed: VKLQTVHSIPLTINKEEALQRPVAS
VKLQTVHSIPVTILKLEAFQRPVAS

SEQ ID NO: 59991 - protein, 25 aa, synthetic construct
  source 1..25: note = Seed: VKLQTVHSIPLTINKEEALQRPVAS
VKLQTVHSIPVTILKLEAIQRPVAS

SEQ ID NO: 59992 - protein, 25 aa, synthetic construct
  source 1..25: note = Seed: VKLQTVHSIPLTINKEEALQRPVAS
VKLQTVHSIPVTILKLEALQRPVAS

SEQ ID NO: 59993 - protein, 25 aa, synthetic construct
  source 1..25: note = Seed: VKLQTVHSIPLTINKEEALQRPVAS
VKLQTVHSIPVTILKLEAMQRPVAS

SEQ ID NO: 59994 - protein, 25 aa, synthetic construct
  source 1..25: note = Seed: VKLQTVHSIPLTINKEEALQRPVAS
VKLQTVHSIPVTILKLEAVQRPVAS

SEQ ID NO: 59995 - protein, 25 aa, synthetic construct
  source 1..25: note = Seed: VKLQTVHSIPLTINKEEALQRPVAS
VKLQTVHSIPVTILKLEAYQRPVAS

SEQ ID NO: 59996 - protein, 25 aa, synthetic construct
  source 1..25: note = Seed: VKLQTVHSIPLTINKEEALQRPVAS
VKLQTVHSIPVTILKMEAAQRPVAS

SEQ ID NO: 59997 - protein, 25 aa, synthetic construct
  source 1..25: note = Seed: VKLQTVHSIPLTINKEEALQRPVAS
VKLQTVHSIPVTILKMEAFQRPVAS

SEQ ID NO: 59998 - protein, 25 aa, synthetic construct
  source 1..25: note = Seed: VKLQTVHSIPLTINKEEALQRPVAS
VKLQTVHSIPVTILKMEAIQRPVAS

SEQ ID NO: 59999 - protein, 25 aa, synthetic construct
  source 1..25: note = Seed: VKLQTVHSIPLTINKEEALQRPVAS
VKLQTVHSIPVTILKMEALQRPVAS

SEQ ID NO: 60000 - protein, 25 aa, synthetic construct
  source 1..25: note = Seed: VKLQTVHSIPLTINKEEALQRPVAS
VKLQTVHSIPVTILKMEAMQRPVAS

SEQ ID NO: 60001 - protein, 25 aa, synthetic construct
  source 1..25: note = Seed: VKLQTVHSIPLTINKEEALQRPVAS
VKLQTVHSIPVTILKMEAVQRPVAS

SEQ ID NO: 60002 - protein, 25 aa, synthetic construct
  source 1..25: note = Seed: VKLQTVHSIPLTINKEEALQRPVAS
VKLQTVHSIPVTILKREAFQRPVAS

SEQ ID NO: 60003 - protein, 25 aa, synthetic construct
  source 1..25: note = Seed: VKLQTVHSIPLTINKEEALQRPVAS
VKLQTVHSIPVTILKREAIQRPVAS

SEQ ID NO: 60004 - protein, 25 aa, synthetic construct
  source 1..25: note = Seed: VKLQTVHSIPLTINKEEALQRPVAS
VKLQTVHSIPVTILKREALQRPVAS

SEQ ID NO: 60005 - protein, 25 aa, synthetic construct
  source 1..25: note = Seed: VKLQTVHSIPLTINKEEALQRPVAS
VKLQTVHSIPVTILKSEAIQRPVAS

SEQ ID NO: 60006 - protein, 25 aa, synthetic construct
  source 1..25: note = Seed: VKLQTVHSIPLTINKEEALQRPVAS
VKLQTVHSIPVTILKSEAVQRPVAS

SEQ ID NO: 60007 - protein, 25 aa, synthetic construct
  source 1..25: note = Seed: VKLQTVHSIPLTINKEEALQRPVAS
VKLQTVHSIPVTILKVEAAQRPVAS

SEQ ID NO: 60008 - protein, 25 aa, synthetic construct
  source 1..25: note = Seed: VKLQTVHSIPLTINKEEALQRPVAS
VKLQTVHSIPVTILKVEAFQRPVAS

SEQ ID NO: 60009 - protein, 25 aa, synthetic construct
  source 1..25: note = Seed: VKLQTVHSIPLTINKEEALQRPVAS
VKLQTVHSIPVTILKVEAIQRPVAS

SEQ ID NO: 60010 - protein, 25 aa, synthetic construct
  source 1..25: note = Seed: VKLQTVHSIPLTINKEEALQRPVAS
VKLQTVHSIPVTILKVEALQRPVAS

SEQ ID NO: 60011 - protein, 25 aa, synthetic construct
  source 1..25: note = Seed: VKLQTVHSIPLTINKEEALQRPVAS
VKLQTVHSIPVTILKVEAMQRPVAS

SEQ ID NO: 60012 - protein, 25 aa, synthetic construct
  source 1..25: note = Seed: VKLQTVHSIPLTINKEEALQRPVAS
VKLQTVHSIPVTILKVEAVQRPVAS

SEQ ID NO: 60013 - protein, 25 aa, synthetic construct
  source 1..25: note = Seed: VKLQTVHSIPLTINKEEALQRPVAS
VKLQTVHSIPVTILKVEAYQRPVAS

SEQ ID NO: 60014 - protein, 25 aa, synthetic construct
  source 1..25: note = Seed: VKLQTVHSIPLTINKEEALQRPVAS
VKLQTVHSIPVTILKWEAFQRPVAS

SEQ ID NO: 60015 - protein, 25 aa, synthetic construct
  source 1..25: note = Seed: VKLQTVHSIPLTINKEEALQRPVAS
VKLQTVHSIPVTILKWEAIQRPVAS

SEQ ID NO: 60016 - protein, 25 aa, synthetic construct
  source 1..25: note = Seed: VKLQTVHSIPLTINKEEALQRPVAS
VKLQTVHSIPVTILKWEALQRPVAS

SEQ ID NO: 60017 - protein, 25 aa, synthetic construct
  source 1..25: note = Seed: VKLQTVHSIPLTINKEEALQRPVAS
VKLQTVHSIPVTILKYEAFQRPVAS

SEQ ID NO: 60018 - protein, 25 aa, synthetic construct
  source 1..25: note = Seed: VKLQTVHSIPLTINKEEALQRPVAS
VKLQTVHSIPVTILKYEAIQRPVAS

SEQ ID NO: 60019 - protein, 25 aa, synthetic construct
  source 1..25: note = Seed: VKLQTVHSIPLTINKEEALQRPVAS
VKLQTVHSIPVTILKYEALQRPVAS

SEQ ID NO: 60020 - protein, 25 aa, synthetic construct
  source 1..25: note = Seed: VKLQTVHSIPLTINKEEALQRPVAS
VKLQTVHSIPVTILKYEAMQRPVAS

SEQ ID NO: 60021 - protein, 25 aa, synthetic construct
  source 1..25: note = Seed: VKLQTVHSIPLTINKEEALQRPVAS
VKLQTVHSIPVTILKYEAVQRPVAS

SEQ ID NO: 60022 - protein, 25 aa, synthetic construct
  source 1..25: note = Seed: VKLQTVHSIPLTINKEEALQRPVAS
VKLQTVHSIPVTILKYEAYQRPVAS

SEQ ID NO: 60023 - protein, 25 aa, synthetic construct
  source 1..25: note = Seed: VKLQTVHSIPLTINKEEALQRPVAS
VKLQTVHSIPVTIMKAEAAQRPVAS

SEQ ID NO: 60024 - protein, 25 aa, synthetic construct
  source 1..25: note = Seed: VKLQTVHSIPLTINKEEALQRPVAS
VKLQTVHSIPVTIMKAEAFQRPVAS

SEQ ID NO: 60025 - protein, 25 aa, synthetic construct
  source 1..25: note = Seed: VKLQTVHSIPLTINKEEALQRPVAS
VKLQTVHSIPVTIMKAEAIQRPVAS

SEQ ID NO: 60026 - protein, 25 aa, synthetic construct
  source 1..25: note = Seed: VKLQTVHSIPLTINKEEALQRPVAS
VKLQTVHSIPVTIMKAEALQRPVAS

SEQ ID NO: 60027 - protein, 25 aa, synthetic construct
  source 1..25: note = Seed: VKLQTVHSIPLTINKEEALQRPVAS
VKLQTVHSIPVTIMKAEAMQRPVAS

SEQ ID NO: 60028 - protein, 25 aa, synthetic construct
  source 1..25: note = Seed: VKLQTVHSIPLTINKEEALQRPVAS
VKLQTVHSIPVTIMKAEAVQRPVAS

SEQ ID NO: 60029 - protein, 25 aa, synthetic construct
  source 1..25: note = Seed: VKLQTVHSIPLTINKEEALQRPVAS
VKLQTVHSIPVTIMKAEAYQRPVAS

SEQ ID NO: 60030 - protein, 25 aa, synthetic construct
  source 1..25: note = Seed: VKLQTVHSIPLTINKEEALQRPVAS
VKLQTVHSIPVTIMKDEAIQRPVAS

SEQ ID NO: 60031 - protein, 25 aa, synthetic construct
  source 1..25: note = Seed: VKLQTVHSIPLTINKEEALQRPVAS
VKLQTVHSIPVTIMKDEALQRPVAS

SEQ ID NO: 60032 - protein, 25 aa, synthetic construct
  source 1..25: note = Seed: VKLQTVHSIPLTINKEEALQRPVAS
VKLQTVHSIPVTIMKDEAVQRPVAS

SEQ ID NO: 60033 - protein, 25 aa, synthetic construct
  source 1..25: note = Seed: VKLQTVHSIPLTINKEEALQRPVAS
VKLQTVHSIPVTIMKFEAFQRPVAS

SEQ ID NO: 60034 - protein, 25 aa, synthetic construct
  source 1..25: note = Seed: VKLQTVHSIPLTINKEEALQRPVAS
VKLQTVHSIPVTIMKFEAIQRPVAS

SEQ ID NO: 60035 - protein, 25 aa, synthetic construct
  source 1..25: note = Seed: VKLQTVHSIPLTINKEEALQRPVAS
VKLQTVHSIPVTIMKFEALQRPVAS

SEQ ID NO: 60036 - protein, 25 aa, synthetic construct
  source 1..25: note = Seed: VKLQTVHSIPLTINKEEALQRPVAS
VKLQTVHSIPVTIMKFEAMQRPVAS

SEQ ID NO: 60037 - protein, 25 aa, synthetic construct
  source 1..25: note = Seed: VKLQTVHSIPLTINKEEALQRPVAS
VKLQTVHSIPVTIMKFEAVQRPVAS

SEQ ID NO: 60038 - protein, 25 aa, synthetic construct
  source 1..25: note = Seed: VKLQTVHSIPLTINKEEALQRPVAS
VKLQTVHSIPVTIMKFEAYQRPVAS

SEQ ID NO: 60039 - protein, 25 aa, synthetic construct
  source 1..25: note = Seed: VKLQTVHSIPLTINKEEALQRPVAS
VKLQTVHSIPVTIMKHEALQRPVAS

SEQ ID NO: 60040 - protein, 25 aa, synthetic construct
  source 1..25: note = Seed: VKLQTVHSIPLTINKEEALQRPVAS
VKLQTVHSIPVTIMKIEAAQRPVAS

SEQ ID NO: 60041 - protein, 25 aa, synthetic construct
  source 1..25: note = Seed: VKLQTVHSIPLTINKEEALQRPVAS
VKLQTVHSIPVTIMKIEAFQRPVAS

SEQ ID NO: 60042 - protein, 25 aa, synthetic construct
  source 1..25: note = Seed: VKLQTVHSIPLTINKEEALQRPVAS
VKLQTVHSIPVTIMKIEAIQRPVAS

SEQ ID NO: 60043 - protein, 25 aa, synthetic construct
  source 1..25: note = Seed: VKLQTVHSIPLTINKEEALQRPVAS
VKLQTVHSIPVTIMKIEALQRPVAS

SEQ ID NO: 60044 - protein, 25 aa, synthetic construct
  source 1..25: note = Seed: VKLQTVHSIPLTINKEEALQRPVAS
VKLQTVHSIPVTIMKIEAMQRPVAS

SEQ ID NO: 60045 - protein, 25 aa, synthetic construct
  source 1..25: note = Seed: VKLQTVHSIPLTINKEEALQRPVAS
VKLQTVHSIPVTIMKIEASQRPVAS

SEQ ID NO: 60046 - protein, 25 aa, synthetic construct
  source 1..25: note = Seed: VKLQTVHSIPLTINKEEALQRPVAS
VKLQTVHSIPVTIMKIEAVQRPVAS

SEQ ID NO: 60047 - protein, 25 aa, synthetic construct
  source 1..25: note = Seed: VKLQTVHSIPLTINKEEALQRPVAS
VKLQTVHSIPVTIMKIEAYQRPVAS

SEQ ID NO: 60048 - protein, 25 aa, synthetic construct
  source 1..25: note = Seed: VKLQTVHSIPLTINKEEALQRPVAS
VKLQTVHSIPVTIMKLEAAQRPVAS

SEQ ID NO: 60049 - protein, 25 aa, synthetic construct
  source 1..25: note = Seed: VKLQTVHSIPLTINKEEALQRPVAS
VKLQTVHSIPVTIMKLEAFQRPVAS

SEQ ID NO: 60050 - protein, 25 aa, synthetic construct
  source 1..25: note = Seed: VKLQTVHSIPLTINKEEALQRPVAS
VKLQTVHSIPVTIMKLEAIQRPVAS

SEQ ID NO: 60051 - protein, 25 aa, synthetic construct
  source 1..25: note = Seed: VKLQTVHSIPLTINKEEALQRPVAS
VKLQTVHSIPVTIMKLEALQRPVAS

SEQ ID NO: 60052 - protein, 25 aa, synthetic construct
  source 1..25: note = Seed: VKLQTVHSIPLTINKEEALQRPVAS
VKLQTVHSIPVTIMKLEAMQRPVAS

SEQ ID NO: 60053 - protein, 25 aa, synthetic construct
  source 1..25: note = Seed: VKLQTVHSIPLTINKEEALQRPVAS
VKLQTVHSIPVTIMKLEAVQRPVAS

SEQ ID NO: 60054 - protein, 25 aa, synthetic construct
  source 1..25: note = Seed: VKLQTVHSIPLTINKEEALQRPVAS
VKLQTVHSIPVTIMKMEAAQRPVAS

SEQ ID NO: 60055 - protein, 25 aa, synthetic construct
  source 1..25: note = Seed: VKLQTVHSIPLTINKEEALQRPVAS
VKLQTVHSIPVTIMKMEAIQRPVAS

SEQ ID NO: 60056 - protein, 25 aa, synthetic construct
  source 1..25: note = Seed: VKLQTVHSIPLTINKEEALQRPVAS
VKLQTVHSIPVTIMKMEALQRPVAS

SEQ ID NO: 60057 - protein, 25 aa, synthetic construct
  source 1..25: note = Seed: VKLQTVHSIPLTINKEEALQRPVAS
VKLQTVHSIPVTIMKMEAMQRPVAS

SEQ ID NO: 60058 - protein, 25 aa, synthetic construct
  source 1..25: note = Seed: VKLQTVHSIPLTINKEEALQRPVAS
VKLQTVHSIPVTIMKMEAVQRPVAS

SEQ ID NO: 60059 - protein, 25 aa, synthetic construct
  source 1..25: note = Seed: VKLQTVHSIPLTINKEEALQRPVAS
VKLQTVHSIPVTIMKNEAIQRPVAS

SEQ ID NO: 60060 - protein, 25 aa, synthetic construct
  source 1..25: note = Seed: VKLQTVHSIPLTINKEEALQRPVAS
VKLQTVHSIPVTIMKNEALQRPVAS

SEQ ID NO: 60061 - protein, 25 aa, synthetic construct
  source 1..25: note = Seed: VKLQTVHSIPLTINKEEALQRPVAS
VKLQTVHSIPVTIMKNEAVQRPVAS

SEQ ID NO: 60062 - protein, 25 aa, synthetic construct
  source 1..25: note = Seed: VKLQTVHSIPLTINKEEALQRPVAS
VKLQTVHSIPVTIMKREAIQRPVAS

SEQ ID NO: 60063 - protein, 25 aa, synthetic construct
  source 1..25: note = Seed: VKLQTVHSIPLTINKEEALQRPVAS
VKLQTVHSIPVTIMKREALQRPVAS

SEQ ID NO: 60064 - protein, 25 aa, synthetic construct
  source 1..25: note = Seed: VKLQTVHSIPLTINKEEALQRPVAS
VKLQTVHSIPVTIMKSEAIQRPVAS

SEQ ID NO: 60065 - protein, 25 aa, synthetic construct
  source 1..25: note = Seed: VKLQTVHSIPLTINKEEALQRPVAS
VKLQTVHSIPVTIMKSEAVQRPVAS

SEQ ID NO: 60066 - protein, 25 aa, synthetic construct
  source 1..25: note = Seed: VKLQTVHSIPLTINKEEALQRPVAS
VKLQTVHSIPVTIMKTEAIQRPVAS

SEQ ID NO: 60067 - protein, 25 aa, synthetic construct
  source 1..25: note = Seed: VKLQTVHSIPLTINKEEALQRPVAS
VKLQTVHSIPVTIMKVEAAQRPVAS

SEQ ID NO: 60068 - protein, 25 aa, synthetic construct
  source 1..25: note = Seed: VKLQTVHSIPLTINKEEALQRPVAS
VKLQTVHSIPVTIMKVEAFQRPVAS

SEQ ID NO: 60069 - protein, 25 aa, synthetic construct
  source 1..25: note = Seed: VKLQTVHSIPLTINKEEALQRPVAS
VKLQTVHSIPVTIMKVEAIQRPVAS

SEQ ID NO: 60070 - protein, 25 aa, synthetic construct
  source 1..25: note = Seed: VKLQTVHSIPLTINKEEALQRPVAS
VKLQTVHSIPVTIMKVEALQRPVAS

SEQ ID NO: 60071 - protein, 25 aa, synthetic construct
  source 1..25: note = Seed: VKLQTVHSIPLTINKEEALQRPVAS
VKLQTVHSIPVTIMKVEAMQRPVAS

SEQ ID NO: 60072 - protein, 25 aa, synthetic construct
  source 1..25: note = Seed: VKLQTVHSIPLTINKEEALQRPVAS
VKLQTVHSIPVTIMKVEAVQRPVAS

SEQ ID NO: 60073 - protein, 25 aa, synthetic construct
  source 1..25: note = Seed: VKLQTVHSIPLTINKEEALQRPVAS
VKLQTVHSIPVTIMKVEAYQRPVAS

SEQ ID NO: 60074 - protein, 25 aa, synthetic construct
  source 1..25: note = Seed: VKLQTVHSIPLTINKEEALQRPVAS
VKLQTVHSIPVTIMKWEAFQRPVAS

SEQ ID NO: 60075 - protein, 25 aa, synthetic construct
  source 1..25: note = Seed: VKLQTVHSIPLTINKEEALQRPVAS
VKLQTVHSIPVTIMKYEAFQRPVAS

SEQ ID NO: 60076 - protein, 25 aa, synthetic construct
  source 1..25: note = Seed: VKLQTVHSIPLTINKEEALQRPVAS
VKLQTVHSIPVTIMKYEAIQRPVAS

SEQ ID NO: 60077 - protein, 25 aa, synthetic construct
  source 1..25: note = Seed: VKLQTVHSIPLTINKEEALQRPVAS
VKLQTVHSIPVTIMKYEALQRPVAS

SEQ ID NO: 60078 - protein, 25 aa, synthetic construct
  source 1..25: note = Seed: VKLQTVHSIPLTINKEEALQRPVAS
VKLQTVHSIPVTINKAEAAQRPVAS

SEQ ID NO: 60079 - protein, 25 aa, synthetic construct
  source 1..25: note = Seed: VKLQTVHSIPLTINKEEALQRPVAS
VKLQTVHSIPVTINKAEAFQRPVAS

SEQ ID NO: 60080 - protein, 25 aa, synthetic construct
  source 1..25: note = Seed: VKLQTVHSIPLTINKEEALQRPVAS
VKLQTVHSIPVTINKAEAIQRPVAS

SEQ ID NO: 60081 - protein, 25 aa, synthetic construct
  source 1..25: note = Seed: VKLQTVHSIPLTINKEEALQRPVAS
VKLQTVHSIPVTINKAEALQRPVAS

SEQ ID NO: 60082 - protein, 25 aa, synthetic construct
  source 1..25: note = Seed: VKLQTVHSIPLTINKEEALQRPVAS
VKLQTVHSIPVTINKAEAMQRPVAS

SEQ ID NO: 60083 - protein, 25 aa, synthetic construct
  source 1..25: note = Seed: VKLQTVHSIPLTINKEEALQRPVAS
VKLQTVHSIPVTINKAEAVQRPVAS

SEQ ID NO: 60084 - protein, 25 aa, synthetic construct
  source 1..25: note = Seed: VKLQTVHSIPLTINKEEALQRPVAS
VKLQTVHSIPVTINKAEAWQRPVAS

SEQ ID NO: 60085 - protein, 25 aa, synthetic construct
  source 1..25: note = Seed: VKLQTVHSIPLTINKEEALQRPVAS
VKLQTVHSIPVTINKAEAYQRPVAS

SEQ ID NO: 60086 - protein, 25 aa, synthetic construct
  source 1..25: note = Seed: VKLQTVHSIPLTINKEEALQRPVAS
VKLQTVHSIPVTINKFEAFQRPVAS

SEQ ID NO: 60087 - protein, 25 aa, synthetic construct
  source 1..25: note = Seed: VKLQTVHSIPLTINKEEALQRPVAS
VKLQTVHSIPVTINKFEAIQRPVAS

SEQ ID NO: 60088 - protein, 25 aa, synthetic construct
  source 1..25: note = Seed: VKLQTVHSIPLTINKEEALQRPVAS
VKLQTVHSIPVTINKFEALQRPVAS

SEQ ID NO: 60089 - protein, 25 aa, synthetic construct
  source 1..25: note = Seed: VKLQTVHSIPLTINKEEALQRPVAS
VKLQTVHSIPVTINKFEAVQRPVAS

SEQ ID NO: 60090 - protein, 25 aa, synthetic construct
  source 1..25: note = Seed: VKLQTVHSIPLTINKEEALQRPVAS
VKLQTVHSIPVTINKGEAFQRPVAS

SEQ ID NO: 60091 - protein, 25 aa, synthetic construct
  source 1..25: note = Seed: VKLQTVHSIPLTINKEEALQRPVAS
VKLQTVHSIPVTINKGEAIQRPVAS

SEQ ID NO: 60092 - protein, 25 aa, synthetic construct
  source 1..25: note = Seed: VKLQTVHSIPLTINKEEALQRPVAS
VKLQTVHSIPVTINKGEALQRPVAS

SEQ ID NO: 60093 - protein, 25 aa, synthetic construct
  source 1..25: note = Seed: VKLQTVHSIPLTINKEEALQRPVAS
VKLQTVHSIPVTINKGEAMQRPVAS

SEQ ID NO: 60094 - protein, 25 aa, synthetic construct
  source 1..25: note = Seed: VKLQTVHSIPLTINKEEALQRPVAS
VKLQTVHSIPVTINKGEAVQRPVAS

SEQ ID NO: 60095 - protein, 25 aa, synthetic construct
  source 1..25: note = Seed: VKLQTVHSIPLTINKEEALQRPVAS
VKLQTVHSIPVTINKGEAYQRPVAS

SEQ ID NO: 60096 - protein, 25 aa, synthetic construct
  source 1..25: note = Seed: VKLQTVHSIPLTINKEEALQRPVAS
VKLQTVHSIPVTINKHEAIQRPVAS

SEQ ID NO: 60097 - protein, 25 aa, synthetic construct
  source 1..25: note = Seed: VKLQTVHSIPLTINKEEALQRPVAS
VKLQTVHSIPVTINKHEAVQRPVAS

SEQ ID NO: 60098 - protein, 25 aa, synthetic construct
  source 1..25: note = Seed: VKLQTVHSIPLTINKEEALQRPVAS
VKLQTVHSIPVTINKIEAFQRPVAS

SEQ ID NO: 60099 - protein, 25 aa, synthetic construct
  source 1..25: note = Seed: VKLQTVHSIPLTINKEEALQRPVAS
VKLQTVHSIPVTINKIEAIQRPVAS

SEQ ID NO: 60100 - protein, 25 aa, synthetic construct
  source 1..25: note = Seed: VKLQTVHSIPLTINKEEALQRPVAS
VKLQTVHSIPVTINKIEALQRPVAS

SEQ ID NO: 60101 - protein, 25 aa, synthetic construct
  source 1..25: note = Seed: VKLQTVHSIPLTINKEEALQRPVAS
VKLQTVHSIPVTINKIEAMQRPVAS

SEQ ID NO: 60102 - protein, 25 aa, synthetic construct
  source 1..25: note = Seed: VKLQTVHSIPLTINKEEALQRPVAS
VKLQTVHSIPVTINKIEAVQRPVAS

SEQ ID NO: 60103 - protein, 25 aa, synthetic construct
  source 1..25: note = Seed: VKLQTVHSIPLTINKEEALQRPVAS
VKLQTVHSIPVTINKIEAYQRPVAS

SEQ ID NO: 60104 - protein, 25 aa, synthetic construct
  source 1..25: note = Seed: VKLQTVHSIPLTINKEEALQRPVAS
VKLQTVHSIPVTINKLEAIQRPVAS

SEQ ID NO: 60105 - protein, 25 aa, synthetic construct
  source 1..25: note = Seed: VKLQTVHSIPLTINKEEALQRPVAS
VKLQTVHSIPVTINKLEALQRPVAS

SEQ ID NO: 60106 - protein, 25 aa, synthetic construct
  source 1..25: note = Seed: VKLQTVHSIPLTINKEEALQRPVAS
VKLQTVHSIPVTINKLEAVQRPVAS

SEQ ID NO: 60107 - protein, 25 aa, synthetic construct
  source 1..25: note = Seed: VKLQTVHSIPLTINKEEALQRPVAS
VKLQTVHSIPVTINKMEAIQRPVAS

SEQ ID NO: 60108 - protein, 25 aa, synthetic construct
  source 1..25: note = Seed: VKLQTVHSIPLTINKEEALQRPVAS
VKLQTVHSIPVTINKMEALQRPVAS

SEQ ID NO: 60109 - protein, 25 aa, synthetic construct
  source 1..25: note = Seed: VKLQTVHSIPLTINKEEALQRPVAS
VKLQTVHSIPVTINKMEAVQRPVAS

SEQ ID NO: 60110 - protein, 25 aa, synthetic construct
  source 1..25: note = Seed: VKLQTVHSIPLTINKEEALQRPVAS
VKLQTVHSIPVTINKNEAAQRPVAS

SEQ ID NO: 60111 - protein, 25 aa, synthetic construct
  source 1..25: note = Seed: VKLQTVHSIPLTINKEEALQRPVAS
VKLQTVHSIPVTINKNEAFQRPVAS

SEQ ID NO: 60112 - protein, 25 aa, synthetic construct
  source 1..25: note = Seed: VKLQTVHSIPLTINKEEALQRPVAS
VKLQTVHSIPVTINKNEAIQRPVAS

SEQ ID NO: 60113 - protein, 25 aa, synthetic construct
  source 1..25: note = Seed: VKLQTVHSIPLTINKEEALQRPVAS
VKLQTVHSIPVTINKNEALQRPVAS

SEQ ID NO: 60114 - protein, 25 aa, synthetic construct
  source 1..25: note = Seed: VKLQTVHSIPLTINKEEALQRPVAS
VKLQTVHSIPVTINKNEAMQRPVAS

SEQ ID NO: 60115 - protein, 25 aa, synthetic construct
  source 1..25: note = Seed: VKLQTVHSIPLTINKEEALQRPVAS
VKLQTVHSIPVTINKNEAVQRPVAS

SEQ ID NO: 60116 - protein, 25 aa, synthetic construct
  source 1..25: note = Seed: VKLQTVHSIPLTINKEEALQRPVAS
VKLQTVHSIPVTINKNEAWQRPVAS

SEQ ID NO: 60117 - protein, 25 aa, synthetic construct
  source 1..25: note = Seed: VKLQTVHSIPLTINKEEALQRPVAS
VKLQTVHSIPVTINKNEAYQRPVAS

SEQ ID NO: 60118 - protein, 25 aa, synthetic construct
  source 1..25: note = Seed: VKLQTVHSIPLTINKEEALQRPVAS
VKLQTVHSIPVTINKPEAFQRPVAS

SEQ ID NO: 60119 - protein, 25 aa, synthetic construct
  source 1..25: note = Seed: VKLQTVHSIPLTINKEEALQRPVAS
VKLQTVHSIPVTINKPEAIQRPVAS

SEQ ID NO: 60120 - protein, 25 aa, synthetic construct
  source 1..25: note = Seed: VKLQTVHSIPLTINKEEALQRPVAS
VKLQTVHSIPVTINKPEALQRPVAS

SEQ ID NO: 60121 - protein, 25 aa, synthetic construct
  source 1..25: note = Seed: VKLQTVHSIPLTINKEEALQRPVAS
VKLQTVHSIPVTINKPEAVQRPVAS

SEQ ID NO: 60122 - protein, 25 aa, synthetic construct
  source 1..25: note = Seed: VKLQTVHSIPLTINKEEALQRPVAS
VKLQTVHSIPVTINKSEAAQRPVAS

SEQ ID NO: 60123 - protein, 25 aa, synthetic construct
  source 1..25: note = Seed: VKLQTVHSIPLTINKEEALQRPVAS
VKLQTVHSIPVTINKSEAFQRPVAS

SEQ ID NO: 60124 - protein, 25 aa, synthetic construct
  source 1..25: note = Seed: VKLQTVHSIPLTINKEEALQRPVAS
VKLQTVHSIPVTINKSEAIQRPVAS

SEQ ID NO: 60125 - protein, 25 aa, synthetic construct
  source 1..25: note = Seed: VKLQTVHSIPLTINKEEALQRPVAS
VKLQTVHSIPVTINKSEALQRPVAS

SEQ ID NO: 60126 - protein, 25 aa, synthetic construct
  source 1..25: note = Seed: VKLQTVHSIPLTINKEEALQRPVAS
VKLQTVHSIPVTINKSEAMQRPVAS

SEQ ID NO: 60127 - protein, 25 aa, synthetic construct
  source 1..25: note = Seed: VKLQTVHSIPLTINKEEALQRPVAS
VKLQTVHSIPVTINKSEAVQRPVAS

SEQ ID NO: 60128 - protein, 25 aa, synthetic construct
  source 1..25: note = Seed: VKLQTVHSIPLTINKEEALQRPVAS
VKLQTVHSIPVTINKSEAYQRPVAS

SEQ ID NO: 60129 - protein, 25 aa, synthetic construct
  source 1..25: note = Seed: VKLQTVHSIPLTINKEEALQRPVAS
VKLQTVHSIPVTINKTEAFQRPVAS

SEQ ID NO: 60130 - protein, 25 aa, synthetic construct
  source 1..25: note = Seed: VKLQTVHSIPLTINKEEALQRPVAS
VKLQTVHSIPVTINKTEAIQRPVAS

SEQ ID NO: 60131 - protein, 25 aa, synthetic construct
  source 1..25: note = Seed: VKLQTVHSIPLTINKEEALQRPVAS
VKLQTVHSIPVTINKTEALQRPVAS

SEQ ID NO: 60132 - protein, 25 aa, synthetic construct
  source 1..25: note = Seed: VKLQTVHSIPLTINKEEALQRPVAS
VKLQTVHSIPVTINKTEAMQRPVAS

SEQ ID NO: 60133 - protein, 25 aa, synthetic construct
  source 1..25: note = Seed: VKLQTVHSIPLTINKEEALQRPVAS
VKLQTVHSIPVTINKTEAVQRPVAS

SEQ ID NO: 60134 - protein, 25 aa, synthetic construct
  source 1..25: note = Seed: VKLQTVHSIPLTINKEEALQRPVAS
VKLQTVHSIPVTINKTEAYQRPVAS

SEQ ID NO: 60135 - protein, 25 aa, synthetic construct
  source 1..25: note = Seed: VKLQTVHSIPLTINKEEALQRPVAS
VKLQTVHSIPVTINKVEAFQRPVAS

SEQ ID NO: 60136 - protein, 25 aa, synthetic construct
  source 1..25: note = Seed: VKLQTVHSIPLTINKEEALQRPVAS
VKLQTVHSIPVTINKVEAIQRPVAS

SEQ ID NO: 60137 - protein, 25 aa, synthetic construct
  source 1..25: note = Seed: VKLQTVHSIPLTINKEEALQRPVAS
VKLQTVHSIPVTINKVEALQRPVAS

SEQ ID NO: 60138 - protein, 25 aa, synthetic construct
  source 1..25: note = Seed: VKLQTVHSIPLTINKEEALQRPVAS
VKLQTVHSIPVTINKVEAMQRPVAS

SEQ ID NO: 60139 - protein, 25 aa, synthetic construct
  source 1..25: note = Seed: VKLQTVHSIPLTINKEEALQRPVAS
VKLQTVHSIPVTINKVEAVQRPVAS

SEQ ID NO: 60140 - protein, 25 aa, synthetic construct
  source 1..25: note = Seed: VKLQTVHSIPLTINKEEALQRPVAS
VKLQTVHSIPVTINKVEAYQRPVAS

SEQ ID NO: 60141 - protein, 25 aa, synthetic construct
  source 1..25: note = Seed: VKLQTVHSIPLTINKEEALQRPVAS
VKLQTVHSIPVTIQKFEAFQRPVAS

SEQ ID NO: 60142 - protein, 25 aa, synthetic construct
  source 1..25: note = Seed: VKLQTVHSIPLTINKEEALQRPVAS
VKLQTVHSIPVTIQKFEAIQRPVAS

SEQ ID NO: 60143 - protein, 25 aa, synthetic construct
  source 1..25: note = Seed: VKLQTVHSIPLTINKEEALQRPVAS
VKLQTVHSIPVTIQKFEALQRPVAS

SEQ ID NO: 60144 - protein, 25 aa, synthetic construct
  source 1..25: note = Seed: VKLQTVHSIPLTINKEEALQRPVAS
VKLQTVHSIPVTIQKFEAMQRPVAS

SEQ ID NO: 60145 - protein, 25 aa, synthetic construct
  source 1..25: note = Seed: VKLQTVHSIPLTINKEEALQRPVAS
VKLQTVHSIPVTIQKFEAVQRPVAS

SEQ ID NO: 60146 - protein, 25 aa, synthetic construct
  source 1..25: note = Seed: VKLQTVHSIPLTINKEEALQRPVAS
VKLQTVHSIPVTIRKREAFQRPVAS

SEQ ID NO: 60147 - protein, 25 aa, synthetic construct
  source 1..25: note = Seed: VKLQTVHSIPLTINKEEALQRPVAS
VKLQTVHSIPVTISKAEAIQRPVAS

SEQ ID NO: 60148 - protein, 25 aa, synthetic construct
  source 1..25: note = Seed: VKLQTVHSIPLTINKEEALQRPVAS
VKLQTVHSIPVTISKFEAAQRPVAS

SEQ ID NO: 60149 - protein, 25 aa, synthetic construct
  source 1..25: note = Seed: VKLQTVHSIPLTINKEEALQRPVAS
VKLQTVHSIPVTISKFEAFQRPVAS

SEQ ID NO: 60150 - protein, 25 aa, synthetic construct
  source 1..25: note = Seed: VKLQTVHSIPLTINKEEALQRPVAS
VKLQTVHSIPVTISKFEAIQRPVAS

SEQ ID NO: 60151 - protein, 25 aa, synthetic construct
  source 1..25: note = Seed: VKLQTVHSIPLTINKEEALQRPVAS
VKLQTVHSIPVTISKFEALQRPVAS

SEQ ID NO: 60152 - protein, 25 aa, synthetic construct
  source 1..25: note = Seed: VKLQTVHSIPLTINKEEALQRPVAS
VKLQTVHSIPVTISKFEAMQRPVAS

SEQ ID NO: 60153 - protein, 25 aa, synthetic construct
  source 1..25: note = Seed: VKLQTVHSIPLTINKEEALQRPVAS
VKLQTVHSIPVTISKFEAVQRPVAS

SEQ ID NO: 60154 - protein, 25 aa, synthetic construct
  source 1..25: note = Seed: VKLQTVHSIPLTINKEEALQRPVAS
VKLQTVHSIPVTISKIEAIQRPVAS

SEQ ID NO: 60155 - protein, 25 aa, synthetic construct
  source 1..25: note = Seed: VKLQTVHSIPLTINKEEALQRPVAS
VKLQTVHSIPVTISKIEALQRPVAS

SEQ ID NO: 60156 - protein, 25 aa, synthetic construct
  source 1..25: note = Seed: VKLQTVHSIPLTINKEEALQRPVAS
VKLQTVHSIPVTISKNEAIQRPVAS

SEQ ID NO: 60157 - protein, 25 aa, synthetic construct
  source 1..25: note = Seed: VKLQTVHSIPLTINKEEALQRPVAS
VKLQTVHSIPVTISKNEALQRPVAS

SEQ ID NO: 60158 - protein, 25 aa, synthetic construct
  source 1..25: note = Seed: VKLQTVHSIPLTINKEEALQRPVAS
VKLQTVHSIPVTISKNEAVQRPVAS

SEQ ID NO: 60159 - protein, 25 aa, synthetic construct
  source 1..25: note = Seed: VKLQTVHSIPLTINKEEALQRPVAS
VKLQTVHSIPVTISKSEAIQRPVAS

SEQ ID NO: 60160 - protein, 25 aa, synthetic construct
  source 1..25: note = Seed: VKLQTVHSIPLTINKEEALQRPVAS
VKLQTVHSIPVTITKFEAAQRPVAS

SEQ ID NO: 60161 - protein, 25 aa, synthetic construct
  source 1..25: note = Seed: VKLQTVHSIPLTINKEEALQRPVAS
VKLQTVHSIPVTITKFEAFQRPVAS

SEQ ID NO: 60162 - protein, 25 aa, synthetic construct
  source 1..25: note = Seed: VKLQTVHSIPLTINKEEALQRPVAS
VKLQTVHSIPVTITKFEAIQRPVAS

SEQ ID NO: 60163 - protein, 25 aa, synthetic construct
  source 1..25: note = Seed: VKLQTVHSIPLTINKEEALQRPVAS
VKLQTVHSIPVTITKFEALQRPVAS

SEQ ID NO: 60164 - protein, 25 aa, synthetic construct
  source 1..25: note = Seed: VKLQTVHSIPLTINKEEALQRPVAS
VKLQTVHSIPVTITKFEAMQRPVAS

SEQ ID NO: 60165 - protein, 25 aa, synthetic construct
  source 1..25: note = Seed: VKLQTVHSIPLTINKEEALQRPVAS
VKLQTVHSIPVTITKFEATQRPVAS

SEQ ID NO: 60166 - protein, 25 aa, synthetic construct
  source 1..25: note = Seed: VKLQTVHSIPLTINKEEALQRPVAS
VKLQTVHSIPVTITKFEAVQRPVAS

SEQ ID NO: 60167 - protein, 25 aa, synthetic construct
  source 1..25: note = Seed: VKLQTVHSIPLTINKEEALQRPVAS
VKLQTVHSIPVTITKFEAYQRPVAS

SEQ ID NO: 60168 - protein, 25 aa, synthetic construct
  source 1..25: note = Seed: VKLQTVHSIPLTINKEEALQRPVAS
VKLQTVHSIPVTITKYEALQRPVAS

SEQ ID NO: 60169 - protein, 25 aa, synthetic construct
  source 1..25: note = Seed: VKLQTVHSIPLTINKEEALQRPVAS
VKLQTVHSIPVTIVKAEAAQRPVAS

SEQ ID NO: 60170 - protein, 25 aa, synthetic construct
  source 1..25: note = Seed: VKLQTVHSIPLTINKEEALQRPVAS
VKLQTVHSIPVTIVKAEAFQRPVAS

SEQ ID NO: 60171 - protein, 25 aa, synthetic construct
  source 1..25: note = Seed: VKLQTVHSIPLTINKEEALQRPVAS
VKLQTVHSIPVTIVKAEAIQRPVAS

SEQ ID NO: 60172 - protein, 25 aa, synthetic construct
  source 1..25: note = Seed: VKLQTVHSIPLTINKEEALQRPVAS
VKLQTVHSIPVTIVKAEALQRPVAS

SEQ ID NO: 60173 - protein, 25 aa, synthetic construct
  source 1..25: note = Seed: VKLQTVHSIPLTINKEEALQRPVAS
VKLQTVHSIPVTIVKAEAVQRPVAS

SEQ ID NO: 60174 - protein, 25 aa, synthetic construct
  source 1..25: note = Seed: VKLQTVHSIPLTINKEEALQRPVAS
VKLQTVHSIPVTIVKDEAIQRPVAS

SEQ ID NO: 60175 - protein, 25 aa, synthetic construct
  source 1..25: note = Seed: VKLQTVHSIPLTINKEEALQRPVAS
VKLQTVHSIPVTIVKDEALQRPVAS

SEQ ID NO: 60176 - protein, 25 aa, synthetic construct
  source 1..25: note = Seed: VKLQTVHSIPLTINKEEALQRPVAS
VKLQTVHSIPVTIVKDEAVQRPVAS

SEQ ID NO: 60177 - protein, 25 aa, synthetic construct
  source 1..25: note = Seed: VKLQTVHSIPLTINKEEALQRPVAS
VKLQTVHSIPVTIVKFEAAQRPVAS

SEQ ID NO: 60178 - protein, 25 aa, synthetic construct
  source 1..25: note = Seed: VKLQTVHSIPLTINKEEALQRPVAS
VKLQTVHSIPVTIVKFEAEQRPVAS

SEQ ID NO: 60179 - protein, 25 aa, synthetic construct
  source 1..25: note = Seed: VKLQTVHSIPLTINKEEALQRPVAS
VKLQTVHSIPVTIVKFEAFQRPVAS

SEQ ID NO: 60180 - protein, 25 aa, synthetic construct
  source 1..25: note = Seed: VKLQTVHSIPLTINKEEALQRPVAS
VKLQTVHSIPVTIVKFEAIQRPVAS

SEQ ID NO: 60181 - protein, 25 aa, synthetic construct
  source 1..25: note = Seed: VKLQTVHSIPLTINKEEALQRPVAS
VKLQTVHSIPVTIVKFEALQRPVAS

SEQ ID NO: 60182 - protein, 25 aa, synthetic construct
  source 1..25: note = Seed: VKLQTVHSIPLTINKEEALQRPVAS
VKLQTVHSIPVTIVKFEAMQRPVAS

SEQ ID NO: 60183 - protein, 25 aa, synthetic construct
  source 1..25: note = Seed: VKLQTVHSIPLTINKEEALQRPVAS
VKLQTVHSIPVTIVKFEANQRPVAS

SEQ ID NO: 60184 - protein, 25 aa, synthetic construct
  source 1..25: note = Seed: VKLQTVHSIPLTINKEEALQRPVAS
VKLQTVHSIPVTIVKFEASQRPVAS

SEQ ID NO: 60185 - protein, 25 aa, synthetic construct
  source 1..25: note = Seed: VKLQTVHSIPLTINKEEALQRPVAS
VKLQTVHSIPVTIVKFEATQRPVAS

SEQ ID NO: 60186 - protein, 25 aa, synthetic construct
  source 1..25: note = Seed: VKLQTVHSIPLTINKEEALQRPVAS
VKLQTVHSIPVTIVKFEAVQRPVAS

SEQ ID NO: 60187 - protein, 25 aa, synthetic construct
  source 1..25: note = Seed: VKLQTVHSIPLTINKEEALQRPVAS
VKLQTVHSIPVTIVKFEAYQRPVAS

SEQ ID NO: 60188 - protein, 25 aa, synthetic construct
  source 1..25: note = Seed: VKLQTVHSIPLTINKEEALQRPVAS
VKLQTVHSIPVTIVKIEAAQRPVAS

SEQ ID NO: 60189 - protein, 25 aa, synthetic construct
  source 1..25: note = Seed: VKLQTVHSIPLTINKEEALQRPVAS
VKLQTVHSIPVTIVKIEAFQRPVAS

SEQ ID NO: 60190 - protein, 25 aa, synthetic construct
  source 1..25: note = Seed: VKLQTVHSIPLTINKEEALQRPVAS
VKLQTVHSIPVTIVKIEAIQRPVAS

SEQ ID NO: 60191 - protein, 25 aa, synthetic construct
  source 1..25: note = Seed: VKLQTVHSIPLTINKEEALQRPVAS
VKLQTVHSIPVTIVKIEALQRPVAS

SEQ ID NO: 60192 - protein, 25 aa, synthetic construct
  source 1..25: note = Seed: VKLQTVHSIPLTINKEEALQRPVAS
VKLQTVHSIPVTIVKIEAMQRPVAS

SEQ ID NO: 60193 - protein, 25 aa, synthetic construct
  source 1..25: note = Seed: VKLQTVHSIPLTINKEEALQRPVAS
VKLQTVHSIPVTIVKIEAVQRPVAS

SEQ ID NO: 60194 - protein, 25 aa, synthetic construct
  source 1..25: note = Seed: VKLQTVHSIPLTINKEEALQRPVAS
VKLQTVHSIPVTIVKIEAYQRPVAS

SEQ ID NO: 60195 - protein, 25 aa, synthetic construct
  source 1..25: note = Seed: VKLQTVHSIPLTINKEEALQRPVAS
VKLQTVHSIPVTIVKLEAFQRPVAS

SEQ ID NO: 60196 - protein, 25 aa, synthetic construct
  source 1..25: note = Seed: VKLQTVHSIPLTINKEEALQRPVAS
VKLQTVHSIPVTIVKLEALQRPVAS

SEQ ID NO: 60197 - protein, 25 aa, synthetic construct
  source 1..25: note = Seed: VKLQTVHSIPLTINKEEALQRPVAS
VKLQTVHSIPVTIVKMEAIQRPVAS

SEQ ID NO: 60198 - protein, 25 aa, synthetic construct
  source 1..25: note = Seed: VKLQTVHSIPLTINKEEALQRPVAS
VKLQTVHSIPVTIVKREALQRPVAS

SEQ ID NO: 60199 - protein, 25 aa, synthetic construct
  source 1..25: note = Seed: VKLQTVHSIPLTINKEEALQRPVAS
VKLQTVHSIPVTIVKVEAAQRPVAS

SEQ ID NO: 60200 - protein, 25 aa, synthetic construct
  source 1..25: note = Seed: VKLQTVHSIPLTINKEEALQRPVAS
VKLQTVHSIPVTIVKVEAIQRPVAS

SEQ ID NO: 60201 - protein, 25 aa, synthetic construct
  source 1..25: note = Seed: VKLQTVHSIPLTINKEEALQRPVAS
VKLQTVHSIPVTIVKVEAVQRPVAS

SEQ ID NO: 60202 - protein, 25 aa, synthetic construct
  source 1..25: note = Seed: VKLQTVHSIPLTINKEEALQRPVAS
VKLQTVHSIPVTIVKWEAFQRPVAS

SEQ ID NO: 60203 - protein, 25 aa, synthetic construct
  source 1..25: note = Seed: VKLQTVHSIPLTINKEEALQRPVAS
VKLQTVHSIPVTIVKWEAIQRPVAS

SEQ ID NO: 60204 - protein, 25 aa, synthetic construct
  source 1..25: note = Seed: VKLQTVHSIPLTINKEEALQRPVAS
VKLQTVHSIPVTIVKWEALQRPVAS

SEQ ID NO: 60205 - protein, 25 aa, synthetic construct
  source 1..25: note = Seed: VKLQTVHSIPLTINKEEALQRPVAS
VKLQTVHSIPVTIVKYEAFQRPVAS

SEQ ID NO: 60206 - protein, 25 aa, synthetic construct
  source 1..25: note = Seed: VKLQTVHSIPLTINKEEALQRPVAS
VKLQTVHSIPVTIVKYEAIQRPVAS

SEQ ID NO: 60207 - protein, 25 aa, synthetic construct
  source 1..25: note = Seed: VKLQTVHSIPLTINKEEALQRPVAS
VKLQTVHSIPVTIVKYEALQRPVAS

SEQ ID NO: 60208 - protein, 25 aa, synthetic construct
  source 1..25: note = Seed: VKLQTVHSIPLTINKEEALQRPVAS
VKLQTVHSIPVTIVKYEAVQRPVAS

SEQ ID NO: 60209 - protein, 25 aa, synthetic construct
  source 1..25: note = Seed: VKLQTVHSIPLTINKEEALQRPVAS
VKLQTVHSIPVTIWKAEAAQRPVAS

SEQ ID NO: 60210 - protein, 25 aa, synthetic construct
  source 1..25: note = Seed: VKLQTVHSIPLTINKEEALQRPVAS
VKLQTVHSIPVTIWKAEAFQRPVAS

SEQ ID NO: 60211 - protein, 25 aa, synthetic construct
  source 1..25: note = Seed: VKLQTVHSIPLTINKEEALQRPVAS
VKLQTVHSIPVTIWKAEAIQRPVAS

SEQ ID NO: 60212 - protein, 25 aa, synthetic construct
  source 1..25: note = Seed: VKLQTVHSIPLTINKEEALQRPVAS
VKLQTVHSIPVTIWKAEALQRPVAS

SEQ ID NO: 60213 - protein, 25 aa, synthetic construct
  source 1..25: note = Seed: VKLQTVHSIPLTINKEEALQRPVAS
VKLQTVHSIPVTIWKAEAMQRPVAS

SEQ ID NO: 60214 - protein, 25 aa, synthetic construct
  source 1..25: note = Seed: VKLQTVHSIPLTINKEEALQRPVAS
VKLQTVHSIPVTIWKAEAVQRPVAS

SEQ ID NO: 60215 - protein, 25 aa, synthetic construct
  source 1..25: note = Seed: VKLQTVHSIPLTINKEEALQRPVAS
VKLQTVHSIPVTIWKDEAAQRPVAS

SEQ ID NO: 60216 - protein, 25 aa, synthetic construct
  source 1..25: note = Seed: VKLQTVHSIPLTINKEEALQRPVAS
VKLQTVHSIPVTIWKDEAFQRPVAS

SEQ ID NO: 60217 - protein, 25 aa, synthetic construct
  source 1..25: note = Seed: VKLQTVHSIPLTINKEEALQRPVAS
VKLQTVHSIPVTIWKDEAIQRPVAS

SEQ ID NO: 60218 - protein, 25 aa, synthetic construct
  source 1..25: note = Seed: VKLQTVHSIPLTINKEEALQRPVAS
VKLQTVHSIPVTIWKDEALQRPVAS

SEQ ID NO: 60219 - protein, 25 aa, synthetic construct
  source 1..25: note = Seed: VKLQTVHSIPLTINKEEALQRPVAS
VKLQTVHSIPVTIWKDEAMQRPVAS

SEQ ID NO: 60220 - protein, 25 aa, synthetic construct
  source 1..25: note = Seed: VKLQTVHSIPLTINKEEALQRPVAS
VKLQTVHSIPVTIWKDEAVQRPVAS

SEQ ID NO: 60221 - protein, 25 aa, synthetic construct
  source 1..25: note = Seed: VKLQTVHSIPLTINKEEALQRPVAS
VKLQTVHSIPVTIWKFEAFQRPVAS

SEQ ID NO: 60222 - protein, 25 aa, synthetic construct
  source 1..25: note = Seed: VKLQTVHSIPLTINKEEALQRPVAS
VKLQTVHSIPVTIWKFEAIQRPVAS

SEQ ID NO: 60223 - protein, 25 aa, synthetic construct
  source 1..25: note = Seed: VKLQTVHSIPLTINKEEALQRPVAS
VKLQTVHSIPVTIWKFEALQRPVAS

SEQ ID NO: 60224 - protein, 25 aa, synthetic construct
  source 1..25: note = Seed: VKLQTVHSIPLTINKEEALQRPVAS
VKLQTVHSIPVTIWKFEAMQRPVAS

SEQ ID NO: 60225 - protein, 25 aa, synthetic construct
  source 1..25: note = Seed: VKLQTVHSIPLTINKEEALQRPVAS
VKLQTVHSIPVTIWKFEAVQRPVAS

SEQ ID NO: 60226 - protein, 25 aa, synthetic construct
  source 1..25: note = Seed: VKLQTVHSIPLTINKEEALQRPVAS
VKLQTVHSIPVTIWKFEAYQRPVAS

SEQ ID NO: 60227 - protein, 25 aa, synthetic construct
  source 1..25: note = Seed: VKLQTVHSIPLTINKEEALQRPVAS
VKLQTVHSIPVTIWKIEAAQRPVAS

SEQ ID NO: 60228 - protein, 25 aa, synthetic construct
  source 1..25: note = Seed: VKLQTVHSIPLTINKEEALQRPVAS
VKLQTVHSIPVTIWKIEAFQRPVAS

SEQ ID NO: 60229 - protein, 25 aa, synthetic construct
  source 1..25: note = Seed: VKLQTVHSIPLTINKEEALQRPVAS
VKLQTVHSIPVTIWKIEAIQRPVAS

SEQ ID NO: 60230 - protein, 25 aa, synthetic construct
  source 1..25: note = Seed: VKLQTVHSIPLTINKEEALQRPVAS
VKLQTVHSIPVTIWKIEALQRPVAS

SEQ ID NO: 60231 - protein, 25 aa, synthetic construct
  source 1..25: note = Seed: VKLQTVHSIPLTINKEEALQRPVAS
VKLQTVHSIPVTIWKIEAMQRPVAS

SEQ ID NO: 60232 - protein, 25 aa, synthetic construct
  source 1..25: note = Seed: VKLQTVHSIPLTINKEEALQRPVAS
VKLQTVHSIPVTIWKIEASQRPVAS

SEQ ID NO: 60233 - protein, 25 aa, synthetic construct
  source 1..25: note = Seed: VKLQTVHSIPLTINKEEALQRPVAS
VKLQTVHSIPVTIWKIEAVQRPVAS

SEQ ID NO: 60234 - protein, 25 aa, synthetic construct
  source 1..25: note = Seed: VKLQTVHSIPLTINKEEALQRPVAS
VKLQTVHSIPVTIWKIEAYQRPVAS

SEQ ID NO: 60235 - protein, 25 aa, synthetic construct
  source 1..25: note = Seed: VKLQTVHSIPLTINKEEALQRPVAS
VKLQTVHSIPVTIWKLEAAQRPVAS

SEQ ID NO: 60236 - protein, 25 aa, synthetic construct
  source 1..25: note = Seed: VKLQTVHSIPLTINKEEALQRPVAS
VKLQTVHSIPVTIWKLEAFQRPVAS

SEQ ID NO: 60237 - protein, 25 aa, synthetic construct
  source 1..25: note = Seed: VKLQTVHSIPLTINKEEALQRPVAS
VKLQTVHSIPVTIWKLEAIQRPVAS

SEQ ID NO: 60238 - protein, 25 aa, synthetic construct
  source 1..25: note = Seed: VKLQTVHSIPLTINKEEALQRPVAS
VKLQTVHSIPVTIWKLEAVQRPVAS

SEQ ID NO: 60239 - protein, 25 aa, synthetic construct
  source 1..25: note = Seed: VKLQTVHSIPLTINKEEALQRPVAS
VKLQTVHSIPVTIWKMEAAQRPVAS

SEQ ID NO: 60240 - protein, 25 aa, synthetic construct
  source 1..25: note = Seed: VKLQTVHSIPLTINKEEALQRPVAS
VKLQTVHSIPVTIWKMEAIQRPVAS

SEQ ID NO: 60241 - protein, 25 aa, synthetic construct
  source 1..25: note = Seed: VKLQTVHSIPLTINKEEALQRPVAS
VKLQTVHSIPVTIWKMEAVQRPVAS

SEQ ID NO: 60242 - protein, 25 aa, synthetic construct
  source 1..25: note = Seed: VKLQTVHSIPLTINKEEALQRPVAS
VKLQTVHSIPVTIWKNEAIQRPVAS

SEQ ID NO: 60243 - protein, 25 aa, synthetic construct
  source 1..25: note = Seed: VKLQTVHSIPLTINKEEALQRPVAS
VKLQTVHSIPVTIWKNEALQRPVAS

SEQ ID NO: 60244 - protein, 25 aa, synthetic construct
  source 1..25: note = Seed: VKLQTVHSIPLTINKEEALQRPVAS
VKLQTVHSIPVTIWKNEAVQRPVAS

SEQ ID NO: 60245 - protein, 25 aa, synthetic construct
  source 1..25: note = Seed: VKLQTVHSIPLTINKEEALQRPVAS
VKLQTVHSIPVTIWKVEAAQRPVAS

SEQ ID NO: 60246 - protein, 25 aa, synthetic construct
  source 1..25: note = Seed: VKLQTVHSIPLTINKEEALQRPVAS
VKLQTVHSIPVTIWKVEAFQRPVAS

SEQ ID NO: 60247 - protein, 25 aa, synthetic construct
  source 1..25: note = Seed: VKLQTVHSIPLTINKEEALQRPVAS
VKLQTVHSIPVTIWKVEAIQRPVAS

SEQ ID NO: 60248 - protein, 25 aa, synthetic construct
  source 1..25: note = Seed: VKLQTVHSIPLTINKEEALQRPVAS
VKLQTVHSIPVTIWKVEALQRPVAS

SEQ ID NO: 60249 - protein, 25 aa, synthetic construct
  source 1..25: note = Seed: VKLQTVHSIPLTINKEEALQRPVAS
VKLQTVHSIPVTIWKVEAMQRPVAS

SEQ ID NO: 60250 - protein, 25 aa, synthetic construct
  source 1..25: note = Seed: VKLQTVHSIPLTINKEEALQRPVAS
VKLQTVHSIPVTIWKVEAVQRPVAS

SEQ ID NO: 60251 - protein, 25 aa, synthetic construct
  source 1..25: note = Seed: VKLQTVHSIPLTINKEEALQRPVAS
VKLQTVHSIPVTIWKWEAFQRPVAS

SEQ ID NO: 60252 - protein, 25 aa, synthetic construct
  source 1..25: note = Seed: VKLQTVHSIPLTINKEEALQRPVAS
VKLQTVHSIPVTIWKYEAFQRPVAS

SEQ ID NO: 60253 - protein, 25 aa, synthetic construct
  source 1..25: note = Seed: VKLQTVHSIPLTINKEEALQRPVAS
VKLQTVHSIPVTIWKYEALQRPVAS

SEQ ID NO: 60254 - protein, 25 aa, synthetic construct
  source 1..25: note = Seed: VKLQTVHSIPLTINKEEALQRPVAS
VKLQTVHSIPVTIYKAEAAQRPVAS

SEQ ID NO: 60255 - protein, 25 aa, synthetic construct
  source 1..25: note = Seed: VKLQTVHSIPLTINKEEALQRPVAS
VKLQTVHSIPVTIYKAEAFQRPVAS

SEQ ID NO: 60256 - protein, 25 aa, synthetic construct
  source 1..25: note = Seed: VKLQTVHSIPLTINKEEALQRPVAS
VKLQTVHSIPVTIYKAEAIQRPVAS

SEQ ID NO: 60257 - protein, 25 aa, synthetic construct
  source 1..25: note = Seed: VKLQTVHSIPLTINKEEALQRPVAS
VKLQTVHSIPVTIYKAEALQRPVAS

SEQ ID NO: 60258 - protein, 25 aa, synthetic construct
  source 1..25: note = Seed: VKLQTVHSIPLTINKEEALQRPVAS
VKLQTVHSIPVTIYKAEAMQRPVAS

SEQ ID NO: 60259 - protein, 25 aa, synthetic construct
  source 1..25: note = Seed: VKLQTVHSIPLTINKEEALQRPVAS
VKLQTVHSIPVTIYKAEASQRPVAS

SEQ ID NO: 60260 - protein, 25 aa, synthetic construct
  source 1..25: note = Seed: VKLQTVHSIPLTINKEEALQRPVAS
VKLQTVHSIPVTIYKAEATQRPVAS

SEQ ID NO: 60261 - protein, 25 aa, synthetic construct
  source 1..25: note = Seed: VKLQTVHSIPLTINKEEALQRPVAS
VKLQTVHSIPVTIYKAEAVQRPVAS

SEQ ID NO: 60262 - protein, 25 aa, synthetic construct
  source 1..25: note = Seed: VKLQTVHSIPLTINKEEALQRPVAS
VKLQTVHSIPVTIYKAEAYQRPVAS

SEQ ID NO: 60263 - protein, 25 aa, synthetic construct
  source 1..25: note = Seed: VKLQTVHSIPLTINKEEALQRPVAS
VKLQTVHSIPVTIYKDEAAQRPVAS

SEQ ID NO: 60264 - protein, 25 aa, synthetic construct
  source 1..25: note = Seed: VKLQTVHSIPLTINKEEALQRPVAS
VKLQTVHSIPVTIYKDEAFQRPVAS

SEQ ID NO: 60265 - protein, 25 aa, synthetic construct
  source 1..25: note = Seed: VKLQTVHSIPLTINKEEALQRPVAS
VKLQTVHSIPVTIYKDEAIQRPVAS

SEQ ID NO: 60266 - protein, 25 aa, synthetic construct
  source 1..25: note = Seed: VKLQTVHSIPLTINKEEALQRPVAS
VKLQTVHSIPVTIYKDEALQRPVAS

SEQ ID NO: 60267 - protein, 25 aa, synthetic construct
  source 1..25: note = Seed: VKLQTVHSIPLTINKEEALQRPVAS
VKLQTVHSIPVTIYKDEAMQRPVAS

SEQ ID NO: 60268 - protein, 25 aa, synthetic construct
  source 1..25: note = Seed: VKLQTVHSIPLTINKEEALQRPVAS
VKLQTVHSIPVTIYKDEASQRPVAS

SEQ ID NO: 60269 - protein, 25 aa, synthetic construct
  source 1..25: note = Seed: VKLQTVHSIPLTINKEEALQRPVAS
VKLQTVHSIPVTIYKDEAVQRPVAS

SEQ ID NO: 60270 - protein, 25 aa, synthetic construct
  source 1..25: note = Seed: VKLQTVHSIPLTINKEEALQRPVAS
VKLQTVHSIPVTIYKDEAYQRPVAS

SEQ ID NO: 60271 - protein, 25 aa, synthetic construct
  source 1..25: note = Seed: VKLQTVHSIPLTINKEEALQRPVAS
VKLQTVHSIPVTIYKFEAFQRPVAS

SEQ ID NO: 60272 - protein, 25 aa, synthetic construct
  source 1..25: note = Seed: VKLQTVHSIPLTINKEEALQRPVAS
VKLQTVHSIPVTIYKFEAIQRPVAS

SEQ ID NO: 60273 - protein, 25 aa, synthetic construct
  source 1..25: note = Seed: VKLQTVHSIPLTINKEEALQRPVAS
VKLQTVHSIPVTIYKFEALQRPVAS

SEQ ID NO: 60274 - protein, 25 aa, synthetic construct
  source 1..25: note = Seed: VKLQTVHSIPLTINKEEALQRPVAS
VKLQTVHSIPVTIYKFEAMQRPVAS

SEQ ID NO: 60275 - protein, 25 aa, synthetic construct
  source 1..25: note = Seed: VKLQTVHSIPLTINKEEALQRPVAS
VKLQTVHSIPVTIYKFEAVQRPVAS

SEQ ID NO: 60276 - protein, 25 aa, synthetic construct
  source 1..25: note = Seed: VKLQTVHSIPLTINKEEALQRPVAS
VKLQTVHSIPVTIYKFEAYQRPVAS

SEQ ID NO: 60277 - protein, 25 aa, synthetic construct
  source 1..25: note = Seed: VKLQTVHSIPLTINKEEALQRPVAS
VKLQTVHSIPVTIYKHEALQRPVAS

SEQ ID NO: 60278 - protein, 25 aa, synthetic construct
  source 1..25: note = Seed: VKLQTVHSIPLTINKEEALQRPVAS
VKLQTVHSIPVTIYKIEAAQRPVAS

SEQ ID NO: 60279 - protein, 25 aa, synthetic construct
  source 1..25: note = Seed: VKLQTVHSIPLTINKEEALQRPVAS
VKLQTVHSIPVTIYKIEAEQRPVAS

SEQ ID NO: 60280 - protein, 25 aa, synthetic construct
  source 1..25: note = Seed: VKLQTVHSIPLTINKEEALQRPVAS
VKLQTVHSIPVTIYKIEAFQRPVAS

SEQ ID NO: 60281 - protein, 25 aa, synthetic construct
  source 1..25: note = Seed: VKLQTVHSIPLTINKEEALQRPVAS
VKLQTVHSIPVTIYKIEAGQRPVAS

SEQ ID NO: 60282 - protein, 25 aa, synthetic construct
  source 1..25: note = Seed: VKLQTVHSIPLTINKEEALQRPVAS
VKLQTVHSIPVTIYKIEAIQRPVAS

SEQ ID NO: 60283 - protein, 25 aa, synthetic construct
  source 1..25: note = Seed: VKLQTVHSIPLTINKEEALQRPVAS
VKLQTVHSIPVTIYKIEALQRPVAS

SEQ ID NO: 60284 - protein, 25 aa, synthetic construct
  source 1..25: note = Seed: VKLQTVHSIPLTINKEEALQRPVAS
VKLQTVHSIPVTIYKIEAMQRPVAS

SEQ ID NO: 60285 - protein, 25 aa, synthetic construct
  source 1..25: note = Seed: VKLQTVHSIPLTINKEEALQRPVAS
VKLQTVHSIPVTIYKIEANQRPVAS

SEQ ID NO: 60286 - protein, 25 aa, synthetic construct
  source 1..25: note = Seed: VKLQTVHSIPLTINKEEALQRPVAS
VKLQTVHSIPVTIYKIEAQQRPVAS

SEQ ID NO: 60287 - protein, 25 aa, synthetic construct
  source 1..25: note = Seed: VKLQTVHSIPLTINKEEALQRPVAS
VKLQTVHSIPVTIYKIEARQRPVAS

SEQ ID NO: 60288 - protein, 25 aa, synthetic construct
  source 1..25: note = Seed: VKLQTVHSIPLTINKEEALQRPVAS
VKLQTVHSIPVTIYKIEASQRPVAS

SEQ ID NO: 60289 - protein, 25 aa, synthetic construct
  source 1..25: note = Seed: VKLQTVHSIPLTINKEEALQRPVAS
VKLQTVHSIPVTIYKIEATQRPVAS

SEQ ID NO: 60290 - protein, 25 aa, synthetic construct
  source 1..25: note = Seed: VKLQTVHSIPLTINKEEALQRPVAS
VKLQTVHSIPVTIYKIEAVQRPVAS

SEQ ID NO: 60291 - protein, 25 aa, synthetic construct
  source 1..25: note = Seed: VKLQTVHSIPLTINKEEALQRPVAS
VKLQTVHSIPVTIYKIEAYQRPVAS

SEQ ID NO: 60292 - protein, 25 aa, synthetic construct
  source 1..25: note = Seed: VKLQTVHSIPLTINKEEALQRPVAS
VKLQTVHSIPVTIYKLEAAQRPVAS

SEQ ID NO: 60293 - protein, 25 aa, synthetic construct
  source 1..25: note = Seed: VKLQTVHSIPLTINKEEALQRPVAS
VKLQTVHSIPVTIYKLEAFQRPVAS

SEQ ID NO: 60294 - protein, 25 aa, synthetic construct
  source 1..25: note = Seed: VKLQTVHSIPLTINKEEALQRPVAS
VKLQTVHSIPVTIYKLEAIQRPVAS

SEQ ID NO: 60295 - protein, 25 aa, synthetic construct
  source 1..25: note = Seed: VKLQTVHSIPLTINKEEALQRPVAS
VKLQTVHSIPVTIYKLEALQRPVAS

SEQ ID NO: 60296 - protein, 25 aa, synthetic construct
  source 1..25: note = Seed: VKLQTVHSIPLTINKEEALQRPVAS
VKLQTVHSIPVTIYKLEAMQRPVAS

SEQ ID NO: 60297 - protein, 25 aa, synthetic construct
  source 1..25: note = Seed: VKLQTVHSIPLTINKEEALQRPVAS
VKLQTVHSIPVTIYKLEASQRPVAS

SEQ ID NO: 60298 - protein, 25 aa, synthetic construct
  source 1..25: note = Seed: VKLQTVHSIPLTINKEEALQRPVAS
VKLQTVHSIPVTIYKLEAVQRPVAS

SEQ ID NO: 60299 - protein, 25 aa, synthetic construct
  source 1..25: note = Seed: VKLQTVHSIPLTINKEEALQRPVAS
VKLQTVHSIPVTIYKLEAYQRPVAS

SEQ ID NO: 60300 - protein, 25 aa, synthetic construct
  source 1..25: note = Seed: VKLQTVHSIPLTINKEEALQRPVAS
VKLQTVHSIPVTIYKMEAAQRPVAS

SEQ ID NO: 60301 - protein, 25 aa, synthetic construct
  source 1..25: note = Seed: VKLQTVHSIPLTINKEEALQRPVAS
VKLQTVHSIPVTIYKMEAFQRPVAS

SEQ ID NO: 60302 - protein, 25 aa, synthetic construct
  source 1..25: note = Seed: VKLQTVHSIPLTINKEEALQRPVAS
VKLQTVHSIPVTIYKMEAIQRPVAS

SEQ ID NO: 60303 - protein, 25 aa, synthetic construct
  source 1..25: note = Seed: VKLQTVHSIPLTINKEEALQRPVAS
VKLQTVHSIPVTIYKMEALQRPVAS

SEQ ID NO: 60304 - protein, 25 aa, synthetic construct
  source 1..25: note = Seed: VKLQTVHSIPLTINKEEALQRPVAS
VKLQTVHSIPVTIYKMEAMQRPVAS

SEQ ID NO: 60305 - protein, 25 aa, synthetic construct
  source 1..25: note = Seed: VKLQTVHSIPLTINKEEALQRPVAS
VKLQTVHSIPVTIYKMEAVQRPVAS

SEQ ID NO: 60306 - protein, 25 aa, synthetic construct
  source 1..25: note = Seed: VKLQTVHSIPLTINKEEALQRPVAS
VKLQTVHSIPVTIYKNEAAQRPVAS

SEQ ID NO: 60307 - protein, 25 aa, synthetic construct
  source 1..25: note = Seed: VKLQTVHSIPLTINKEEALQRPVAS
VKLQTVHSIPVTIYKNEAFQRPVAS

SEQ ID NO: 60308 - protein, 25 aa, synthetic construct
  source 1..25: note = Seed: VKLQTVHSIPLTINKEEALQRPVAS
VKLQTVHSIPVTIYKNEAIQRPVAS

SEQ ID NO: 60309 - protein, 25 aa, synthetic construct
  source 1..25: note = Seed: VKLQTVHSIPLTINKEEALQRPVAS
VKLQTVHSIPVTIYKNEALQRPVAS

SEQ ID NO: 60310 - protein, 25 aa, synthetic construct
  source 1..25: note = Seed: VKLQTVHSIPLTINKEEALQRPVAS
VKLQTVHSIPVTIYKNEAVQRPVAS

SEQ ID NO: 60311 - protein, 25 aa, synthetic construct
  source 1..25: note = Seed: VKLQTVHSIPLTINKEEALQRPVAS
VKLQTVHSIPVTIYKREAFQRPVAS

SEQ ID NO: 60312 - protein, 25 aa, synthetic construct
  source 1..25: note = Seed: VKLQTVHSIPLTINKEEALQRPVAS
VKLQTVHSIPVTIYKSEAAQRPVAS

SEQ ID NO: 60313 - protein, 25 aa, synthetic construct
  source 1..25: note = Seed: VKLQTVHSIPLTINKEEALQRPVAS
VKLQTVHSIPVTIYKSEAIQRPVAS

SEQ ID NO: 60314 - protein, 25 aa, synthetic construct
  source 1..25: note = Seed: VKLQTVHSIPLTINKEEALQRPVAS
VKLQTVHSIPVTIYKSEALQRPVAS

SEQ ID NO: 60315 - protein, 25 aa, synthetic construct
  source 1..25: note = Seed: VKLQTVHSIPLTINKEEALQRPVAS
VKLQTVHSIPVTIYKSEAVQRPVAS

SEQ ID NO: 60316 - protein, 25 aa, synthetic construct
  source 1..25: note = Seed: VKLQTVHSIPLTINKEEALQRPVAS
VKLQTVHSIPVTIYKTEAAQRPVAS

SEQ ID NO: 60317 - protein, 25 aa, synthetic construct
  source 1..25: note = Seed: VKLQTVHSIPLTINKEEALQRPVAS
VKLQTVHSIPVTIYKTEAIQRPVAS

SEQ ID NO: 60318 - protein, 25 aa, synthetic construct
  source 1..25: note = Seed: VKLQTVHSIPLTINKEEALQRPVAS
VKLQTVHSIPVTIYKVEAAQRPVAS

SEQ ID NO: 60319 - protein, 25 aa, synthetic construct
  source 1..25: note = Seed: VKLQTVHSIPLTINKEEALQRPVAS
VKLQTVHSIPVTIYKVEAFQRPVAS

SEQ ID NO: 60320 - protein, 25 aa, synthetic construct
  source 1..25: note = Seed: VKLQTVHSIPLTINKEEALQRPVAS
VKLQTVHSIPVTIYKVEAIQRPVAS

SEQ ID NO: 60321 - protein, 25 aa, synthetic construct
  source 1..25: note = Seed: VKLQTVHSIPLTINKEEALQRPVAS
VKLQTVHSIPVTIYKVEALQRPVAS

SEQ ID NO: 60322 - protein, 25 aa, synthetic construct
  source 1..25: note = Seed: VKLQTVHSIPLTINKEEALQRPVAS
VKLQTVHSIPVTIYKVEAMQRPVAS

SEQ ID NO: 60323 - protein, 25 aa, synthetic construct
  source 1..25: note = Seed: VKLQTVHSIPLTINKEEALQRPVAS
VKLQTVHSIPVTIYKVEASQRPVAS

SEQ ID NO: 60324 - protein, 25 aa, synthetic construct
  source 1..25: note = Seed: VKLQTVHSIPLTINKEEALQRPVAS
VKLQTVHSIPVTIYKVEATQRPVAS

SEQ ID NO: 60325 - protein, 25 aa, synthetic construct
  source 1..25: note = Seed: VKLQTVHSIPLTINKEEALQRPVAS
VKLQTVHSIPVTIYKVEAVQRPVAS

SEQ ID NO: 60326 - protein, 25 aa, synthetic construct
  source 1..25: note = Seed: VKLQTVHSIPLTINKEEALQRPVAS
VKLQTVHSIPVTIYKVEAYQRPVAS

SEQ ID NO: 60327 - protein, 25 aa, synthetic construct
  source 1..25: note = Seed: VKLQTVHSIPLTINKEEALQRPVAS
VKLQTVHSIPVTIYKWEAFQRPVAS

SEQ ID NO: 60328 - protein, 25 aa, synthetic construct
  source 1..25: note = Seed: VKLQTVHSIPLTINKEEALQRPVAS
VKLQTVHSIPVTIYKWEALQRPVAS

SEQ ID NO: 60329 - protein, 25 aa, synthetic construct
  source 1..25: note = Seed: VKLQTVHSIPLTINKEEALQRPVAS
VKLQTVHSIPVTIYKYEAFQRPVAS

SEQ ID NO: 60330 - protein, 25 aa, synthetic construct
  source 1..25: note = Seed: VKLQTVHSIPLTINKEEALQRPVAS
VKLQTVHSIPVTIYKYEAIQRPVAS

SEQ ID NO: 60331 - protein, 25 aa, synthetic construct
  source 1..25: note = Seed: VKLQTVHSIPLTINKEEALQRPVAS
VKLQTVHSIPVTIYKYEALQRPVAS

SEQ ID NO: 60332 - protein, 25 aa, synthetic construct
  source 1..25: note = Seed: VKLQTVHSIPLTINKEEALQRPVAS
VKLQTVHSIPWTIAKFEAAQRPVAS

SEQ ID NO: 60333 - protein, 25 aa, synthetic construct
  source 1..25: note = Seed: VKLQTVHSIPLTINKEEALQRPVAS
VKLQTVHSIPWTIAKFEAFQRPVAS

SEQ ID NO: 60334 - protein, 25 aa, synthetic construct
  source 1..25: note = Seed: VKLQTVHSIPLTINKEEALQRPVAS
VKLQTVHSIPWTIAKFEAIQRPVAS

SEQ ID NO: 60335 - protein, 25 aa, synthetic construct
  source 1..25: note = Seed: VKLQTVHSIPLTINKEEALQRPVAS
VKLQTVHSIPWTIAKFEALQRPVAS

SEQ ID NO: 60336 - protein, 25 aa, synthetic construct
  source 1..25: note = Seed: VKLQTVHSIPLTINKEEALQRPVAS
VKLQTVHSIPWTIAKFEAMQRPVAS

SEQ ID NO: 60337 - protein, 25 aa, synthetic construct
  source 1..25: note = Seed: VKLQTVHSIPLTINKEEALQRPVAS
VKLQTVHSIPWTIAKFEANQRPVAS

SEQ ID NO: 60338 - protein, 25 aa, synthetic construct
  source 1..25: note = Seed: VKLQTVHSIPLTINKEEALQRPVAS
VKLQTVHSIPWTIAKFEASQRPVAS

SEQ ID NO: 60339 - protein, 25 aa, synthetic construct
  source 1..25: note = Seed: VKLQTVHSIPLTINKEEALQRPVAS
VKLQTVHSIPWTIAKFEATQRPVAS

SEQ ID NO: 60340 - protein, 25 aa, synthetic construct
  source 1..25: note = Seed: VKLQTVHSIPLTINKEEALQRPVAS
VKLQTVHSIPWTIAKFEAVQRPVAS

SEQ ID NO: 60341 - protein, 25 aa, synthetic construct
  source 1..25: note = Seed: VKLQTVHSIPLTINKEEALQRPVAS
VKLQTVHSIPWTIAKFEAYQRPVAS

SEQ ID NO: 60342 - protein, 25 aa, synthetic construct
  source 1..25: note = Seed: VKLQTVHSIPLTINKEEALQRPVAS
VKLQTVHSIPWTIAKLEAIQRPVAS

SEQ ID NO: 60343 - protein, 25 aa, synthetic construct
  source 1..25: note = Seed: VKLQTVHSIPLTINKEEALQRPVAS
VKLQTVHSIPWTIAKLEALQRPVAS

SEQ ID NO: 60344 - protein, 25 aa, synthetic construct
  source 1..25: note = Seed: VKLQTVHSIPLTINKEEALQRPVAS
VKLQTVHSIPWTIAKWEAIQRPVAS

SEQ ID NO: 60345 - protein, 25 aa, synthetic construct
  source 1..25: note = Seed: VKLQTVHSIPLTINKEEALQRPVAS
VKLQTVHSIPWTIAKWEALQRPVAS

SEQ ID NO: 60346 - protein, 25 aa, synthetic construct
  source 1..25: note = Seed: VKLQTVHSIPLTINKEEALQRPVAS
VKLQTVHSIPWTIAKYEAFQRPVAS

SEQ ID NO: 60347 - protein, 25 aa, synthetic construct
  source 1..25: note = Seed: VKLQTVHSIPLTINKEEALQRPVAS
VKLQTVHSIPWTIAKYEAIQRPVAS

SEQ ID NO: 60348 - protein, 25 aa, synthetic construct
  source 1..25: note = Seed: VKLQTVHSIPLTINKEEALQRPVAS
VKLQTVHSIPWTIAKYEALQRPVAS

SEQ ID NO: 60349 - protein, 25 aa, synthetic construct
  source 1..25: note = Seed: VKLQTVHSIPLTINKEEALQRPVAS
VKLQTVHSIPWTIAKYEAVQRPVAS

SEQ ID NO: 60350 - protein, 25 aa, synthetic construct
  source 1..25: note = Seed: VKLQTVHSIPLTINKEEALQRPVAS
VKLQTVHSIPWTICKFEAFQRPVAS

SEQ ID NO: 60351 - protein, 25 aa, synthetic construct
  source 1..25: note = Seed: VKLQTVHSIPLTINKEEALQRPVAS
VKLQTVHSIPWTICKFEAIQRPVAS

SEQ ID NO: 60352 - protein, 25 aa, synthetic construct
  source 1..25: note = Seed: VKLQTVHSIPLTINKEEALQRPVAS
VKLQTVHSIPWTICKFEALQRPVAS

SEQ ID NO: 60353 - protein, 25 aa, synthetic construct
  source 1..25: note = Seed: VKLQTVHSIPLTINKEEALQRPVAS
VKLQTVHSIPWTICKFEAVQRPVAS

SEQ ID NO: 60354 - protein, 25 aa, synthetic construct
  source 1..25: note = Seed: VKLQTVHSIPLTINKEEALQRPVAS
VKLQTVHSIPWTIDKFEAFQRPVAS

SEQ ID NO: 60355 - protein, 25 aa, synthetic construct
  source 1..25: note = Seed: VKLQTVHSIPLTINKEEALQRPVAS
VKLQTVHSIPWTIDKFEAIQRPVAS

SEQ ID NO: 60356 - protein, 25 aa, synthetic construct
  source 1..25: note = Seed: VKLQTVHSIPLTINKEEALQRPVAS
VKLQTVHSIPWTIDKFEALQRPVAS

SEQ ID NO: 60357 - protein, 25 aa, synthetic construct
  source 1..25: note = Seed: VKLQTVHSIPLTINKEEALQRPVAS
VKLQTVHSIPWTIDKFEAVQRPVAS

SEQ ID NO: 60358 - protein, 25 aa, synthetic construct
  source 1..25: note = Seed: VKLQTVHSIPLTINKEEALQRPVAS
VKLQTVHSIPWTIEKFEAAQRPVAS

SEQ ID NO: 60359 - protein, 25 aa, synthetic construct
  source 1..25: note = Seed: VKLQTVHSIPLTINKEEALQRPVAS
VKLQTVHSIPWTIEKFEAFQRPVAS

SEQ ID NO: 60360 - protein, 25 aa, synthetic construct
  source 1..25: note = Seed: VKLQTVHSIPLTINKEEALQRPVAS
VKLQTVHSIPWTIEKFEAIQRPVAS

SEQ ID NO: 60361 - protein, 25 aa, synthetic construct
  source 1..25: note = Seed: VKLQTVHSIPLTINKEEALQRPVAS
VKLQTVHSIPWTIEKFEALQRPVAS

SEQ ID NO: 60362 - protein, 25 aa, synthetic construct
  source 1..25: note = Seed: VKLQTVHSIPLTINKEEALQRPVAS
VKLQTVHSIPWTIEKFEAMQRPVAS

SEQ ID NO: 60363 - protein, 25 aa, synthetic construct
  source 1..25: note = Seed: VKLQTVHSIPLTINKEEALQRPVAS
VKLQTVHSIPWTIEKFEAVQRPVAS

SEQ ID NO: 60364 - protein, 25 aa, synthetic construct
  source 1..25: note = Seed: VKLQTVHSIPLTINKEEALQRPVAS
VKLQTVHSIPWTIEKFEAYQRPVAS

SEQ ID NO: 60365 - protein, 25 aa, synthetic construct
  source 1..25: note = Seed: VKLQTVHSIPLTINKEEALQRPVAS
VKLQTVHSIPWTIFKAEAFQRPVAS

SEQ ID NO: 60366 - protein, 25 aa, synthetic construct
  source 1..25: note = Seed: VKLQTVHSIPLTINKEEALQRPVAS
VKLQTVHSIPWTIFKAEAIQRPVAS

SEQ ID NO: 60367 - protein, 25 aa, synthetic construct
  source 1..25: note = Seed: VKLQTVHSIPLTINKEEALQRPVAS
VKLQTVHSIPWTIFKAEALQRPVAS

SEQ ID NO: 60368 - protein, 25 aa, synthetic construct
  source 1..25: note = Seed: VKLQTVHSIPLTINKEEALQRPVAS
VKLQTVHSIPWTIFKAEAMQRPVAS

SEQ ID NO: 60369 - protein, 25 aa, synthetic construct
  source 1..25: note = Seed: VKLQTVHSIPLTINKEEALQRPVAS
VKLQTVHSIPWTIFKAEAVQRPVAS

SEQ ID NO: 60370 - protein, 25 aa, synthetic construct
  source 1..25: note = Seed: VKLQTVHSIPLTINKEEALQRPVAS
VKLQTVHSIPWTIFKAEAYQRPVAS

SEQ ID NO: 60371 - protein, 25 aa, synthetic construct
  source 1..25: note = Seed: VKLQTVHSIPLTINKEEALQRPVAS
VKLQTVHSIPWTIFKDEAIQRPVAS

SEQ ID NO: 60372 - protein, 25 aa, synthetic construct
  source 1..25: note = Seed: VKLQTVHSIPLTINKEEALQRPVAS
VKLQTVHSIPWTIFKDEALQRPVAS

SEQ ID NO: 60373 - protein, 25 aa, synthetic construct
  source 1..25: note = Seed: VKLQTVHSIPLTINKEEALQRPVAS
VKLQTVHSIPWTIFKDEAVQRPVAS

SEQ ID NO: 60374 - protein, 25 aa, synthetic construct
  source 1..25: note = Seed: VKLQTVHSIPLTINKEEALQRPVAS
VKLQTVHSIPWTIFKEEAFQRPVAS

SEQ ID NO: 60375 - protein, 25 aa, synthetic construct
  source 1..25: note = Seed: VKLQTVHSIPLTINKEEALQRPVAS
VKLQTVHSIPWTIFKFEAAQRPVAS

SEQ ID NO: 60376 - protein, 25 aa, synthetic construct
  source 1..25: note = Seed: VKLQTVHSIPLTINKEEALQRPVAS
VKLQTVHSIPWTIFKFEACQRPVAS

SEQ ID NO: 60377 - protein, 25 aa, synthetic construct
  source 1..25: note = Seed: VKLQTVHSIPLTINKEEALQRPVAS
VKLQTVHSIPWTIFKFEADQRPVAS

SEQ ID NO: 60378 - protein, 25 aa, synthetic construct
  source 1..25: note = Seed: VKLQTVHSIPLTINKEEALQRPVAS
VKLQTVHSIPWTIFKFEAEQRPVAS

SEQ ID NO: 60379 - protein, 25 aa, synthetic construct
  source 1..25: note = Seed: VKLQTVHSIPLTINKEEALQRPVAS
VKLQTVHSIPWTIFKFEAFQRPVAS

SEQ ID NO: 60380 - protein, 25 aa, synthetic construct
  source 1..25: note = Seed: VKLQTVHSIPLTINKEEALQRPVAS
VKLQTVHSIPWTIFKFEAHQRPVAS

SEQ ID NO: 60381 - protein, 25 aa, synthetic construct
  source 1..25: note = Seed: VKLQTVHSIPLTINKEEALQRPVAS
VKLQTVHSIPWTIFKFEAIQRPVAS

SEQ ID NO: 60382 - protein, 25 aa, synthetic construct
  source 1..25: note = Seed: VKLQTVHSIPLTINKEEALQRPVAS
VKLQTVHSIPWTIFKFEAKQRPVAS

SEQ ID NO: 60383 - protein, 25 aa, synthetic construct
  source 1..25: note = Seed: VKLQTVHSIPLTINKEEALQRPVAS
VKLQTVHSIPWTIFKFEALQRPVAS

SEQ ID NO: 60384 - protein, 25 aa, synthetic construct
  source 1..25: note = Seed: VKLQTVHSIPLTINKEEALQRPVAS
VKLQTVHSIPWTIFKFEAMQRPVAS

SEQ ID NO: 60385 - protein, 25 aa, synthetic construct
  source 1..25: note = Seed: VKLQTVHSIPLTINKEEALQRPVAS
VKLQTVHSIPWTIFKFEANQRPVAS

SEQ ID NO: 60386 - protein, 25 aa, synthetic construct
  source 1..25: note = Seed: VKLQTVHSIPLTINKEEALQRPVAS
VKLQTVHSIPWTIFKFEAPQRPVAS

SEQ ID NO: 60387 - protein, 25 aa, synthetic construct
  source 1..25: note = Seed: VKLQTVHSIPLTINKEEALQRPVAS
VKLQTVHSIPWTIFKFEAQQRPVAS

SEQ ID NO: 60388 - protein, 25 aa, synthetic construct
  source 1..25: note = Seed: VKLQTVHSIPLTINKEEALQRPVAS
VKLQTVHSIPWTIFKFEARQRPVAS

SEQ ID NO: 60389 - protein, 25 aa, synthetic construct
  source 1..25: note = Seed: VKLQTVHSIPLTINKEEALQRPVAS
VKLQTVHSIPWTIFKFEASQRPVAS

SEQ ID NO: 60390 - protein, 25 aa, synthetic construct
  source 1..25: note = Seed: VKLQTVHSIPLTINKEEALQRPVAS
VKLQTVHSIPWTIFKFEATQRPVAS

SEQ ID NO: 60391 - protein, 25 aa, synthetic construct
  source 1..25: note = Seed: VKLQTVHSIPLTINKEEALQRPVAS
VKLQTVHSIPWTIFKFEAVQRPVAS

SEQ ID NO: 60392 - protein, 25 aa, synthetic construct
  source 1..25: note = Seed: VKLQTVHSIPLTINKEEALQRPVAS
VKLQTVHSIPWTIFKFEAWQRPVAS

SEQ ID NO: 60393 - protein, 25 aa, synthetic construct
  source 1..25: note = Seed: VKLQTVHSIPLTINKEEALQRPVAS
VKLQTVHSIPWTIFKFEAYQRPVAS

SEQ ID NO: 60394 - protein, 25 aa, synthetic construct
  source 1..25: note = Seed: VKLQTVHSIPLTINKEEALQRPVAS
VKLQTVHSIPWTIFKHEAFQRPVAS

SEQ ID NO: 60395 - protein, 25 aa, synthetic construct
  source 1..25: note = Seed: VKLQTVHSIPLTINKEEALQRPVAS
VKLQTVHSIPWTIFKIEAAQRPVAS

SEQ ID NO: 60396 - protein, 25 aa, synthetic construct
  source 1..25: note = Seed: VKLQTVHSIPLTINKEEALQRPVAS
VKLQTVHSIPWTIFKIEAFQRPVAS

SEQ ID NO: 60397 - protein, 25 aa, synthetic construct
  source 1..25: note = Seed: VKLQTVHSIPLTINKEEALQRPVAS
VKLQTVHSIPWTIFKIEAIQRPVAS

SEQ ID NO: 60398 - protein, 25 aa, synthetic construct
  source 1..25: note = Seed: VKLQTVHSIPLTINKEEALQRPVAS
VKLQTVHSIPWTIFKIEALQRPVAS

SEQ ID NO: 60399 - protein, 25 aa, synthetic construct
  source 1..25: note = Seed: VKLQTVHSIPLTINKEEALQRPVAS
VKLQTVHSIPWTIFKIEAMQRPVAS

SEQ ID NO: 60400 - protein, 25 aa, synthetic construct
  source 1..25: note = Seed: VKLQTVHSIPLTINKEEALQRPVAS
VKLQTVHSIPWTIFKIEAVQRPVAS

SEQ ID NO: 60401 - protein, 25 aa, synthetic construct
  source 1..25: note = Seed: VKLQTVHSIPLTINKEEALQRPVAS
VKLQTVHSIPWTIFKIEAWQRPVAS

SEQ ID NO: 60402 - protein, 25 aa, synthetic construct
  source 1..25: note = Seed: VKLQTVHSIPLTINKEEALQRPVAS
VKLQTVHSIPWTIFKIEAYQRPVAS

SEQ ID NO: 60403 - protein, 25 aa, synthetic construct
  source 1..25: note = Seed: VKLQTVHSIPLTINKEEALQRPVAS
VKLQTVHSIPWTIFKKEAFQRPVAS

SEQ ID NO: 60404 - protein, 25 aa, synthetic construct
  source 1..25: note = Seed: VKLQTVHSIPLTINKEEALQRPVAS
VKLQTVHSIPWTIFKLEAAQRPVAS

SEQ ID NO: 60405 - protein, 25 aa, synthetic construct
  source 1..25: note = Seed: VKLQTVHSIPLTINKEEALQRPVAS
VKLQTVHSIPWTIFKLEAEQRPVAS

SEQ ID NO: 60406 - protein, 25 aa, synthetic construct
  source 1..25: note = Seed: VKLQTVHSIPLTINKEEALQRPVAS
VKLQTVHSIPWTIFKLEAFQRPVAS

SEQ ID NO: 60407 - protein, 25 aa, synthetic construct
  source 1..25: note = Seed: VKLQTVHSIPLTINKEEALQRPVAS
VKLQTVHSIPWTIFKLEAHQRPVAS

SEQ ID NO: 60408 - protein, 25 aa, synthetic construct
  source 1..25: note = Seed: VKLQTVHSIPLTINKEEALQRPVAS
VKLQTVHSIPWTIFKLEAIQRPVAS

SEQ ID NO: 60409 - protein, 25 aa, synthetic construct
  source 1..25: note = Seed: VKLQTVHSIPLTINKEEALQRPVAS
VKLQTVHSIPWTIFKLEAKQRPVAS

SEQ ID NO: 60410 - protein, 25 aa, synthetic construct
  source 1..25: note = Seed: VKLQTVHSIPLTINKEEALQRPVAS
VKLQTVHSIPWTIFKLEALQRPVAS

SEQ ID NO: 60411 - protein, 25 aa, synthetic construct
  source 1..25: note = Seed: VKLQTVHSIPLTINKEEALQRPVAS
VKLQTVHSIPWTIFKLEAMQRPVAS

SEQ ID NO: 60412 - protein, 25 aa, synthetic construct
  source 1..25: note = Seed: VKLQTVHSIPLTINKEEALQRPVAS
VKLQTVHSIPWTIFKLEANQRPVAS

SEQ ID NO: 60413 - protein, 25 aa, synthetic construct
  source 1..25: note = Seed: VKLQTVHSIPLTINKEEALQRPVAS
VKLQTVHSIPWTIFKLEAQQRPVAS

SEQ ID NO: 60414 - protein, 25 aa, synthetic construct
  source 1..25: note = Seed: VKLQTVHSIPLTINKEEALQRPVAS
VKLQTVHSIPWTIFKLEARQRPVAS

SEQ ID NO: 60415 - protein, 25 aa, synthetic construct
  source 1..25: note = Seed: VKLQTVHSIPLTINKEEALQRPVAS
VKLQTVHSIPWTIFKLEASQRPVAS

SEQ ID NO: 60416 - protein, 25 aa, synthetic construct
  source 1..25: note = Seed: VKLQTVHSIPLTINKEEALQRPVAS
VKLQTVHSIPWTIFKLEATQRPVAS

SEQ ID NO: 60417 - protein, 25 aa, synthetic construct
  source 1..25: note = Seed: VKLQTVHSIPLTINKEEALQRPVAS
VKLQTVHSIPWTIFKLEAVQRPVAS

SEQ ID NO: 60418 - protein, 25 aa, synthetic construct
  source 1..25: note = Seed: VKLQTVHSIPLTINKEEALQRPVAS
VKLQTVHSIPWTIFKLEAWQRPVAS

SEQ ID NO: 60419 - protein, 25 aa, synthetic construct
  source 1..25: note = Seed: VKLQTVHSIPLTINKEEALQRPVAS
VKLQTVHSIPWTIFKLEAYQRPVAS

SEQ ID NO: 60420 - protein, 25 aa, synthetic construct
  source 1..25: note = Seed: VKLQTVHSIPLTINKEEALQRPVAS
VKLQTVHSIPWTIFKMEAFQRPVAS

SEQ ID NO: 60421 - protein, 25 aa, synthetic construct
  source 1..25: note = Seed: VKLQTVHSIPLTINKEEALQRPVAS
VKLQTVHSIPWTIFKMEAIQRPVAS

SEQ ID NO: 60422 - protein, 25 aa, synthetic construct
  source 1..25: note = Seed: VKLQTVHSIPLTINKEEALQRPVAS
VKLQTVHSIPWTIFKMEALQRPVAS

SEQ ID NO: 60423 - protein, 25 aa, synthetic construct
  source 1..25: note = Seed: VKLQTVHSIPLTINKEEALQRPVAS
VKLQTVHSIPWTIFKMEAMQRPVAS

SEQ ID NO: 60424 - protein, 25 aa, synthetic construct
  source 1..25: note = Seed: VKLQTVHSIPLTINKEEALQRPVAS
VKLQTVHSIPWTIFKMEAVQRPVAS

SEQ ID NO: 60425 - protein, 25 aa, synthetic construct
  source 1..25: note = Seed: VKLQTVHSIPLTINKEEALQRPVAS
VKLQTVHSIPWTIFKMEAYQRPVAS

SEQ ID NO: 60426 - protein, 25 aa, synthetic construct
  source 1..25: note = Seed: VKLQTVHSIPLTINKEEALQRPVAS
VKLQTVHSIPWTIFKPEAFQRPVAS

SEQ ID NO: 60427 - protein, 25 aa, synthetic construct
  source 1..25: note = Seed: VKLQTVHSIPLTINKEEALQRPVAS
VKLQTVHSIPWTIFKQEAFQRPVAS

SEQ ID NO: 60428 - protein, 25 aa, synthetic construct
  source 1..25: note = Seed: VKLQTVHSIPLTINKEEALQRPVAS
VKLQTVHSIPWTIFKREAFQRPVAS

SEQ ID NO: 60429 - protein, 25 aa, synthetic construct
  source 1..25: note = Seed: VKLQTVHSIPLTINKEEALQRPVAS
VKLQTVHSIPWTIFKSEAFQRPVAS

SEQ ID NO: 60430 - protein, 25 aa, synthetic construct
  source 1..25: note = Seed: VKLQTVHSIPLTINKEEALQRPVAS
VKLQTVHSIPWTIFKSEALQRPVAS

SEQ ID NO: 60431 - protein, 25 aa, synthetic construct
  source 1..25: note = Seed: VKLQTVHSIPLTINKEEALQRPVAS
VKLQTVHSIPWTIFKSEAYQRPVAS

SEQ ID NO: 60432 - protein, 25 aa, synthetic construct
  source 1..25: note = Seed: VKLQTVHSIPLTINKEEALQRPVAS
VKLQTVHSIPWTIFKTEAFQRPVAS

SEQ ID NO: 60433 - protein, 25 aa, synthetic construct
  source 1..25: note = Seed: VKLQTVHSIPLTINKEEALQRPVAS
VKLQTVHSIPWTIFKTEALQRPVAS

SEQ ID NO: 60434 - protein, 25 aa, synthetic construct
  source 1..25: note = Seed: VKLQTVHSIPLTINKEEALQRPVAS
VKLQTVHSIPWTIFKVEAAQRPVAS

SEQ ID NO: 60435 - protein, 25 aa, synthetic construct
  source 1..25: note = Seed: VKLQTVHSIPLTINKEEALQRPVAS
VKLQTVHSIPWTIFKVEAFQRPVAS

SEQ ID NO: 60436 - protein, 25 aa, synthetic construct
  source 1..25: note = Seed: VKLQTVHSIPLTINKEEALQRPVAS
VKLQTVHSIPWTIFKVEAIQRPVAS

SEQ ID NO: 60437 - protein, 25 aa, synthetic construct
  source 1..25: note = Seed: VKLQTVHSIPLTINKEEALQRPVAS
VKLQTVHSIPWTIFKVEALQRPVAS

SEQ ID NO: 60438 - protein, 25 aa, synthetic construct
  source 1..25: note = Seed: VKLQTVHSIPLTINKEEALQRPVAS
VKLQTVHSIPWTIFKVEAMQRPVAS

SEQ ID NO: 60439 - protein, 25 aa, synthetic construct
  source 1..25: note = Seed: VKLQTVHSIPLTINKEEALQRPVAS
VKLQTVHSIPWTIFKVEAVQRPVAS

SEQ ID NO: 60440 - protein, 25 aa, synthetic construct
  source 1..25: note = Seed: VKLQTVHSIPLTINKEEALQRPVAS
VKLQTVHSIPWTIFKVEAYQRPVAS

SEQ ID NO: 60441 - protein, 25 aa, synthetic construct
  source 1..25: note = Seed: VKLQTVHSIPLTINKEEALQRPVAS
VKLQTVHSIPWTIFKWEAAQRPVAS

SEQ ID NO: 60442 - protein, 25 aa, synthetic construct
  source 1..25: note = Seed: VKLQTVHSIPLTINKEEALQRPVAS
VKLQTVHSIPWTIFKWEAFQRPVAS

SEQ ID NO: 60443 - protein, 25 aa, synthetic construct
  source 1..25: note = Seed: VKLQTVHSIPLTINKEEALQRPVAS
VKLQTVHSIPWTIFKWEAIQRPVAS

SEQ ID NO: 60444 - protein, 25 aa, synthetic construct
  source 1..25: note = Seed: VKLQTVHSIPLTINKEEALQRPVAS
VKLQTVHSIPWTIFKWEALQRPVAS

SEQ ID NO: 60445 - protein, 25 aa, synthetic construct
  source 1..25: note = Seed: VKLQTVHSIPLTINKEEALQRPVAS
VKLQTVHSIPWTIFKWEAMQRPVAS

SEQ ID NO: 60446 - protein, 25 aa, synthetic construct
  source 1..25: note = Seed: VKLQTVHSIPLTINKEEALQRPVAS
VKLQTVHSIPWTIFKWEAVQRPVAS

SEQ ID NO: 60447 - protein, 25 aa, synthetic construct
  source 1..25: note = Seed: VKLQTVHSIPLTINKEEALQRPVAS
VKLQTVHSIPWTIFKWEAWQRPVAS

SEQ ID NO: 60448 - protein, 25 aa, synthetic construct
  source 1..25: note = Seed: VKLQTVHSIPLTINKEEALQRPVAS
VKLQTVHSIPWTIFKWEAYQRPVAS

SEQ ID NO: 60449 - protein, 25 aa, synthetic construct
  source 1..25: note = Seed: VKLQTVHSIPLTINKEEALQRPVAS
VKLQTVHSIPWTIFKYEAAQRPVAS

SEQ ID NO: 60450 - protein, 25 aa, synthetic construct
  source 1..25: note = Seed: VKLQTVHSIPLTINKEEALQRPVAS
VKLQTVHSIPWTIFKYEAFQRPVAS

SEQ ID NO: 60451 - protein, 25 aa, synthetic construct
  source 1..25: note = Seed: VKLQTVHSIPLTINKEEALQRPVAS
VKLQTVHSIPWTIFKYEAIQRPVAS

SEQ ID NO: 60452 - protein, 25 aa, synthetic construct
  source 1..25: note = Seed: VKLQTVHSIPLTINKEEALQRPVAS
VKLQTVHSIPWTIFKYEALQRPVAS

SEQ ID NO: 60453 - protein, 25 aa, synthetic construct
  source 1..25: note = Seed: VKLQTVHSIPLTINKEEALQRPVAS
VKLQTVHSIPWTIFKYEAMQRPVAS

SEQ ID NO: 60454 - protein, 25 aa, synthetic construct
  source 1..25: note = Seed: VKLQTVHSIPLTINKEEALQRPVAS
VKLQTVHSIPWTIFKYEATQRPVAS

SEQ ID NO: 60455 - protein, 25 aa, synthetic construct
  source 1..25: note = Seed: VKLQTVHSIPLTINKEEALQRPVAS
VKLQTVHSIPWTIFKYEAVQRPVAS

SEQ ID NO: 60456 - protein, 25 aa, synthetic construct
  source 1..25: note = Seed: VKLQTVHSIPLTINKEEALQRPVAS
VKLQTVHSIPWTIFKYEAWQRPVAS

SEQ ID NO: 60457 - protein, 25 aa, synthetic construct
  source 1..25: note = Seed: VKLQTVHSIPLTINKEEALQRPVAS
VKLQTVHSIPWTIFKYEAYQRPVAS

SEQ ID NO: 60458 - protein, 25 aa, synthetic construct
  source 1..25: note = Seed: VKLQTVHSIPLTINKEEALQRPVAS
VKLQTVHSIPWTIGKFEALQRPVAS

SEQ ID NO: 60459 - protein, 25 aa, synthetic construct
  source 1..25: note = Seed: VKLQTVHSIPLTINKEEALQRPVAS
VKLQTVHSIPWTIHKFEAAQRPVAS

SEQ ID NO: 60460 - protein, 25 aa, synthetic construct
  source 1..25: note = Seed: VKLQTVHSIPLTINKEEALQRPVAS
VKLQTVHSIPWTIHKFEAFQRPVAS

SEQ ID NO: 60461 - protein, 25 aa, synthetic construct
  source 1..25: note = Seed: VKLQTVHSIPLTINKEEALQRPVAS
VKLQTVHSIPWTIHKFEAIQRPVAS

SEQ ID NO: 60462 - protein, 25 aa, synthetic construct
  source 1..25: note = Seed: VKLQTVHSIPLTINKEEALQRPVAS
VKLQTVHSIPWTIHKFEALQRPVAS

SEQ ID NO: 60463 - protein, 25 aa, synthetic construct
  source 1..25: note = Seed: VKLQTVHSIPLTINKEEALQRPVAS
VKLQTVHSIPWTIHKFEAMQRPVAS

SEQ ID NO: 60464 - protein, 25 aa, synthetic construct
  source 1..25: note = Seed: VKLQTVHSIPLTINKEEALQRPVAS
VKLQTVHSIPWTIHKFEASQRPVAS

SEQ ID NO: 60465 - protein, 25 aa, synthetic construct
  source 1..25: note = Seed: VKLQTVHSIPLTINKEEALQRPVAS
VKLQTVHSIPWTIHKFEATQRPVAS

SEQ ID NO: 60466 - protein, 25 aa, synthetic construct
  source 1..25: note = Seed: VKLQTVHSIPLTINKEEALQRPVAS
VKLQTVHSIPWTIHKFEAVQRPVAS

SEQ ID NO: 60467 - protein, 25 aa, synthetic construct
  source 1..25: note = Seed: VKLQTVHSIPLTINKEEALQRPVAS
VKLQTVHSIPWTIHKFEAYQRPVAS

SEQ ID NO: 60468 - protein, 25 aa, synthetic construct
  source 1..25: note = Seed: VKLQTVHSIPLTINKEEALQRPVAS
VKLQTVHSIPWTIHKLEAIQRPVAS

SEQ ID NO: 60469 - protein, 25 aa, synthetic construct
  source 1..25: note = Seed: VKLQTVHSIPLTINKEEALQRPVAS
VKLQTVHSIPWTIHKLEALQRPVAS

SEQ ID NO: 60470 - protein, 25 aa, synthetic construct
  source 1..25: note = Seed: VKLQTVHSIPLTINKEEALQRPVAS
VKLQTVHSIPWTIHKWEALQRPVAS

SEQ ID NO: 60471 - protein, 25 aa, synthetic construct
  source 1..25: note = Seed: VKLQTVHSIPLTINKEEALQRPVAS
VKLQTVHSIPWTIHKYEALQRPVAS

SEQ ID NO: 60472 - protein, 25 aa, synthetic construct
  source 1..25: note = Seed: VKLQTVHSIPLTINKEEALQRPVAS
VKLQTVHSIPWTIIKAEAFQRPVAS

SEQ ID NO: 60473 - protein, 25 aa, synthetic construct
  source 1..25: note = Seed: VKLQTVHSIPLTINKEEALQRPVAS
VKLQTVHSIPWTIIKAEAIQRPVAS

SEQ ID NO: 60474 - protein, 25 aa, synthetic construct
  source 1..25: note = Seed: VKLQTVHSIPLTINKEEALQRPVAS
VKLQTVHSIPWTIIKAEALQRPVAS

SEQ ID NO: 60475 - protein, 25 aa, synthetic construct
  source 1..25: note = Seed: VKLQTVHSIPLTINKEEALQRPVAS
VKLQTVHSIPWTIIKAEAVQRPVAS

SEQ ID NO: 60476 - protein, 25 aa, synthetic construct
  source 1..25: note = Seed: VKLQTVHSIPLTINKEEALQRPVAS
VKLQTVHSIPWTIIKFEAAQRPVAS

SEQ ID NO: 60477 - protein, 25 aa, synthetic construct
  source 1..25: note = Seed: VKLQTVHSIPLTINKEEALQRPVAS
VKLQTVHSIPWTIIKFEACQRPVAS

SEQ ID NO: 60478 - protein, 25 aa, synthetic construct
  source 1..25: note = Seed: VKLQTVHSIPLTINKEEALQRPVAS
VKLQTVHSIPWTIIKFEADQRPVAS

SEQ ID NO: 60479 - protein, 25 aa, synthetic construct
  source 1..25: note = Seed: VKLQTVHSIPLTINKEEALQRPVAS
VKLQTVHSIPWTIIKFEAEQRPVAS

SEQ ID NO: 60480 - protein, 25 aa, synthetic construct
  source 1..25: note = Seed: VKLQTVHSIPLTINKEEALQRPVAS
VKLQTVHSIPWTIIKFEAFQRPVAS

SEQ ID NO: 60481 - protein, 25 aa, synthetic construct
  source 1..25: note = Seed: VKLQTVHSIPLTINKEEALQRPVAS
VKLQTVHSIPWTIIKFEAGQRPVAS

SEQ ID NO: 60482 - protein, 25 aa, synthetic construct
  source 1..25: note = Seed: VKLQTVHSIPLTINKEEALQRPVAS
VKLQTVHSIPWTIIKFEAHQRPVAS

SEQ ID NO: 60483 - protein, 25 aa, synthetic construct
  source 1..25: note = Seed: VKLQTVHSIPLTINKEEALQRPVAS
VKLQTVHSIPWTIIKFEAIQRPVAS

SEQ ID NO: 60484 - protein, 25 aa, synthetic construct
  source 1..25: note = Seed: VKLQTVHSIPLTINKEEALQRPVAS
VKLQTVHSIPWTIIKFEAKQRPVAS

SEQ ID NO: 60485 - protein, 25 aa, synthetic construct
  source 1..25: note = Seed: VKLQTVHSIPLTINKEEALQRPVAS
VKLQTVHSIPWTIIKFEALQRPVAS

SEQ ID NO: 60486 - protein, 25 aa, synthetic construct
  source 1..25: note = Seed: VKLQTVHSIPLTINKEEALQRPVAS
VKLQTVHSIPWTIIKFEAMQRPVAS

SEQ ID NO: 60487 - protein, 25 aa, synthetic construct
  source 1..25: note = Seed: VKLQTVHSIPLTINKEEALQRPVAS
VKLQTVHSIPWTIIKFEANQRPVAS

SEQ ID NO: 60488 - protein, 25 aa, synthetic construct
  source 1..25: note = Seed: VKLQTVHSIPLTINKEEALQRPVAS
VKLQTVHSIPWTIIKFEAPQRPVAS

SEQ ID NO: 60489 - protein, 25 aa, synthetic construct
  source 1..25: note = Seed: VKLQTVHSIPLTINKEEALQRPVAS
VKLQTVHSIPWTIIKFEAQQRPVAS

SEQ ID NO: 60490 - protein, 25 aa, synthetic construct
  source 1..25: note = Seed: VKLQTVHSIPLTINKEEALQRPVAS
VKLQTVHSIPWTIIKFEARQRPVAS

SEQ ID NO: 60491 - protein, 25 aa, synthetic construct
  source 1..25: note = Seed: VKLQTVHSIPLTINKEEALQRPVAS
VKLQTVHSIPWTIIKFEASQRPVAS

SEQ ID NO: 60492 - protein, 25 aa, synthetic construct
  source 1..25: note = Seed: VKLQTVHSIPLTINKEEALQRPVAS
VKLQTVHSIPWTIIKFEATQRPVAS

SEQ ID NO: 60493 - protein, 25 aa, synthetic construct
  source 1..25: note = Seed: VKLQTVHSIPLTINKEEALQRPVAS
VKLQTVHSIPWTIIKFEAVQRPVAS

SEQ ID NO: 60494 - protein, 25 aa, synthetic construct
  source 1..25: note = Seed: VKLQTVHSIPLTINKEEALQRPVAS
VKLQTVHSIPWTIIKFEAWQRPVAS

SEQ ID NO: 60495 - protein, 25 aa, synthetic construct
  source 1..25: note = Seed: VKLQTVHSIPLTINKEEALQRPVAS
VKLQTVHSIPWTIIKFEAYQRPVAS

SEQ ID NO: 60496 - protein, 25 aa, synthetic construct
  source 1..25: note = Seed: VKLQTVHSIPLTINKEEALQRPVAS
VKLQTVHSIPWTIIKIEAFQRPVAS

SEQ ID NO: 60497 - protein, 25 aa, synthetic construct
  source 1..25: note = Seed: VKLQTVHSIPLTINKEEALQRPVAS
VKLQTVHSIPWTIIKIEAIQRPVAS

SEQ ID NO: 60498 - protein, 25 aa, synthetic construct
  source 1..25: note = Seed: VKLQTVHSIPLTINKEEALQRPVAS
VKLQTVHSIPWTIIKIEALQRPVAS

SEQ ID NO: 60499 - protein, 25 aa, synthetic construct
  source 1..25: note = Seed: VKLQTVHSIPLTINKEEALQRPVAS
VKLQTVHSIPWTIIKIEAMQRPVAS

SEQ ID NO: 60500 - protein, 25 aa, synthetic construct
  source 1..25: note = Seed: VKLQTVHSIPLTINKEEALQRPVAS
VKLQTVHSIPWTIIKIEAVQRPVAS

SEQ ID NO: 60501 - protein, 25 aa, synthetic construct
  source 1..25: note = Seed: VKLQTVHSIPLTINKEEALQRPVAS
VKLQTVHSIPWTIIKIEAYQRPVAS

SEQ ID NO: 60502 - protein, 25 aa, synthetic construct
  source 1..25: note = Seed: VKLQTVHSIPLTINKEEALQRPVAS
VKLQTVHSIPWTIIKLEAAQRPVAS

SEQ ID NO: 60503 - protein, 25 aa, synthetic construct
  source 1..25: note = Seed: VKLQTVHSIPLTINKEEALQRPVAS
VKLQTVHSIPWTIIKLEADQRPVAS

SEQ ID NO: 60504 - protein, 25 aa, synthetic construct
  source 1..25: note = Seed: VKLQTVHSIPLTINKEEALQRPVAS
VKLQTVHSIPWTIIKLEAEQRPVAS

SEQ ID NO: 60505 - protein, 25 aa, synthetic construct
  source 1..25: note = Seed: VKLQTVHSIPLTINKEEALQRPVAS
VKLQTVHSIPWTIIKLEAFQRPVAS

SEQ ID NO: 60506 - protein, 25 aa, synthetic construct
  source 1..25: note = Seed: VKLQTVHSIPLTINKEEALQRPVAS
VKLQTVHSIPWTIIKLEAHQRPVAS

SEQ ID NO: 60507 - protein, 25 aa, synthetic construct
  source 1..25: note = Seed: VKLQTVHSIPLTINKEEALQRPVAS
VKLQTVHSIPWTIIKLEAIQRPVAS

SEQ ID NO: 60508 - protein, 25 aa, synthetic construct
  source 1..25: note = Seed: VKLQTVHSIPLTINKEEALQRPVAS
VKLQTVHSIPWTIIKLEALQRPVAS

SEQ ID NO: 60509 - protein, 25 aa, synthetic construct
  source 1..25: note = Seed: VKLQTVHSIPLTINKEEALQRPVAS
VKLQTVHSIPWTIIKLEAMQRPVAS

SEQ ID NO: 60510 - protein, 25 aa, synthetic construct
  source 1..25: note = Seed: VKLQTVHSIPLTINKEEALQRPVAS
VKLQTVHSIPWTIIKLEANQRPVAS

SEQ ID NO: 60511 - protein, 25 aa, synthetic construct
  source 1..25: note = Seed: VKLQTVHSIPLTINKEEALQRPVAS
VKLQTVHSIPWTIIKLEAQQRPVAS

SEQ ID NO: 60512 - protein, 25 aa, synthetic construct
  source 1..25: note = Seed: VKLQTVHSIPLTINKEEALQRPVAS
VKLQTVHSIPWTIIKLEARQRPVAS

SEQ ID NO: 60513 - protein, 25 aa, synthetic construct
  source 1..25: note = Seed: VKLQTVHSIPLTINKEEALQRPVAS
VKLQTVHSIPWTIIKLEASQRPVAS

SEQ ID NO: 60514 - protein, 25 aa, synthetic construct
  source 1..25: note = Seed: VKLQTVHSIPLTINKEEALQRPVAS
VKLQTVHSIPWTIIKLEATQRPVAS

SEQ ID NO: 60515 - protein, 25 aa, synthetic construct
  source 1..25: note = Seed: VKLQTVHSIPLTINKEEALQRPVAS
VKLQTVHSIPWTIIKLEAVQRPVAS

SEQ ID NO: 60516 - protein, 25 aa, synthetic construct
  source 1..25: note = Seed: VKLQTVHSIPLTINKEEALQRPVAS
VKLQTVHSIPWTIIKLEAYQRPVAS

SEQ ID NO: 60517 - protein, 25 aa, synthetic construct
  source 1..25: note = Seed: VKLQTVHSIPLTINKEEALQRPVAS
VKLQTVHSIPWTIIKMEAFQRPVAS

SEQ ID NO: 60518 - protein, 25 aa, synthetic construct
  source 1..25: note = Seed: VKLQTVHSIPLTINKEEALQRPVAS
VKLQTVHSIPWTIIKMEAIQRPVAS

SEQ ID NO: 60519 - protein, 25 aa, synthetic construct
  source 1..25: note = Seed: VKLQTVHSIPLTINKEEALQRPVAS
VKLQTVHSIPWTIIKMEALQRPVAS

SEQ ID NO: 60520 - protein, 25 aa, synthetic construct
  source 1..25: note = Seed: VKLQTVHSIPLTINKEEALQRPVAS
VKLQTVHSIPWTIIKMEAMQRPVAS

SEQ ID NO: 60521 - protein, 25 aa, synthetic construct
  source 1..25: note = Seed: VKLQTVHSIPLTINKEEALQRPVAS
VKLQTVHSIPWTIIKMEAVQRPVAS

SEQ ID NO: 60522 - protein, 25 aa, synthetic construct
  source 1..25: note = Seed: VKLQTVHSIPLTINKEEALQRPVAS
VKLQTVHSIPWTIIKMEAYQRPVAS

SEQ ID NO: 60523 - protein, 25 aa, synthetic construct
  source 1..25: note = Seed: VKLQTVHSIPLTINKEEALQRPVAS
VKLQTVHSIPWTIIKNEADQRPVAS

SEQ ID NO: 60524 - protein, 25 aa, synthetic construct
  source 1..25: note = Seed: VKLQTVHSIPLTINKEEALQRPVAS
VKLQTVHSIPWTIIKVEAFQRPVAS

SEQ ID NO: 60525 - protein, 25 aa, synthetic construct
  source 1..25: note = Seed: VKLQTVHSIPLTINKEEALQRPVAS
VKLQTVHSIPWTIIKVEAIQRPVAS

SEQ ID NO: 60526 - protein, 25 aa, synthetic construct
  source 1..25: note = Seed: VKLQTVHSIPLTINKEEALQRPVAS
VKLQTVHSIPWTIIKVEALQRPVAS

SEQ ID NO: 60527 - protein, 25 aa, synthetic construct
  source 1..25: note = Seed: VKLQTVHSIPLTINKEEALQRPVAS
VKLQTVHSIPWTIIKVEAMQRPVAS

SEQ ID NO: 60528 - protein, 25 aa, synthetic construct
  source 1..25: note = Seed: VKLQTVHSIPLTINKEEALQRPVAS
VKLQTVHSIPWTIIKVEAVQRPVAS

SEQ ID NO: 60529 - protein, 25 aa, synthetic construct
  source 1..25: note = Seed: VKLQTVHSIPLTINKEEALQRPVAS
VKLQTVHSIPWTIIKVEAYQRPVAS

SEQ ID NO: 60530 - protein, 25 aa, synthetic construct
  source 1..25: note = Seed: VKLQTVHSIPLTINKEEALQRPVAS
VKLQTVHSIPWTIIKWEAAQRPVAS

SEQ ID NO: 60531 - protein, 25 aa, synthetic construct
  source 1..25: note = Seed: VKLQTVHSIPLTINKEEALQRPVAS
VKLQTVHSIPWTIIKWEAFQRPVAS

SEQ ID NO: 60532 - protein, 25 aa, synthetic construct
  source 1..25: note = Seed: VKLQTVHSIPLTINKEEALQRPVAS
VKLQTVHSIPWTIIKWEAIQRPVAS

SEQ ID NO: 60533 - protein, 25 aa, synthetic construct
  source 1..25: note = Seed: VKLQTVHSIPLTINKEEALQRPVAS
VKLQTVHSIPWTIIKWEALQRPVAS

SEQ ID NO: 60534 - protein, 25 aa, synthetic construct
  source 1..25: note = Seed: VKLQTVHSIPLTINKEEALQRPVAS
VKLQTVHSIPWTIIKWEAMQRPVAS

SEQ ID NO: 60535 - protein, 25 aa, synthetic construct
  source 1..25: note = Seed: VKLQTVHSIPLTINKEEALQRPVAS
VKLQTVHSIPWTIIKWEATQRPVAS

SEQ ID NO: 60536 - protein, 25 aa, synthetic construct
  source 1..25: note = Seed: VKLQTVHSIPLTINKEEALQRPVAS
VKLQTVHSIPWTIIKWEAVQRPVAS

SEQ ID NO: 60537 - protein, 25 aa, synthetic construct
  source 1..25: note = Seed: VKLQTVHSIPLTINKEEALQRPVAS
VKLQTVHSIPWTIIKWEAYQRPVAS

SEQ ID NO: 60538 - protein, 25 aa, synthetic construct
  source 1..25: note = Seed: VKLQTVHSIPLTINKEEALQRPVAS
VKLQTVHSIPWTIIKYEAAQRPVAS

SEQ ID NO: 60539 - protein, 25 aa, synthetic construct
  source 1..25: note = Seed: VKLQTVHSIPLTINKEEALQRPVAS
VKLQTVHSIPWTIIKYEADQRPVAS

SEQ ID NO: 60540 - protein, 25 aa, synthetic construct
  source 1..25: note = Seed: VKLQTVHSIPLTINKEEALQRPVAS
VKLQTVHSIPWTIIKYEAEQRPVAS

SEQ ID NO: 60541 - protein, 25 aa, synthetic construct
  source 1..25: note = Seed: VKLQTVHSIPLTINKEEALQRPVAS
VKLQTVHSIPWTIIKYEAFQRPVAS

SEQ ID NO: 60542 - protein, 25 aa, synthetic construct
  source 1..25: note = Seed: VKLQTVHSIPLTINKEEALQRPVAS
VKLQTVHSIPWTIIKYEAHQRPVAS

SEQ ID NO: 60543 - protein, 25 aa, synthetic construct
  source 1..25: note = Seed: VKLQTVHSIPLTINKEEALQRPVAS
VKLQTVHSIPWTIIKYEAIQRPVAS

SEQ ID NO: 60544 - protein, 25 aa, synthetic construct
  source 1..25: note = Seed: VKLQTVHSIPLTINKEEALQRPVAS
VKLQTVHSIPWTIIKYEALQRPVAS

SEQ ID NO: 60545 - protein, 25 aa, synthetic construct
  source 1..25: note = Seed: VKLQTVHSIPLTINKEEALQRPVAS
VKLQTVHSIPWTIIKYEAMQRPVAS

SEQ ID NO: 60546 - protein, 25 aa, synthetic construct
  source 1..25: note = Seed: VKLQTVHSIPLTINKEEALQRPVAS
VKLQTVHSIPWTIIKYEANQRPVAS

SEQ ID NO: 60547 - protein, 25 aa, synthetic construct
  source 1..25: note = Seed: VKLQTVHSIPLTINKEEALQRPVAS
VKLQTVHSIPWTIIKYEARQRPVAS

SEQ ID NO: 60548 - protein, 25 aa, synthetic construct
  source 1..25: note = Seed: VKLQTVHSIPLTINKEEALQRPVAS
VKLQTVHSIPWTIIKYEASQRPVAS

SEQ ID NO: 60549 - protein, 25 aa, synthetic construct
  source 1..25: note = Seed: VKLQTVHSIPLTINKEEALQRPVAS
VKLQTVHSIPWTIIKYEATQRPVAS

SEQ ID NO: 60550 - protein, 25 aa, synthetic construct
  source 1..25: note = Seed: VKLQTVHSIPLTINKEEALQRPVAS
VKLQTVHSIPWTIIKYEAVQRPVAS

SEQ ID NO: 60551 - protein, 25 aa, synthetic construct
  source 1..25: note = Seed: VKLQTVHSIPLTINKEEALQRPVAS
VKLQTVHSIPWTIIKYEAWQRPVAS

SEQ ID NO: 60552 - protein, 25 aa, synthetic construct
  source 1..25: note = Seed: VKLQTVHSIPLTINKEEALQRPVAS
VKLQTVHSIPWTIIKYEAYQRPVAS

SEQ ID NO: 60553 - protein, 25 aa, synthetic construct
  source 1..25: note = Seed: VKLQTVHSIPLTINKEEALQRPVAS
VKLQTVHSIPWTIKKFEAFQRPVAS

SEQ ID NO: 60554 - protein, 25 aa, synthetic construct
  source 1..25: note = Seed: VKLQTVHSIPLTINKEEALQRPVAS
VKLQTVHSIPWTIKKFEAIQRPVAS

SEQ ID NO: 60555 - protein, 25 aa, synthetic construct
  source 1..25: note = Seed: VKLQTVHSIPLTINKEEALQRPVAS
VKLQTVHSIPWTIKKFEALQRPVAS

SEQ ID NO: 60556 - protein, 25 aa, synthetic construct
  source 1..25: note = Seed: VKLQTVHSIPLTINKEEALQRPVAS
VKLQTVHSIPWTIKKFEAVQRPVAS

SEQ ID NO: 60557 - protein, 25 aa, synthetic construct
  source 1..25: note = Seed: VKLQTVHSIPLTINKEEALQRPVAS
VKLQTVHSIPWTILKAEAFQRPVAS

SEQ ID NO: 60558 - protein, 25 aa, synthetic construct
  source 1..25: note = Seed: VKLQTVHSIPLTINKEEALQRPVAS
VKLQTVHSIPWTILKAEAIQRPVAS

SEQ ID NO: 60559 - protein, 25 aa, synthetic construct
  source 1..25: note = Seed: VKLQTVHSIPLTINKEEALQRPVAS
VKLQTVHSIPWTILKAEALQRPVAS

SEQ ID NO: 60560 - protein, 25 aa, synthetic construct
  source 1..25: note = Seed: VKLQTVHSIPLTINKEEALQRPVAS
VKLQTVHSIPWTILKFEAAQRPVAS

SEQ ID NO: 60561 - protein, 25 aa, synthetic construct
  source 1..25: note = Seed: VKLQTVHSIPLTINKEEALQRPVAS
VKLQTVHSIPWTILKFEACQRPVAS

SEQ ID NO: 60562 - protein, 25 aa, synthetic construct
  source 1..25: note = Seed: VKLQTVHSIPLTINKEEALQRPVAS
VKLQTVHSIPWTILKFEADQRPVAS

SEQ ID NO: 60563 - protein, 25 aa, synthetic construct
  source 1..25: note = Seed: VKLQTVHSIPLTINKEEALQRPVAS
VKLQTVHSIPWTILKFEAEQRPVAS

SEQ ID NO: 60564 - protein, 25 aa, synthetic construct
  source 1..25: note = Seed: VKLQTVHSIPLTINKEEALQRPVAS
VKLQTVHSIPWTILKFEAFQRPVAS

SEQ ID NO: 60565 - protein, 25 aa, synthetic construct
  source 1..25: note = Seed: VKLQTVHSIPLTINKEEALQRPVAS
VKLQTVHSIPWTILKFEAGQRPVAS

SEQ ID NO: 60566 - protein, 25 aa, synthetic construct
  source 1..25: note = Seed: VKLQTVHSIPLTINKEEALQRPVAS
VKLQTVHSIPWTILKFEAHQRPVAS

SEQ ID NO: 60567 - protein, 25 aa, synthetic construct
  source 1..25: note = Seed: VKLQTVHSIPLTINKEEALQRPVAS
VKLQTVHSIPWTILKFEAIQRPVAS

SEQ ID NO: 60568 - protein, 25 aa, synthetic construct
  source 1..25: note = Seed: VKLQTVHSIPLTINKEEALQRPVAS
VKLQTVHSIPWTILKFEAKQRPVAS

SEQ ID NO: 60569 - protein, 25 aa, synthetic construct
  source 1..25: note = Seed: VKLQTVHSIPLTINKEEALQRPVAS
VKLQTVHSIPWTILKFEALQRPVAS

SEQ ID NO: 60570 - protein, 25 aa, synthetic construct
  source 1..25: note = Seed: VKLQTVHSIPLTINKEEALQRPVAS
VKLQTVHSIPWTILKFEAMQRPVAS

SEQ ID NO: 60571 - protein, 25 aa, synthetic construct
  source 1..25: note = Seed: VKLQTVHSIPLTINKEEALQRPVAS
VKLQTVHSIPWTILKFEANQRPVAS

SEQ ID NO: 60572 - protein, 25 aa, synthetic construct
  source 1..25: note = Seed: VKLQTVHSIPLTINKEEALQRPVAS
VKLQTVHSIPWTILKFEAPQRPVAS

SEQ ID NO: 60573 - protein, 25 aa, synthetic construct
  source 1..25: note = Seed: VKLQTVHSIPLTINKEEALQRPVAS
VKLQTVHSIPWTILKFEAQQRPVAS

SEQ ID NO: 60574 - protein, 25 aa, synthetic construct
  source 1..25: note = Seed: VKLQTVHSIPLTINKEEALQRPVAS
VKLQTVHSIPWTILKFEARQRPVAS

SEQ ID NO: 60575 - protein, 25 aa, synthetic construct
  source 1..25: note = Seed: VKLQTVHSIPLTINKEEALQRPVAS
VKLQTVHSIPWTILKFEASQRPVAS

SEQ ID NO: 60576 - protein, 25 aa, synthetic construct
  source 1..25: note = Seed: VKLQTVHSIPLTINKEEALQRPVAS
VKLQTVHSIPWTILKFEATQRPVAS

SEQ ID NO: 60577 - protein, 25 aa, synthetic construct
  source 1..25: note = Seed: VKLQTVHSIPLTINKEEALQRPVAS
VKLQTVHSIPWTILKFEAVQRPVAS

SEQ ID NO: 60578 - protein, 25 aa, synthetic construct
  source 1..25: note = Seed: VKLQTVHSIPLTINKEEALQRPVAS
VKLQTVHSIPWTILKFEAWQRPVAS

SEQ ID NO: 60579 - protein, 25 aa, synthetic construct
  source 1..25: note = Seed: VKLQTVHSIPLTINKEEALQRPVAS
VKLQTVHSIPWTILKFEAYQRPVAS

SEQ ID NO: 60580 - protein, 25 aa, synthetic construct
  source 1..25: note = Seed: VKLQTVHSIPLTINKEEALQRPVAS
VKLQTVHSIPWTILKHEAFQRPVAS

SEQ ID NO: 60581 - protein, 25 aa, synthetic construct
  source 1..25: note = Seed: VKLQTVHSIPLTINKEEALQRPVAS
VKLQTVHSIPWTILKIEAAQRPVAS

SEQ ID NO: 60582 - protein, 25 aa, synthetic construct
  source 1..25: note = Seed: VKLQTVHSIPLTINKEEALQRPVAS
VKLQTVHSIPWTILKIEAFQRPVAS

SEQ ID NO: 60583 - protein, 25 aa, synthetic construct
  source 1..25: note = Seed: VKLQTVHSIPLTINKEEALQRPVAS
VKLQTVHSIPWTILKIEAIQRPVAS

SEQ ID NO: 60584 - protein, 25 aa, synthetic construct
  source 1..25: note = Seed: VKLQTVHSIPLTINKEEALQRPVAS
VKLQTVHSIPWTILKIEALQRPVAS

SEQ ID NO: 60585 - protein, 25 aa, synthetic construct
  source 1..25: note = Seed: VKLQTVHSIPLTINKEEALQRPVAS
VKLQTVHSIPWTILKIEAMQRPVAS

SEQ ID NO: 60586 - protein, 25 aa, synthetic construct
  source 1..25: note = Seed: VKLQTVHSIPLTINKEEALQRPVAS
VKLQTVHSIPWTILKIEANQRPVAS

SEQ ID NO: 60587 - protein, 25 aa, synthetic construct
  source 1..25: note = Seed: VKLQTVHSIPLTINKEEALQRPVAS
VKLQTVHSIPWTILKIEASQRPVAS

SEQ ID NO: 60588 - protein, 25 aa, synthetic construct
  source 1..25: note = Seed: VKLQTVHSIPLTINKEEALQRPVAS
VKLQTVHSIPWTILKIEATQRPVAS

SEQ ID NO: 60589 - protein, 25 aa, synthetic construct
  source 1..25: note = Seed: VKLQTVHSIPLTINKEEALQRPVAS
VKLQTVHSIPWTILKIEAVQRPVAS

SEQ ID NO: 60590 - protein, 25 aa, synthetic construct
  source 1..25: note = Seed: VKLQTVHSIPLTINKEEALQRPVAS
VKLQTVHSIPWTILKIEAYQRPVAS

SEQ ID NO: 60591 - protein, 25 aa, synthetic construct
  source 1..25: note = Seed: VKLQTVHSIPLTINKEEALQRPVAS
VKLQTVHSIPWTILKLEAAQRPVAS

SEQ ID NO: 60592 - protein, 25 aa, synthetic construct
  source 1..25: note = Seed: VKLQTVHSIPLTINKEEALQRPVAS
VKLQTVHSIPWTILKLEADQRPVAS

SEQ ID NO: 60593 - protein, 25 aa, synthetic construct
  source 1..25: note = Seed: VKLQTVHSIPLTINKEEALQRPVAS
VKLQTVHSIPWTILKLEAEQRPVAS

SEQ ID NO: 60594 - protein, 25 aa, synthetic construct
  source 1..25: note = Seed: VKLQTVHSIPLTINKEEALQRPVAS
VKLQTVHSIPWTILKLEAFQRPVAS

SEQ ID NO: 60595 - protein, 25 aa, synthetic construct
  source 1..25: note = Seed: VKLQTVHSIPLTINKEEALQRPVAS
VKLQTVHSIPWTILKLEAHQRPVAS

SEQ ID NO: 60596 - protein, 25 aa, synthetic construct
  source 1..25: note = Seed: VKLQTVHSIPLTINKEEALQRPVAS
VKLQTVHSIPWTILKLEAIQRPVAS

SEQ ID NO: 60597 - protein, 25 aa, synthetic construct
  source 1..25: note = Seed: VKLQTVHSIPLTINKEEALQRPVAS
VKLQTVHSIPWTILKLEALQRPVAS

SEQ ID NO: 60598 - protein, 25 aa, synthetic construct
  source 1..25: note = Seed: VKLQTVHSIPLTINKEEALQRPVAS
VKLQTVHSIPWTILKLEAMQRPVAS

SEQ ID NO: 60599 - protein, 25 aa, synthetic construct
  source 1..25: note = Seed: VKLQTVHSIPLTINKEEALQRPVAS
VKLQTVHSIPWTILKLEANQRPVAS

SEQ ID NO: 60600 - protein, 25 aa, synthetic construct
  source 1..25: note = Seed: VKLQTVHSIPLTINKEEALQRPVAS
VKLQTVHSIPWTILKLEAQQRPVAS

SEQ ID NO: 60601 - protein, 25 aa, synthetic construct
  source 1..25: note = Seed: VKLQTVHSIPLTINKEEALQRPVAS
VKLQTVHSIPWTILKLEARQRPVAS

SEQ ID NO: 60602 - protein, 25 aa, synthetic construct
  source 1..25: note = Seed: VKLQTVHSIPLTINKEEALQRPVAS
VKLQTVHSIPWTILKLEASQRPVAS

SEQ ID NO: 60603 - protein, 25 aa, synthetic construct
  source 1..25: note = Seed: VKLQTVHSIPLTINKEEALQRPVAS
VKLQTVHSIPWTILKLEATQRPVAS

SEQ ID NO: 60604 - protein, 25 aa, synthetic construct
  source 1..25: note = Seed: VKLQTVHSIPLTINKEEALQRPVAS
VKLQTVHSIPWTILKLEAVQRPVAS

SEQ ID NO: 60605 - protein, 25 aa, synthetic construct
  source 1..25: note = Seed: VKLQTVHSIPLTINKEEALQRPVAS
VKLQTVHSIPWTILKLEAYQRPVAS

SEQ ID NO: 60606 - protein, 25 aa, synthetic construct
  source 1..25: note = Seed: VKLQTVHSIPLTINKEEALQRPVAS
VKLQTVHSIPWTILKMEAFQRPVAS

SEQ ID NO: 60607 - protein, 25 aa, synthetic construct
  source 1..25: note = Seed: VKLQTVHSIPLTINKEEALQRPVAS
VKLQTVHSIPWTILKMEAIQRPVAS

SEQ ID NO: 60608 - protein, 25 aa, synthetic construct
  source 1..25: note = Seed: VKLQTVHSIPLTINKEEALQRPVAS
VKLQTVHSIPWTILKMEALQRPVAS

SEQ ID NO: 60609 - protein, 25 aa, synthetic construct
  source 1..25: note = Seed: VKLQTVHSIPLTINKEEALQRPVAS
VKLQTVHSIPWTILKMEAMQRPVAS

SEQ ID NO: 60610 - protein, 25 aa, synthetic construct
  source 1..25: note = Seed: VKLQTVHSIPLTINKEEALQRPVAS
VKLQTVHSIPWTILKMEAVQRPVAS

SEQ ID NO: 60611 - protein, 25 aa, synthetic construct
  source 1..25: note = Seed: VKLQTVHSIPLTINKEEALQRPVAS
VKLQTVHSIPWTILKMEAYQRPVAS

SEQ ID NO: 60612 - protein, 25 aa, synthetic construct
  source 1..25: note = Seed: VKLQTVHSIPLTINKEEALQRPVAS
VKLQTVHSIPWTILKVEAFQRPVAS

SEQ ID NO: 60613 - protein, 25 aa, synthetic construct
  source 1..25: note = Seed: VKLQTVHSIPLTINKEEALQRPVAS
VKLQTVHSIPWTILKVEAIQRPVAS

SEQ ID NO: 60614 - protein, 25 aa, synthetic construct
  source 1..25: note = Seed: VKLQTVHSIPLTINKEEALQRPVAS
VKLQTVHSIPWTILKVEALQRPVAS

SEQ ID NO: 60615 - protein, 25 aa, synthetic construct
  source 1..25: note = Seed: VKLQTVHSIPLTINKEEALQRPVAS
VKLQTVHSIPWTILKVEAMQRPVAS

SEQ ID NO: 60616 - protein, 25 aa, synthetic construct
  source 1..25: note = Seed: VKLQTVHSIPLTINKEEALQRPVAS
VKLQTVHSIPWTILKVEAVQRPVAS

SEQ ID NO: 60617 - protein, 25 aa, synthetic construct
  source 1..25: note = Seed: VKLQTVHSIPLTINKEEALQRPVAS
VKLQTVHSIPWTILKVEAYQRPVAS

SEQ ID NO: 60618 - protein, 25 aa, synthetic construct
  source 1..25: note = Seed: VKLQTVHSIPLTINKEEALQRPVAS
VKLQTVHSIPWTILKWEAFQRPVAS

SEQ ID NO: 60619 - protein, 25 aa, synthetic construct
  source 1..25: note = Seed: VKLQTVHSIPLTINKEEALQRPVAS
VKLQTVHSIPWTILKWEAIQRPVAS

SEQ ID NO: 60620 - protein, 25 aa, synthetic construct
  source 1..25: note = Seed: VKLQTVHSIPLTINKEEALQRPVAS
VKLQTVHSIPWTILKWEALQRPVAS

SEQ ID NO: 60621 - protein, 25 aa, synthetic construct
  source 1..25: note = Seed: VKLQTVHSIPLTINKEEALQRPVAS
VKLQTVHSIPWTILKWEAMQRPVAS

SEQ ID NO: 60622 - protein, 25 aa, synthetic construct
  source 1..25: note = Seed: VKLQTVHSIPLTINKEEALQRPVAS
VKLQTVHSIPWTILKWEAVQRPVAS

SEQ ID NO: 60623 - protein, 25 aa, synthetic construct
  source 1..25: note = Seed: VKLQTVHSIPLTINKEEALQRPVAS
VKLQTVHSIPWTILKWEAYQRPVAS

SEQ ID NO: 60624 - protein, 25 aa, synthetic construct
  source 1..25: note = Seed: VKLQTVHSIPLTINKEEALQRPVAS
VKLQTVHSIPWTILKYEAAQRPVAS

SEQ ID NO: 60625 - protein, 25 aa, synthetic construct
  source 1..25: note = Seed: VKLQTVHSIPLTINKEEALQRPVAS
VKLQTVHSIPWTILKYEAFQRPVAS

SEQ ID NO: 60626 - protein, 25 aa, synthetic construct
  source 1..25: note = Seed: VKLQTVHSIPLTINKEEALQRPVAS
VKLQTVHSIPWTILKYEAIQRPVAS

SEQ ID NO: 60627 - protein, 25 aa, synthetic construct
  source 1..25: note = Seed: VKLQTVHSIPLTINKEEALQRPVAS
VKLQTVHSIPWTILKYEALQRPVAS

SEQ ID NO: 60628 - protein, 25 aa, synthetic construct
  source 1..25: note = Seed: VKLQTVHSIPLTINKEEALQRPVAS
VKLQTVHSIPWTILKYEAMQRPVAS

SEQ ID NO: 60629 - protein, 25 aa, synthetic construct
  source 1..25: note = Seed: VKLQTVHSIPLTINKEEALQRPVAS
VKLQTVHSIPWTILKYEASQRPVAS

SEQ ID NO: 60630 - protein, 25 aa, synthetic construct
  source 1..25: note = Seed: VKLQTVHSIPLTINKEEALQRPVAS
VKLQTVHSIPWTILKYEATQRPVAS

SEQ ID NO: 60631 - protein, 25 aa, synthetic construct
  source 1..25: note = Seed: VKLQTVHSIPLTINKEEALQRPVAS
VKLQTVHSIPWTILKYEAVQRPVAS

SEQ ID NO: 60632 - protein, 25 aa, synthetic construct
  source 1..25: note = Seed: VKLQTVHSIPLTINKEEALQRPVAS
VKLQTVHSIPWTILKYEAYQRPVAS

SEQ ID NO: 60633 - protein, 25 aa, synthetic construct
  source 1..25: note = Seed: VKLQTVHSIPLTINKEEALQRPVAS
VKLQTVHSIPWTIMKAEAIQRPVAS

SEQ ID NO: 60634 - protein, 25 aa, synthetic construct
  source 1..25: note = Seed: VKLQTVHSIPLTINKEEALQRPVAS
VKLQTVHSIPWTIMKAEALQRPVAS

SEQ ID NO: 60635 - protein, 25 aa, synthetic construct
  source 1..25: note = Seed: VKLQTVHSIPLTINKEEALQRPVAS
VKLQTVHSIPWTIMKAEAVQRPVAS

SEQ ID NO: 60636 - protein, 25 aa, synthetic construct
  source 1..25: note = Seed: VKLQTVHSIPLTINKEEALQRPVAS
VKLQTVHSIPWTIMKFEAAQRPVAS

SEQ ID NO: 60637 - protein, 25 aa, synthetic construct
  source 1..25: note = Seed: VKLQTVHSIPLTINKEEALQRPVAS
VKLQTVHSIPWTIMKFEADQRPVAS

SEQ ID NO: 60638 - protein, 25 aa, synthetic construct
  source 1..25: note = Seed: VKLQTVHSIPLTINKEEALQRPVAS
VKLQTVHSIPWTIMKFEAEQRPVAS

SEQ ID NO: 60639 - protein, 25 aa, synthetic construct
  source 1..25: note = Seed: VKLQTVHSIPLTINKEEALQRPVAS
VKLQTVHSIPWTIMKFEAFQRPVAS

SEQ ID NO: 60640 - protein, 25 aa, synthetic construct
  source 1..25: note = Seed: VKLQTVHSIPLTINKEEALQRPVAS
VKLQTVHSIPWTIMKFEAHQRPVAS

SEQ ID NO: 60641 - protein, 25 aa, synthetic construct
  source 1..25: note = Seed: VKLQTVHSIPLTINKEEALQRPVAS
VKLQTVHSIPWTIMKFEAIQRPVAS

SEQ ID NO: 60642 - protein, 25 aa, synthetic construct
  source 1..25: note = Seed: VKLQTVHSIPLTINKEEALQRPVAS
VKLQTVHSIPWTIMKFEALQRPVAS

SEQ ID NO: 60643 - protein, 25 aa, synthetic construct
  source 1..25: note = Seed: VKLQTVHSIPLTINKEEALQRPVAS
VKLQTVHSIPWTIMKFEAMQRPVAS

SEQ ID NO: 60644 - protein, 25 aa, synthetic construct
  source 1..25: note = Seed: VKLQTVHSIPLTINKEEALQRPVAS
VKLQTVHSIPWTIMKFEANQRPVAS

SEQ ID NO: 60645 - protein, 25 aa, synthetic construct
  source 1..25: note = Seed: VKLQTVHSIPLTINKEEALQRPVAS
VKLQTVHSIPWTIMKFEARQRPVAS

SEQ ID NO: 60646 - protein, 25 aa, synthetic construct
  source 1..25: note = Seed: VKLQTVHSIPLTINKEEALQRPVAS
VKLQTVHSIPWTIMKFEASQRPVAS

SEQ ID NO: 60647 - protein, 25 aa, synthetic construct
  source 1..25: note = Seed: VKLQTVHSIPLTINKEEALQRPVAS
VKLQTVHSIPWTIMKFEATQRPVAS

SEQ ID NO: 60648 - protein, 25 aa, synthetic construct
  source 1..25: note = Seed: VKLQTVHSIPLTINKEEALQRPVAS
VKLQTVHSIPWTIMKFEAVQRPVAS

SEQ ID NO: 60649 - protein, 25 aa, synthetic construct
  source 1..25: note = Seed: VKLQTVHSIPLTINKEEALQRPVAS
VKLQTVHSIPWTIMKFEAWQRPVAS

SEQ ID NO: 60650 - protein, 25 aa, synthetic construct
  source 1..25: note = Seed: VKLQTVHSIPLTINKEEALQRPVAS
VKLQTVHSIPWTIMKFEAYQRPVAS

SEQ ID NO: 60651 - protein, 25 aa, synthetic construct
  source 1..25: note = Seed: VKLQTVHSIPLTINKEEALQRPVAS
VKLQTVHSIPWTIMKIEAAQRPVAS

SEQ ID NO: 60652 - protein, 25 aa, synthetic construct
  source 1..25: note = Seed: VKLQTVHSIPLTINKEEALQRPVAS
VKLQTVHSIPWTIMKIEAFQRPVAS

SEQ ID NO: 60653 - protein, 25 aa, synthetic construct
  source 1..25: note = Seed: VKLQTVHSIPLTINKEEALQRPVAS
VKLQTVHSIPWTIMKIEAIQRPVAS

SEQ ID NO: 60654 - protein, 25 aa, synthetic construct
  source 1..25: note = Seed: VKLQTVHSIPLTINKEEALQRPVAS
VKLQTVHSIPWTIMKIEALQRPVAS

SEQ ID NO: 60655 - protein, 25 aa, synthetic construct
  source 1..25: note = Seed: VKLQTVHSIPLTINKEEALQRPVAS
VKLQTVHSIPWTIMKIEAMQRPVAS

SEQ ID NO: 60656 - protein, 25 aa, synthetic construct
  source 1..25: note = Seed: VKLQTVHSIPLTINKEEALQRPVAS
VKLQTVHSIPWTIMKIEAVQRPVAS

SEQ ID NO: 60657 - protein, 25 aa, synthetic construct
  source 1..25: note = Seed: VKLQTVHSIPLTINKEEALQRPVAS
VKLQTVHSIPWTIMKIEAYQRPVAS

SEQ ID NO: 60658 - protein, 25 aa, synthetic construct
  source 1..25: note = Seed: VKLQTVHSIPLTINKEEALQRPVAS
VKLQTVHSIPWTIMKLEAFQRPVAS

SEQ ID NO: 60659 - protein, 25 aa, synthetic construct
  source 1..25: note = Seed: VKLQTVHSIPLTINKEEALQRPVAS
VKLQTVHSIPWTIMKLEAIQRPVAS

SEQ ID NO: 60660 - protein, 25 aa, synthetic construct
  source 1..25: note = Seed: VKLQTVHSIPLTINKEEALQRPVAS
VKLQTVHSIPWTIMKLEALQRPVAS

SEQ ID NO: 60661 - protein, 25 aa, synthetic construct
  source 1..25: note = Seed: VKLQTVHSIPLTINKEEALQRPVAS
VKLQTVHSIPWTIMKLEAVQRPVAS

SEQ ID NO: 60662 - protein, 25 aa, synthetic construct
  source 1..25: note = Seed: VKLQTVHSIPLTINKEEALQRPVAS
VKLQTVHSIPWTIMKMEAFQRPVAS

SEQ ID NO: 60663 - protein, 25 aa, synthetic construct
  source 1..25: note = Seed: VKLQTVHSIPLTINKEEALQRPVAS
VKLQTVHSIPWTIMKMEAIQRPVAS

SEQ ID NO: 60664 - protein, 25 aa, synthetic construct
  source 1..25: note = Seed: VKLQTVHSIPLTINKEEALQRPVAS
VKLQTVHSIPWTIMKMEAVQRPVAS

SEQ ID NO: 60665 - protein, 25 aa, synthetic construct
  source 1..25: note = Seed: VKLQTVHSIPLTINKEEALQRPVAS
VKLQTVHSIPWTIMKNEADQRPVAS

SEQ ID NO: 60666 - protein, 25 aa, synthetic construct
  source 1..25: note = Seed: VKLQTVHSIPLTINKEEALQRPVAS
VKLQTVHSIPWTIMKNEAEQRPVAS

SEQ ID NO: 60667 - protein, 25 aa, synthetic construct
  source 1..25: note = Seed: VKLQTVHSIPLTINKEEALQRPVAS
VKLQTVHSIPWTIMKVEAIQRPVAS

SEQ ID NO: 60668 - protein, 25 aa, synthetic construct
  source 1..25: note = Seed: VKLQTVHSIPLTINKEEALQRPVAS
VKLQTVHSIPWTIMKVEAVQRPVAS

SEQ ID NO: 60669 - protein, 25 aa, synthetic construct
  source 1..25: note = Seed: VKLQTVHSIPLTINKEEALQRPVAS
VKLQTVHSIPWTIMKWEAFQRPVAS

SEQ ID NO: 60670 - protein, 25 aa, synthetic construct
  source 1..25: note = Seed: VKLQTVHSIPLTINKEEALQRPVAS
VKLQTVHSIPWTIMKWEAIQRPVAS

SEQ ID NO: 60671 - protein, 25 aa, synthetic construct
  source 1..25: note = Seed: VKLQTVHSIPLTINKEEALQRPVAS
VKLQTVHSIPWTIMKWEALQRPVAS

SEQ ID NO: 60672 - protein, 25 aa, synthetic construct
  source 1..25: note = Seed: VKLQTVHSIPLTINKEEALQRPVAS
VKLQTVHSIPWTIMKYEAFQRPVAS

SEQ ID NO: 60673 - protein, 25 aa, synthetic construct
  source 1..25: note = Seed: VKLQTVHSIPLTINKEEALQRPVAS
VKLQTVHSIPWTIMKYEAIQRPVAS

SEQ ID NO: 60674 - protein, 25 aa, synthetic construct
  source 1..25: note = Seed: VKLQTVHSIPLTINKEEALQRPVAS
VKLQTVHSIPWTIMKYEALQRPVAS

SEQ ID NO: 60675 - protein, 25 aa, synthetic construct
  source 1..25: note = Seed: VKLQTVHSIPLTINKEEALQRPVAS
VKLQTVHSIPWTIMKYEAMQRPVAS

SEQ ID NO: 60676 - protein, 25 aa, synthetic construct
  source 1..25: note = Seed: VKLQTVHSIPLTINKEEALQRPVAS
VKLQTVHSIPWTIMKYEAVQRPVAS

SEQ ID NO: 60677 - protein, 25 aa, synthetic construct
  source 1..25: note = Seed: VKLQTVHSIPLTINKEEALQRPVAS
VKLQTVHSIPWTIMKYEAYQRPVAS

SEQ ID NO: 60678 - protein, 25 aa, synthetic construct
  source 1..25: note = Seed: VKLQTVHSIPLTINKEEALQRPVAS
VKLQTVHSIPWTINKAEAFQRPVAS

SEQ ID NO: 60679 - protein, 25 aa, synthetic construct
  source 1..25: note = Seed: VKLQTVHSIPLTINKEEALQRPVAS
VKLQTVHSIPWTINKAEAIQRPVAS

SEQ ID NO: 60680 - protein, 25 aa, synthetic construct
  source 1..25: note = Seed: VKLQTVHSIPLTINKEEALQRPVAS
VKLQTVHSIPWTINKAEALQRPVAS

SEQ ID NO: 60681 - protein, 25 aa, synthetic construct
  source 1..25: note = Seed: VKLQTVHSIPLTINKEEALQRPVAS
VKLQTVHSIPWTINKAEAVQRPVAS

SEQ ID NO: 60682 - protein, 25 aa, synthetic construct
  source 1..25: note = Seed: VKLQTVHSIPLTINKEEALQRPVAS
VKLQTVHSIPWTINKFEAFQRPVAS

SEQ ID NO: 60683 - protein, 25 aa, synthetic construct
  source 1..25: note = Seed: VKLQTVHSIPLTINKEEALQRPVAS
VKLQTVHSIPWTINKFEAIQRPVAS

SEQ ID NO: 60684 - protein, 25 aa, synthetic construct
  source 1..25: note = Seed: VKLQTVHSIPLTINKEEALQRPVAS
VKLQTVHSIPWTINKFEALQRPVAS

SEQ ID NO: 60685 - protein, 25 aa, synthetic construct
  source 1..25: note = Seed: VKLQTVHSIPLTINKEEALQRPVAS
VKLQTVHSIPWTINKFEAMQRPVAS

SEQ ID NO: 60686 - protein, 25 aa, synthetic construct
  source 1..25: note = Seed: VKLQTVHSIPLTINKEEALQRPVAS
VKLQTVHSIPWTINKFEAVQRPVAS

SEQ ID NO: 60687 - protein, 25 aa, synthetic construct
  source 1..25: note = Seed: VKLQTVHSIPLTINKEEALQRPVAS
VKLQTVHSIPWTINKIEAIQRPVAS

SEQ ID NO: 60688 - protein, 25 aa, synthetic construct
  source 1..25: note = Seed: VKLQTVHSIPLTINKEEALQRPVAS
VKLQTVHSIPWTINKIEAVQRPVAS

SEQ ID NO: 60689 - protein, 25 aa, synthetic construct
  source 1..25: note = Seed: VKLQTVHSIPLTINKEEALQRPVAS
VKLQTVHSIPWTINKNEAFQRPVAS

SEQ ID NO: 60690 - protein, 25 aa, synthetic construct
  source 1..25: note = Seed: VKLQTVHSIPLTINKEEALQRPVAS
VKLQTVHSIPWTINKNEAIQRPVAS

SEQ ID NO: 60691 - protein, 25 aa, synthetic construct
  source 1..25: note = Seed: VKLQTVHSIPLTINKEEALQRPVAS
VKLQTVHSIPWTINKNEALQRPVAS

SEQ ID NO: 60692 - protein, 25 aa, synthetic construct
  source 1..25: note = Seed: VKLQTVHSIPLTINKEEALQRPVAS
VKLQTVHSIPWTINKNEAMQRPVAS

SEQ ID NO: 60693 - protein, 25 aa, synthetic construct
  source 1..25: note = Seed: VKLQTVHSIPLTINKEEALQRPVAS
VKLQTVHSIPWTINKNEAVQRPVAS

SEQ ID NO: 60694 - protein, 25 aa, synthetic construct
  source 1..25: note = Seed: VKLQTVHSIPLTINKEEALQRPVAS
VKLQTVHSIPWTINKNEAYQRPVAS

SEQ ID NO: 60695 - protein, 25 aa, synthetic construct
  source 1..25: note = Seed: VKLQTVHSIPLTINKEEALQRPVAS
VKLQTVHSIPWTINKSEAIQRPVAS

SEQ ID NO: 60696 - protein, 25 aa, synthetic construct
  source 1..25: note = Seed: VKLQTVHSIPLTINKEEALQRPVAS
VKLQTVHSIPWTINKSEALQRPVAS

SEQ ID NO: 60697 - protein, 25 aa, synthetic construct
  source 1..25: note = Seed: VKLQTVHSIPLTINKEEALQRPVAS
VKLQTVHSIPWTINKSEAVQRPVAS

SEQ ID NO: 60698 - protein, 25 aa, synthetic construct
  source 1..25: note = Seed: VKLQTVHSIPLTINKEEALQRPVAS
VKLQTVHSIPWTINKTEAIQRPVAS

SEQ ID NO: 60699 - protein, 25 aa, synthetic construct
  source 1..25: note = Seed: VKLQTVHSIPLTINKEEALQRPVAS
VKLQTVHSIPWTINKTEAVQRPVAS

SEQ ID NO: 60700 - protein, 25 aa, synthetic construct
  source 1..25: note = Seed: VKLQTVHSIPLTINKEEALQRPVAS
VKLQTVHSIPWTINKVEAIQRPVAS

SEQ ID NO: 60701 - protein, 25 aa, synthetic construct
  source 1..25: note = Seed: VKLQTVHSIPLTINKEEALQRPVAS
VKLQTVHSIPWTINKVEAVQRPVAS

SEQ ID NO: 60702 - protein, 25 aa, synthetic construct
  source 1..25: note = Seed: VKLQTVHSIPLTINKEEALQRPVAS
VKLQTVHSIPWTIQKFEAFQRPVAS

SEQ ID NO: 60703 - protein, 25 aa, synthetic construct
  source 1..25: note = Seed: VKLQTVHSIPLTINKEEALQRPVAS
VKLQTVHSIPWTIQKFEAIQRPVAS

SEQ ID NO: 60704 - protein, 25 aa, synthetic construct
  source 1..25: note = Seed: VKLQTVHSIPLTINKEEALQRPVAS
VKLQTVHSIPWTIQKFEALQRPVAS

SEQ ID NO: 60705 - protein, 25 aa, synthetic construct
  source 1..25: note = Seed: VKLQTVHSIPLTINKEEALQRPVAS
VKLQTVHSIPWTIQKFEAMQRPVAS

SEQ ID NO: 60706 - protein, 25 aa, synthetic construct
  source 1..25: note = Seed: VKLQTVHSIPLTINKEEALQRPVAS
VKLQTVHSIPWTIQKFEAVQRPVAS

SEQ ID NO: 60707 - protein, 25 aa, synthetic construct
  source 1..25: note = Seed: VKLQTVHSIPLTINKEEALQRPVAS
VKLQTVHSIPWTIQKFEAYQRPVAS

SEQ ID NO: 60708 - protein, 25 aa, synthetic construct
  source 1..25: note = Seed: VKLQTVHSIPLTINKEEALQRPVAS
VKLQTVHSIPWTIRKFEAFQRPVAS

SEQ ID NO: 60709 - protein, 25 aa, synthetic construct
  source 1..25: note = Seed: VKLQTVHSIPLTINKEEALQRPVAS
VKLQTVHSIPWTIRKFEAIQRPVAS

SEQ ID NO: 60710 - protein, 25 aa, synthetic construct
  source 1..25: note = Seed: VKLQTVHSIPLTINKEEALQRPVAS
VKLQTVHSIPWTIRKFEALQRPVAS

SEQ ID NO: 60711 - protein, 25 aa, synthetic construct
  source 1..25: note = Seed: VKLQTVHSIPLTINKEEALQRPVAS
VKLQTVHSIPWTISKFEAAQRPVAS

SEQ ID NO: 60712 - protein, 25 aa, synthetic construct
  source 1..25: note = Seed: VKLQTVHSIPLTINKEEALQRPVAS
VKLQTVHSIPWTISKFEAFQRPVAS

SEQ ID NO: 60713 - protein, 25 aa, synthetic construct
  source 1..25: note = Seed: VKLQTVHSIPLTINKEEALQRPVAS
VKLQTVHSIPWTISKFEAIQRPVAS

SEQ ID NO: 60714 - protein, 25 aa, synthetic construct
  source 1..25: note = Seed: VKLQTVHSIPLTINKEEALQRPVAS
VKLQTVHSIPWTISKFEALQRPVAS

SEQ ID NO: 60715 - protein, 25 aa, synthetic construct
  source 1..25: note = Seed: VKLQTVHSIPLTINKEEALQRPVAS
VKLQTVHSIPWTISKFEAMQRPVAS

SEQ ID NO: 60716 - protein, 25 aa, synthetic construct
  source 1..25: note = Seed: VKLQTVHSIPLTINKEEALQRPVAS
VKLQTVHSIPWTISKFEANQRPVAS

SEQ ID NO: 60717 - protein, 25 aa, synthetic construct
  source 1..25: note = Seed: VKLQTVHSIPLTINKEEALQRPVAS
VKLQTVHSIPWTISKFEASQRPVAS

SEQ ID NO: 60718 - protein, 25 aa, synthetic construct
  source 1..25: note = Seed: VKLQTVHSIPLTINKEEALQRPVAS
VKLQTVHSIPWTISKFEATQRPVAS

SEQ ID NO: 60719 - protein, 25 aa, synthetic construct
  source 1..25: note = Seed: VKLQTVHSIPLTINKEEALQRPVAS
VKLQTVHSIPWTISKFEAVQRPVAS

SEQ ID NO: 60720 - protein, 25 aa, synthetic construct
  source 1..25: note = Seed: VKLQTVHSIPLTINKEEALQRPVAS
VKLQTVHSIPWTISKFEAYQRPVAS

SEQ ID NO: 60721 - protein, 25 aa, synthetic construct
  source 1..25: note = Seed: VKLQTVHSIPLTINKEEALQRPVAS
VKLQTVHSIPWTISKLEAIQRPVAS

SEQ ID NO: 60722 - protein, 25 aa, synthetic construct
  source 1..25: note = Seed: VKLQTVHSIPLTINKEEALQRPVAS
VKLQTVHSIPWTISKLEALQRPVAS

SEQ ID NO: 60723 - protein, 25 aa, synthetic construct
  source 1..25: note = Seed: VKLQTVHSIPLTINKEEALQRPVAS
VKLQTVHSIPWTISKWEAIQRPVAS

SEQ ID NO: 60724 - protein, 25 aa, synthetic construct
  source 1..25: note = Seed: VKLQTVHSIPLTINKEEALQRPVAS
VKLQTVHSIPWTISKWEALQRPVAS

SEQ ID NO: 60725 - protein, 25 aa, synthetic construct
  source 1..25: note = Seed: VKLQTVHSIPLTINKEEALQRPVAS
VKLQTVHSIPWTISKYEAFQRPVAS

SEQ ID NO: 60726 - protein, 25 aa, synthetic construct
  source 1..25: note = Seed: VKLQTVHSIPLTINKEEALQRPVAS
VKLQTVHSIPWTISKYEAIQRPVAS

SEQ ID NO: 60727 - protein, 25 aa, synthetic construct
  source 1..25: note = Seed: VKLQTVHSIPLTINKEEALQRPVAS
VKLQTVHSIPWTISKYEALQRPVAS

SEQ ID NO: 60728 - protein, 25 aa, synthetic construct
  source 1..25: note = Seed: VKLQTVHSIPLTINKEEALQRPVAS
VKLQTVHSIPWTISKYEAVQRPVAS

SEQ ID NO: 60729 - protein, 25 aa, synthetic construct
  source 1..25: note = Seed: VKLQTVHSIPLTINKEEALQRPVAS
VKLQTVHSIPWTITKFEAAQRPVAS

SEQ ID NO: 60730 - protein, 25 aa, synthetic construct
  source 1..25: note = Seed: VKLQTVHSIPLTINKEEALQRPVAS
VKLQTVHSIPWTITKFEAEQRPVAS

SEQ ID NO: 60731 - protein, 25 aa, synthetic construct
  source 1..25: note = Seed: VKLQTVHSIPLTINKEEALQRPVAS
VKLQTVHSIPWTITKFEAFQRPVAS

SEQ ID NO: 60732 - protein, 25 aa, synthetic construct
  source 1..25: note = Seed: VKLQTVHSIPLTINKEEALQRPVAS
VKLQTVHSIPWTITKFEAIQRPVAS

SEQ ID NO: 60733 - protein, 25 aa, synthetic construct
  source 1..25: note = Seed: VKLQTVHSIPLTINKEEALQRPVAS
VKLQTVHSIPWTITKFEALQRPVAS

SEQ ID NO: 60734 - protein, 25 aa, synthetic construct
  source 1..25: note = Seed: VKLQTVHSIPLTINKEEALQRPVAS
VKLQTVHSIPWTITKFEAMQRPVAS

SEQ ID NO: 60735 - protein, 25 aa, synthetic construct
  source 1..25: note = Seed: VKLQTVHSIPLTINKEEALQRPVAS
VKLQTVHSIPWTITKFEANQRPVAS

SEQ ID NO: 60736 - protein, 25 aa, synthetic construct
  source 1..25: note = Seed: VKLQTVHSIPLTINKEEALQRPVAS
VKLQTVHSIPWTITKFEASQRPVAS

SEQ ID NO: 60737 - protein, 25 aa, synthetic construct
  source 1..25: note = Seed: VKLQTVHSIPLTINKEEALQRPVAS
VKLQTVHSIPWTITKFEATQRPVAS

SEQ ID NO: 60738 - protein, 25 aa, synthetic construct
  source 1..25: note = Seed: VKLQTVHSIPLTINKEEALQRPVAS
VKLQTVHSIPWTITKFEAVQRPVAS

SEQ ID NO: 60739 - protein, 25 aa, synthetic construct
  source 1..25: note = Seed: VKLQTVHSIPLTINKEEALQRPVAS
VKLQTVHSIPWTITKFEAYQRPVAS

SEQ ID NO: 60740 - protein, 25 aa, synthetic construct
  source 1..25: note = Seed: VKLQTVHSIPLTINKEEALQRPVAS
VKLQTVHSIPWTITKIEALQRPVAS

SEQ ID NO: 60741 - protein, 25 aa, synthetic construct
  source 1..25: note = Seed: VKLQTVHSIPLTINKEEALQRPVAS
VKLQTVHSIPWTITKLEAFQRPVAS

SEQ ID NO: 60742 - protein, 25 aa, synthetic construct
  source 1..25: note = Seed: VKLQTVHSIPLTINKEEALQRPVAS
VKLQTVHSIPWTITKLEAIQRPVAS

SEQ ID NO: 60743 - protein, 25 aa, synthetic construct
  source 1..25: note = Seed: VKLQTVHSIPLTINKEEALQRPVAS
VKLQTVHSIPWTITKLEALQRPVAS

SEQ ID NO: 60744 - protein, 25 aa, synthetic construct
  source 1..25: note = Seed: VKLQTVHSIPLTINKEEALQRPVAS
VKLQTVHSIPWTITKLEAVQRPVAS

SEQ ID NO: 60745 - protein, 25 aa, synthetic construct
  source 1..25: note = Seed: VKLQTVHSIPLTINKEEALQRPVAS
VKLQTVHSIPWTITKWEAIQRPVAS

SEQ ID NO: 60746 - protein, 25 aa, synthetic construct
  source 1..25: note = Seed: VKLQTVHSIPLTINKEEALQRPVAS
VKLQTVHSIPWTITKWEALQRPVAS

SEQ ID NO: 60747 - protein, 25 aa, synthetic construct
  source 1..25: note = Seed: VKLQTVHSIPLTINKEEALQRPVAS
VKLQTVHSIPWTITKWEAVQRPVAS

SEQ ID NO: 60748 - protein, 25 aa, synthetic construct
  source 1..25: note = Seed: VKLQTVHSIPLTINKEEALQRPVAS
VKLQTVHSIPWTITKYEAFQRPVAS

SEQ ID NO: 60749 - protein, 25 aa, synthetic construct
  source 1..25: note = Seed: VKLQTVHSIPLTINKEEALQRPVAS
VKLQTVHSIPWTITKYEAIQRPVAS

SEQ ID NO: 60750 - protein, 25 aa, synthetic construct
  source 1..25: note = Seed: VKLQTVHSIPLTINKEEALQRPVAS
VKLQTVHSIPWTITKYEALQRPVAS

SEQ ID NO: 60751 - protein, 25 aa, synthetic construct
  source 1..25: note = Seed: VKLQTVHSIPLTINKEEALQRPVAS
VKLQTVHSIPWTITKYEAMQRPVAS

SEQ ID NO: 60752 - protein, 25 aa, synthetic construct
  source 1..25: note = Seed: VKLQTVHSIPLTINKEEALQRPVAS
VKLQTVHSIPWTITKYEAVQRPVAS

SEQ ID NO: 60753 - protein, 25 aa, synthetic construct
  source 1..25: note = Seed: VKLQTVHSIPLTINKEEALQRPVAS
VKLQTVHSIPWTIVKAEAFQRPVAS

SEQ ID NO: 60754 - protein, 25 aa, synthetic construct
  source 1..25: note = Seed: VKLQTVHSIPLTINKEEALQRPVAS
VKLQTVHSIPWTIVKAEALQRPVAS

SEQ ID NO: 60755 - protein, 25 aa, synthetic construct
  source 1..25: note = Seed: VKLQTVHSIPLTINKEEALQRPVAS
VKLQTVHSIPWTIVKFEAAQRPVAS

SEQ ID NO: 60756 - protein, 25 aa, synthetic construct
  source 1..25: note = Seed: VKLQTVHSIPLTINKEEALQRPVAS
VKLQTVHSIPWTIVKFEACQRPVAS

SEQ ID NO: 60757 - protein, 25 aa, synthetic construct
  source 1..25: note = Seed: VKLQTVHSIPLTINKEEALQRPVAS
VKLQTVHSIPWTIVKFEADQRPVAS

SEQ ID NO: 60758 - protein, 25 aa, synthetic construct
  source 1..25: note = Seed: VKLQTVHSIPLTINKEEALQRPVAS
VKLQTVHSIPWTIVKFEAEQRPVAS

SEQ ID NO: 60759 - protein, 25 aa, synthetic construct
  source 1..25: note = Seed: VKLQTVHSIPLTINKEEALQRPVAS
VKLQTVHSIPWTIVKFEAFQRPVAS

SEQ ID NO: 60760 - protein, 25 aa, synthetic construct
  source 1..25: note = Seed: VKLQTVHSIPLTINKEEALQRPVAS
VKLQTVHSIPWTIVKFEAGQRPVAS

SEQ ID NO: 60761 - protein, 25 aa, synthetic construct
  source 1..25: note = Seed: VKLQTVHSIPLTINKEEALQRPVAS
VKLQTVHSIPWTIVKFEAHQRPVAS

SEQ ID NO: 60762 - protein, 25 aa, synthetic construct
  source 1..25: note = Seed: VKLQTVHSIPLTINKEEALQRPVAS
VKLQTVHSIPWTIVKFEAIQRPVAS

SEQ ID NO: 60763 - protein, 25 aa, synthetic construct
  source 1..25: note = Seed: VKLQTVHSIPLTINKEEALQRPVAS
VKLQTVHSIPWTIVKFEAKQRPVAS

SEQ ID NO: 60764 - protein, 25 aa, synthetic construct
  source 1..25: note = Seed: VKLQTVHSIPLTINKEEALQRPVAS
VKLQTVHSIPWTIVKFEALQRPVAS

SEQ ID NO: 60765 - protein, 25 aa, synthetic construct
  source 1..25: note = Seed: VKLQTVHSIPLTINKEEALQRPVAS
VKLQTVHSIPWTIVKFEAMQRPVAS

SEQ ID NO: 60766 - protein, 25 aa, synthetic construct
  source 1..25: note = Seed: VKLQTVHSIPLTINKEEALQRPVAS
VKLQTVHSIPWTIVKFEANQRPVAS

SEQ ID NO: 60767 - protein, 25 aa, synthetic construct
  source 1..25: note = Seed: VKLQTVHSIPLTINKEEALQRPVAS
VKLQTVHSIPWTIVKFEAPQRPVAS

SEQ ID NO: 60768 - protein, 25 aa, synthetic construct
  source 1..25: note = Seed: VKLQTVHSIPLTINKEEALQRPVAS
VKLQTVHSIPWTIVKFEAQQRPVAS

SEQ ID NO: 60769 - protein, 25 aa, synthetic construct
  source 1..25: note = Seed: VKLQTVHSIPLTINKEEALQRPVAS
VKLQTVHSIPWTIVKFEARQRPVAS

SEQ ID NO: 60770 - protein, 25 aa, synthetic construct
  source 1..25: note = Seed: VKLQTVHSIPLTINKEEALQRPVAS
VKLQTVHSIPWTIVKFEASQRPVAS

SEQ ID NO: 60771 - protein, 25 aa, synthetic construct
  source 1..25: note = Seed: VKLQTVHSIPLTINKEEALQRPVAS
VKLQTVHSIPWTIVKFEATQRPVAS

SEQ ID NO: 60772 - protein, 25 aa, synthetic construct
  source 1..25: note = Seed: VKLQTVHSIPLTINKEEALQRPVAS
VKLQTVHSIPWTIVKFEAVQRPVAS

SEQ ID NO: 60773 - protein, 25 aa, synthetic construct
  source 1..25: note = Seed: VKLQTVHSIPLTINKEEALQRPVAS
VKLQTVHSIPWTIVKFEAWQRPVAS

SEQ ID NO: 60774 - protein, 25 aa, synthetic construct
  source 1..25: note = Seed: VKLQTVHSIPLTINKEEALQRPVAS
VKLQTVHSIPWTIVKFEAYQRPVAS

SEQ ID NO: 60775 - protein, 25 aa, synthetic construct
  source 1..25: note = Seed: VKLQTVHSIPLTINKEEALQRPVAS
VKLQTVHSIPWTIVKIEAFQRPVAS

SEQ ID NO: 60776 - protein, 25 aa, synthetic construct
  source 1..25: note = Seed: VKLQTVHSIPLTINKEEALQRPVAS
VKLQTVHSIPWTIVKIEAIQRPVAS

SEQ ID NO: 60777 - protein, 25 aa, synthetic construct
  source 1..25: note = Seed: VKLQTVHSIPLTINKEEALQRPVAS
VKLQTVHSIPWTIVKIEALQRPVAS

SEQ ID NO: 60778 - protein, 25 aa, synthetic construct
  source 1..25: note = Seed: VKLQTVHSIPLTINKEEALQRPVAS
VKLQTVHSIPWTIVKIEAMQRPVAS

SEQ ID NO: 60779 - protein, 25 aa, synthetic construct
  source 1..25: note = Seed: VKLQTVHSIPLTINKEEALQRPVAS
VKLQTVHSIPWTIVKIEAVQRPVAS

SEQ ID NO: 60780 - protein, 25 aa, synthetic construct
  source 1..25: note = Seed: VKLQTVHSIPLTINKEEALQRPVAS
VKLQTVHSIPWTIVKIEAYQRPVAS

SEQ ID NO: 60781 - protein, 25 aa, synthetic construct
  source 1..25: note = Seed: VKLQTVHSIPLTINKEEALQRPVAS
VKLQTVHSIPWTIVKLEAAQRPVAS

SEQ ID NO: 60782 - protein, 25 aa, synthetic construct
  source 1..25: note = Seed: VKLQTVHSIPLTINKEEALQRPVAS
VKLQTVHSIPWTIVKLEAEQRPVAS

SEQ ID NO: 60783 - protein, 25 aa, synthetic construct
  source 1..25: note = Seed: VKLQTVHSIPLTINKEEALQRPVAS
VKLQTVHSIPWTIVKLEAFQRPVAS

SEQ ID NO: 60784 - protein, 25 aa, synthetic construct
  source 1..25: note = Seed: VKLQTVHSIPLTINKEEALQRPVAS
VKLQTVHSIPWTIVKLEAIQRPVAS

SEQ ID NO: 60785 - protein, 25 aa, synthetic construct
  source 1..25: note = Seed: VKLQTVHSIPLTINKEEALQRPVAS
VKLQTVHSIPWTIVKLEALQRPVAS

SEQ ID NO: 60786 - protein, 25 aa, synthetic construct
  source 1..25: note = Seed: VKLQTVHSIPLTINKEEALQRPVAS
VKLQTVHSIPWTIVKLEAMQRPVAS

SEQ ID NO: 60787 - protein, 25 aa, synthetic construct
  source 1..25: note = Seed: VKLQTVHSIPLTINKEEALQRPVAS
VKLQTVHSIPWTIVKLEANQRPVAS

SEQ ID NO: 60788 - protein, 25 aa, synthetic construct
  source 1..25: note = Seed: VKLQTVHSIPLTINKEEALQRPVAS
VKLQTVHSIPWTIVKLEATQRPVAS

SEQ ID NO: 60789 - protein, 25 aa, synthetic construct
  source 1..25: note = Seed: VKLQTVHSIPLTINKEEALQRPVAS
VKLQTVHSIPWTIVKLEAVQRPVAS

SEQ ID NO: 60790 - protein, 25 aa, synthetic construct
  source 1..25: note = Seed: VKLQTVHSIPLTINKEEALQRPVAS
VKLQTVHSIPWTIVKLEAYQRPVAS

SEQ ID NO: 60791 - protein, 25 aa, synthetic construct
  source 1..25: note = Seed: VKLQTVHSIPLTINKEEALQRPVAS
VKLQTVHSIPWTIVKMEAFQRPVAS

SEQ ID NO: 60792 - protein, 25 aa, synthetic construct
  source 1..25: note = Seed: VKLQTVHSIPLTINKEEALQRPVAS
VKLQTVHSIPWTIVKMEAIQRPVAS

SEQ ID NO: 60793 - protein, 25 aa, synthetic construct
  source 1..25: note = Seed: VKLQTVHSIPLTINKEEALQRPVAS
VKLQTVHSIPWTIVKMEALQRPVAS

SEQ ID NO: 60794 - protein, 25 aa, synthetic construct
  source 1..25: note = Seed: VKLQTVHSIPLTINKEEALQRPVAS
VKLQTVHSIPWTIVKMEAMQRPVAS

SEQ ID NO: 60795 - protein, 25 aa, synthetic construct
  source 1..25: note = Seed: VKLQTVHSIPLTINKEEALQRPVAS
VKLQTVHSIPWTIVKMEAVQRPVAS

SEQ ID NO: 60796 - protein, 25 aa, synthetic construct
  source 1..25: note = Seed: VKLQTVHSIPLTINKEEALQRPVAS
VKLQTVHSIPWTIVKVEAFQRPVAS

SEQ ID NO: 60797 - protein, 25 aa, synthetic construct
  source 1..25: note = Seed: VKLQTVHSIPLTINKEEALQRPVAS
VKLQTVHSIPWTIVKVEAIQRPVAS

SEQ ID NO: 60798 - protein, 25 aa, synthetic construct
  source 1..25: note = Seed: VKLQTVHSIPLTINKEEALQRPVAS
VKLQTVHSIPWTIVKVEALQRPVAS

SEQ ID NO: 60799 - protein, 25 aa, synthetic construct
  source 1..25: note = Seed: VKLQTVHSIPLTINKEEALQRPVAS
VKLQTVHSIPWTIVKVEAVQRPVAS

SEQ ID NO: 60800 - protein, 25 aa, synthetic construct
  source 1..25: note = Seed: VKLQTVHSIPLTINKEEALQRPVAS
VKLQTVHSIPWTIVKWEAFQRPVAS

SEQ ID NO: 60801 - protein, 25 aa, synthetic construct
  source 1..25: note = Seed: VKLQTVHSIPLTINKEEALQRPVAS
VKLQTVHSIPWTIVKWEAIQRPVAS

SEQ ID NO: 60802 - protein, 25 aa, synthetic construct
  source 1..25: note = Seed: VKLQTVHSIPLTINKEEALQRPVAS
VKLQTVHSIPWTIVKWEALQRPVAS

SEQ ID NO: 60803 - protein, 25 aa, synthetic construct
  source 1..25: note = Seed: VKLQTVHSIPLTINKEEALQRPVAS
VKLQTVHSIPWTIVKWEAMQRPVAS

SEQ ID NO: 60804 - protein, 25 aa, synthetic construct
  source 1..25: note = Seed: VKLQTVHSIPLTINKEEALQRPVAS
VKLQTVHSIPWTIVKWEAVQRPVAS

SEQ ID NO: 60805 - protein, 25 aa, synthetic construct
  source 1..25: note = Seed: VKLQTVHSIPLTINKEEALQRPVAS
VKLQTVHSIPWTIVKWEAYQRPVAS

SEQ ID NO: 60806 - protein, 25 aa, synthetic construct
  source 1..25: note = Seed: VKLQTVHSIPLTINKEEALQRPVAS
VKLQTVHSIPWTIVKYEAAQRPVAS

SEQ ID NO: 60807 - protein, 25 aa, synthetic construct
  source 1..25: note = Seed: VKLQTVHSIPLTINKEEALQRPVAS
VKLQTVHSIPWTIVKYEAFQRPVAS

SEQ ID NO: 60808 - protein, 25 aa, synthetic construct
  source 1..25: note = Seed: VKLQTVHSIPLTINKEEALQRPVAS
VKLQTVHSIPWTIVKYEAIQRPVAS

SEQ ID NO: 60809 - protein, 25 aa, synthetic construct
  source 1..25: note = Seed: VKLQTVHSIPLTINKEEALQRPVAS
VKLQTVHSIPWTIVKYEALQRPVAS

SEQ ID NO: 60810 - protein, 25 aa, synthetic construct
  source 1..25: note = Seed: VKLQTVHSIPLTINKEEALQRPVAS
VKLQTVHSIPWTIVKYEAMQRPVAS

SEQ ID NO: 60811 - protein, 25 aa, synthetic construct
  source 1..25: note = Seed: VKLQTVHSIPLTINKEEALQRPVAS
VKLQTVHSIPWTIVKYEANQRPVAS

SEQ ID NO: 60812 - protein, 25 aa, synthetic construct
  source 1..25: note = Seed: VKLQTVHSIPLTINKEEALQRPVAS
VKLQTVHSIPWTIVKYEASQRPVAS

SEQ ID NO: 60813 - protein, 25 aa, synthetic construct
  source 1..25: note = Seed: VKLQTVHSIPLTINKEEALQRPVAS
VKLQTVHSIPWTIVKYEATQRPVAS

SEQ ID NO: 60814 - protein, 25 aa, synthetic construct
  source 1..25: note = Seed: VKLQTVHSIPLTINKEEALQRPVAS
VKLQTVHSIPWTIVKYEAVQRPVAS

SEQ ID NO: 60815 - protein, 25 aa, synthetic construct
  source 1..25: note = Seed: VKLQTVHSIPLTINKEEALQRPVAS
VKLQTVHSIPWTIVKYEAWQRPVAS

SEQ ID NO: 60816 - protein, 25 aa, synthetic construct
  source 1..25: note = Seed: VKLQTVHSIPLTINKEEALQRPVAS
VKLQTVHSIPWTIVKYEAYQRPVAS

SEQ ID NO: 60817 - protein, 25 aa, synthetic construct
  source 1..25: note = Seed: VKLQTVHSIPLTINKEEALQRPVAS
VKLQTVHSIPWTIWKFEAFQRPVAS

SEQ ID NO: 60818 - protein, 25 aa, synthetic construct
  source 1..25: note = Seed: VKLQTVHSIPLTINKEEALQRPVAS
VKLQTVHSIPWTIWKFEAIQRPVAS

SEQ ID NO: 60819 - protein, 25 aa, synthetic construct
  source 1..25: note = Seed: VKLQTVHSIPLTINKEEALQRPVAS
VKLQTVHSIPWTIWKFEALQRPVAS

SEQ ID NO: 60820 - protein, 25 aa, synthetic construct
  source 1..25: note = Seed: VKLQTVHSIPLTINKEEALQRPVAS
VKLQTVHSIPWTIWKFEAMQRPVAS

SEQ ID NO: 60821 - protein, 25 aa, synthetic construct
  source 1..25: note = Seed: VKLQTVHSIPLTINKEEALQRPVAS
VKLQTVHSIPWTIWKFEAVQRPVAS

SEQ ID NO: 60822 - protein, 25 aa, synthetic construct
  source 1..25: note = Seed: VKLQTVHSIPLTINKEEALQRPVAS
VKLQTVHSIPWTIWKFEAYQRPVAS

SEQ ID NO: 60823 - protein, 25 aa, synthetic construct
  source 1..25: note = Seed: VKLQTVHSIPLTINKEEALQRPVAS
VKLQTVHSIPWTIWKIEAFQRPVAS

SEQ ID NO: 60824 - protein, 25 aa, synthetic construct
  source 1..25: note = Seed: VKLQTVHSIPLTINKEEALQRPVAS
VKLQTVHSIPWTIWKIEAIQRPVAS

SEQ ID NO: 60825 - protein, 25 aa, synthetic construct
  source 1..25: note = Seed: VKLQTVHSIPLTINKEEALQRPVAS
VKLQTVHSIPWTIWKIEALQRPVAS

SEQ ID NO: 60826 - protein, 25 aa, synthetic construct
  source 1..25: note = Seed: VKLQTVHSIPLTINKEEALQRPVAS
VKLQTVHSIPWTIWKIEAVQRPVAS

SEQ ID NO: 60827 - protein, 25 aa, synthetic construct
  source 1..25: note = Seed: VKLQTVHSIPLTINKEEALQRPVAS
VKLQTVHSIPWTIWKLEAFQRPVAS

SEQ ID NO: 60828 - protein, 25 aa, synthetic construct
  source 1..25: note = Seed: VKLQTVHSIPLTINKEEALQRPVAS
VKLQTVHSIPWTIWKLEAIQRPVAS

SEQ ID NO: 60829 - protein, 25 aa, synthetic construct
  source 1..25: note = Seed: VKLQTVHSIPLTINKEEALQRPVAS
VKLQTVHSIPWTIWKLEALQRPVAS

SEQ ID NO: 60830 - protein, 25 aa, synthetic construct
  source 1..25: note = Seed: VKLQTVHSIPLTINKEEALQRPVAS
VKLQTVHSIPWTIWKVEAIQRPVAS

SEQ ID NO: 60831 - protein, 25 aa, synthetic construct
  source 1..25: note = Seed: VKLQTVHSIPLTINKEEALQRPVAS
VKLQTVHSIPWTIWKWEALQRPVAS

SEQ ID NO: 60832 - protein, 25 aa, synthetic construct
  source 1..25: note = Seed: VKLQTVHSIPLTINKEEALQRPVAS
VKLQTVHSIPWTIWKYEAFQRPVAS

SEQ ID NO: 60833 - protein, 25 aa, synthetic construct
  source 1..25: note = Seed: VKLQTVHSIPLTINKEEALQRPVAS
VKLQTVHSIPWTIWKYEAIQRPVAS

SEQ ID NO: 60834 - protein, 25 aa, synthetic construct
  source 1..25: note = Seed: VKLQTVHSIPLTINKEEALQRPVAS
VKLQTVHSIPWTIWKYEALQRPVAS

SEQ ID NO: 60835 - protein, 25 aa, synthetic construct
  source 1..25: note = Seed: VKLQTVHSIPLTINKEEALQRPVAS
VKLQTVHSIPWTIYKAEAIQRPVAS

SEQ ID NO: 60836 - protein, 25 aa, synthetic construct
  source 1..25: note = Seed: VKLQTVHSIPLTINKEEALQRPVAS
VKLQTVHSIPWTIYKAEAVQRPVAS

SEQ ID NO: 60837 - protein, 25 aa, synthetic construct
  source 1..25: note = Seed: VKLQTVHSIPLTINKEEALQRPVAS
VKLQTVHSIPWTIYKFEAAQRPVAS

SEQ ID NO: 60838 - protein, 25 aa, synthetic construct
  source 1..25: note = Seed: VKLQTVHSIPLTINKEEALQRPVAS
VKLQTVHSIPWTIYKFEAFQRPVAS

SEQ ID NO: 60839 - protein, 25 aa, synthetic construct
  source 1..25: note = Seed: VKLQTVHSIPLTINKEEALQRPVAS
VKLQTVHSIPWTIYKFEAIQRPVAS

SEQ ID NO: 60840 - protein, 25 aa, synthetic construct
  source 1..25: note = Seed: VKLQTVHSIPLTINKEEALQRPVAS
VKLQTVHSIPWTIYKFEALQRPVAS

SEQ ID NO: 60841 - protein, 25 aa, synthetic construct
  source 1..25: note = Seed: VKLQTVHSIPLTINKEEALQRPVAS
VKLQTVHSIPWTIYKFEAMQRPVAS

SEQ ID NO: 60842 - protein, 25 aa, synthetic construct
  source 1..25: note = Seed: VKLQTVHSIPLTINKEEALQRPVAS
VKLQTVHSIPWTIYKFEASQRPVAS

SEQ ID NO: 60843 - protein, 25 aa, synthetic construct
  source 1..25: note = Seed: VKLQTVHSIPLTINKEEALQRPVAS
VKLQTVHSIPWTIYKFEATQRPVAS

SEQ ID NO: 60844 - protein, 25 aa, synthetic construct
  source 1..25: note = Seed: VKLQTVHSIPLTINKEEALQRPVAS
VKLQTVHSIPWTIYKFEAVQRPVAS

SEQ ID NO: 60845 - protein, 25 aa, synthetic construct
  source 1..25: note = Seed: VKLQTVHSIPLTINKEEALQRPVAS
VKLQTVHSIPWTIYKFEAWQRPVAS

SEQ ID NO: 60846 - protein, 25 aa, synthetic construct
  source 1..25: note = Seed: VKLQTVHSIPLTINKEEALQRPVAS
VKLQTVHSIPWTIYKFEAYQRPVAS

SEQ ID NO: 60847 - protein, 25 aa, synthetic construct
  source 1..25: note = Seed: VKLQTVHSIPLTINKEEALQRPVAS
VKLQTVHSIPWTIYKIEAAQRPVAS

SEQ ID NO: 60848 - protein, 25 aa, synthetic construct
  source 1..25: note = Seed: VKLQTVHSIPLTINKEEALQRPVAS
VKLQTVHSIPWTIYKIEAFQRPVAS

SEQ ID NO: 60849 - protein, 25 aa, synthetic construct
  source 1..25: note = Seed: VKLQTVHSIPLTINKEEALQRPVAS
VKLQTVHSIPWTIYKIEAIQRPVAS

SEQ ID NO: 60850 - protein, 25 aa, synthetic construct
  source 1..25: note = Seed: VKLQTVHSIPLTINKEEALQRPVAS
VKLQTVHSIPWTIYKIEALQRPVAS

SEQ ID NO: 60851 - protein, 25 aa, synthetic construct
  source 1..25: note = Seed: VKLQTVHSIPLTINKEEALQRPVAS
VKLQTVHSIPWTIYKIEAMQRPVAS

SEQ ID NO: 60852 - protein, 25 aa, synthetic construct
  source 1..25: note = Seed: VKLQTVHSIPLTINKEEALQRPVAS
VKLQTVHSIPWTIYKIEARQRPVAS

SEQ ID NO: 60853 - protein, 25 aa, synthetic construct
  source 1..25: note = Seed: VKLQTVHSIPLTINKEEALQRPVAS
VKLQTVHSIPWTIYKIEAVQRPVAS

SEQ ID NO: 60854 - protein, 25 aa, synthetic construct
  source 1..25: note = Seed: VKLQTVHSIPLTINKEEALQRPVAS
VKLQTVHSIPWTIYKLEAFQRPVAS

SEQ ID NO: 60855 - protein, 25 aa, synthetic construct
  source 1..25: note = Seed: VKLQTVHSIPLTINKEEALQRPVAS
VKLQTVHSIPWTIYKLEAIQRPVAS

SEQ ID NO: 60856 - protein, 25 aa, synthetic construct
  source 1..25: note = Seed: VKLQTVHSIPLTINKEEALQRPVAS
VKLQTVHSIPWTIYKLEALQRPVAS

SEQ ID NO: 60857 - protein, 25 aa, synthetic construct
  source 1..25: note = Seed: VKLQTVHSIPLTINKEEALQRPVAS
VKLQTVHSIPWTIYKLEAMQRPVAS

SEQ ID NO: 60858 - protein, 25 aa, synthetic construct
  source 1..25: note = Seed: VKLQTVHSIPLTINKEEALQRPVAS
VKLQTVHSIPWTIYKLEAVQRPVAS

SEQ ID NO: 60859 - protein, 25 aa, synthetic construct
  source 1..25: note = Seed: VKLQTVHSIPLTINKEEALQRPVAS
VKLQTVHSIPWTIYKLEAYQRPVAS

SEQ ID NO: 60860 - protein, 25 aa, synthetic construct
  source 1..25: note = Seed: VKLQTVHSIPLTINKEEALQRPVAS
VKLQTVHSIPWTIYKMEAFQRPVAS

SEQ ID NO: 60861 - protein, 25 aa, synthetic construct
  source 1..25: note = Seed: VKLQTVHSIPLTINKEEALQRPVAS
VKLQTVHSIPWTIYKMEALQRPVAS

SEQ ID NO: 60862 - protein, 25 aa, synthetic construct
  source 1..25: note = Seed: VKLQTVHSIPLTINKEEALQRPVAS
VKLQTVHSIPWTIYKVEAAQRPVAS

SEQ ID NO: 60863 - protein, 25 aa, synthetic construct
  source 1..25: note = Seed: VKLQTVHSIPLTINKEEALQRPVAS
VKLQTVHSIPWTIYKVEAFQRPVAS

SEQ ID NO: 60864 - protein, 25 aa, synthetic construct
  source 1..25: note = Seed: VKLQTVHSIPLTINKEEALQRPVAS
VKLQTVHSIPWTIYKVEAIQRPVAS

SEQ ID NO: 60865 - protein, 25 aa, synthetic construct
  source 1..25: note = Seed: VKLQTVHSIPLTINKEEALQRPVAS
VKLQTVHSIPWTIYKVEALQRPVAS

SEQ ID NO: 60866 - protein, 25 aa, synthetic construct
  source 1..25: note = Seed: VKLQTVHSIPLTINKEEALQRPVAS
VKLQTVHSIPWTIYKVEAVQRPVAS

SEQ ID NO: 60867 - protein, 25 aa, synthetic construct
  source 1..25: note = Seed: VKLQTVHSIPLTINKEEALQRPVAS
VKLQTVHSIPWTIYKWEAFQRPVAS

SEQ ID NO: 60868 - protein, 25 aa, synthetic construct
  source 1..25: note = Seed: VKLQTVHSIPLTINKEEALQRPVAS
VKLQTVHSIPWTIYKWEAIQRPVAS

SEQ ID NO: 60869 - protein, 25 aa, synthetic construct
  source 1..25: note = Seed: VKLQTVHSIPLTINKEEALQRPVAS
VKLQTVHSIPWTIYKWEALQRPVAS

SEQ ID NO: 60870 - protein, 25 aa, synthetic construct
  source 1..25: note = Seed: VKLQTVHSIPLTINKEEALQRPVAS
VKLQTVHSIPWTIYKYEAFQRPVAS

SEQ ID NO: 60871 - protein, 25 aa, synthetic construct
  source 1..25: note = Seed: VKLQTVHSIPLTINKEEALQRPVAS
VKLQTVHSIPWTIYKYEAIQRPVAS

SEQ ID NO: 60872 - protein, 25 aa, synthetic construct
  source 1..25: note = Seed: VKLQTVHSIPLTINKEEALQRPVAS
VKLQTVHSIPWTIYKYEALQRPVAS

SEQ ID NO: 60873 - protein, 25 aa, synthetic construct
  source 1..25: note = Seed: VKLQTVHSIPLTINKEEALQRPVAS
VKLQTVHSIPWTIYKYEAMQRPVAS

SEQ ID NO: 60874 - protein, 25 aa, synthetic construct
  source 1..25: note = Seed: VKLQTVHSIPLTINKEEALQRPVAS
VKLQTVHSIPWTIYKYEAVQRPVAS

SEQ ID NO: 60875 - protein, 25 aa, synthetic construct
  source 1..25: note = Seed: VKLQTVHSIPLTINKEEALQRPVAS
VKLQTVHSIPYTIAKFEAAQRPVAS

SEQ ID NO: 60876 - protein, 25 aa, synthetic construct
  source 1..25: note = Seed: VKLQTVHSIPLTINKEEALQRPVAS
VKLQTVHSIPYTIAKFEAEQRPVAS

SEQ ID NO: 60877 - protein, 25 aa, synthetic construct
  source 1..25: note = Seed: VKLQTVHSIPLTINKEEALQRPVAS
VKLQTVHSIPYTIAKFEAFQRPVAS

SEQ ID NO: 60878 - protein, 25 aa, synthetic construct
  source 1..25: note = Seed: VKLQTVHSIPLTINKEEALQRPVAS
VKLQTVHSIPYTIAKFEAIQRPVAS

SEQ ID NO: 60879 - protein, 25 aa, synthetic construct
  source 1..25: note = Seed: VKLQTVHSIPLTINKEEALQRPVAS
VKLQTVHSIPYTIAKFEALQRPVAS

SEQ ID NO: 60880 - protein, 25 aa, synthetic construct
  source 1..25: note = Seed: VKLQTVHSIPLTINKEEALQRPVAS
VKLQTVHSIPYTIAKFEAMQRPVAS

SEQ ID NO: 60881 - protein, 25 aa, synthetic construct
  source 1..25: note = Seed: VKLQTVHSIPLTINKEEALQRPVAS
VKLQTVHSIPYTIAKFEANQRPVAS

SEQ ID NO: 60882 - protein, 25 aa, synthetic construct
  source 1..25: note = Seed: VKLQTVHSIPLTINKEEALQRPVAS
VKLQTVHSIPYTIAKFEASQRPVAS

SEQ ID NO: 60883 - protein, 25 aa, synthetic construct
  source 1..25: note = Seed: VKLQTVHSIPLTINKEEALQRPVAS
VKLQTVHSIPYTIAKFEATQRPVAS

SEQ ID NO: 60884 - protein, 25 aa, synthetic construct
  source 1..25: note = Seed: VKLQTVHSIPLTINKEEALQRPVAS
VKLQTVHSIPYTIAKFEAVQRPVAS

SEQ ID NO: 60885 - protein, 25 aa, synthetic construct
  source 1..25: note = Seed: VKLQTVHSIPLTINKEEALQRPVAS
VKLQTVHSIPYTIAKFEAWQRPVAS

SEQ ID NO: 60886 - protein, 25 aa, synthetic construct
  source 1..25: note = Seed: VKLQTVHSIPLTINKEEALQRPVAS
VKLQTVHSIPYTIAKFEAYQRPVAS

SEQ ID NO: 60887 - protein, 25 aa, synthetic construct
  source 1..25: note = Seed: VKLQTVHSIPLTINKEEALQRPVAS
VKLQTVHSIPYTIAKIEALQRPVAS

SEQ ID NO: 60888 - protein, 25 aa, synthetic construct
  source 1..25: note = Seed: VKLQTVHSIPLTINKEEALQRPVAS
VKLQTVHSIPYTIAKLEAIQRPVAS

SEQ ID NO: 60889 - protein, 25 aa, synthetic construct
  source 1..25: note = Seed: VKLQTVHSIPLTINKEEALQRPVAS
VKLQTVHSIPYTIAKLEALQRPVAS

SEQ ID NO: 60890 - protein, 25 aa, synthetic construct
  source 1..25: note = Seed: VKLQTVHSIPLTINKEEALQRPVAS
VKLQTVHSIPYTIAKLEAVQRPVAS

SEQ ID NO: 60891 - protein, 25 aa, synthetic construct
  source 1..25: note = Seed: VKLQTVHSIPLTINKEEALQRPVAS
VKLQTVHSIPYTIAKWEAFQRPVAS

SEQ ID NO: 60892 - protein, 25 aa, synthetic construct
  source 1..25: note = Seed: VKLQTVHSIPLTINKEEALQRPVAS
VKLQTVHSIPYTIAKWEAIQRPVAS

SEQ ID NO: 60893 - protein, 25 aa, synthetic construct
  source 1..25: note = Seed: VKLQTVHSIPLTINKEEALQRPVAS
VKLQTVHSIPYTIAKWEALQRPVAS

SEQ ID NO: 60894 - protein, 25 aa, synthetic construct
  source 1..25: note = Seed: VKLQTVHSIPLTINKEEALQRPVAS
VKLQTVHSIPYTIAKWEAVQRPVAS

SEQ ID NO: 60895 - protein, 25 aa, synthetic construct
  source 1..25: note = Seed: VKLQTVHSIPLTINKEEALQRPVAS
VKLQTVHSIPYTIAKYEAFQRPVAS

SEQ ID NO: 60896 - protein, 25 aa, synthetic construct
  source 1..25: note = Seed: VKLQTVHSIPLTINKEEALQRPVAS
VKLQTVHSIPYTIAKYEAIQRPVAS

SEQ ID NO: 60897 - protein, 25 aa, synthetic construct
  source 1..25: note = Seed: VKLQTVHSIPLTINKEEALQRPVAS
VKLQTVHSIPYTIAKYEALQRPVAS

SEQ ID NO: 60898 - protein, 25 aa, synthetic construct
  source 1..25: note = Seed: VKLQTVHSIPLTINKEEALQRPVAS
VKLQTVHSIPYTIAKYEAVQRPVAS

SEQ ID NO: 60899 - protein, 25 aa, synthetic construct
  source 1..25: note = Seed: VKLQTVHSIPLTINKEEALQRPVAS
VKLQTVHSIPYTICKFEAFQRPVAS

SEQ ID NO: 60900 - protein, 25 aa, synthetic construct
  source 1..25: note = Seed: VKLQTVHSIPLTINKEEALQRPVAS
VKLQTVHSIPYTICKFEAIQRPVAS

SEQ ID NO: 60901 - protein, 25 aa, synthetic construct
  source 1..25: note = Seed: VKLQTVHSIPLTINKEEALQRPVAS
VKLQTVHSIPYTICKFEALQRPVAS

SEQ ID NO: 60902 - protein, 25 aa, synthetic construct
  source 1..25: note = Seed: VKLQTVHSIPLTINKEEALQRPVAS
VKLQTVHSIPYTICKFEAMQRPVAS

SEQ ID NO: 60903 - protein, 25 aa, synthetic construct
  source 1..25: note = Seed: VKLQTVHSIPLTINKEEALQRPVAS
VKLQTVHSIPYTICKFEAVQRPVAS

SEQ ID NO: 60904 - protein, 25 aa, synthetic construct
  source 1..25: note = Seed: VKLQTVHSIPLTINKEEALQRPVAS
VKLQTVHSIPYTIDKFEAFQRPVAS

SEQ ID NO: 60905 - protein, 25 aa, synthetic construct
  source 1..25: note = Seed: VKLQTVHSIPLTINKEEALQRPVAS
VKLQTVHSIPYTIDKFEAIQRPVAS

SEQ ID NO: 60906 - protein, 25 aa, synthetic construct
  source 1..25: note = Seed: VKLQTVHSIPLTINKEEALQRPVAS
VKLQTVHSIPYTIDKFEALQRPVAS

SEQ ID NO: 60907 - protein, 25 aa, synthetic construct
  source 1..25: note = Seed: VKLQTVHSIPLTINKEEALQRPVAS
VKLQTVHSIPYTIDKFEAVQRPVAS

SEQ ID NO: 60908 - protein, 25 aa, synthetic construct
  source 1..25: note = Seed: VKLQTVHSIPLTINKEEALQRPVAS
VKLQTVHSIPYTIEKFEAAQRPVAS

SEQ ID NO: 60909 - protein, 25 aa, synthetic construct
  source 1..25: note = Seed: VKLQTVHSIPLTINKEEALQRPVAS
VKLQTVHSIPYTIEKFEAFQRPVAS

SEQ ID NO: 60910 - protein, 25 aa, synthetic construct
  source 1..25: note = Seed: VKLQTVHSIPLTINKEEALQRPVAS
VKLQTVHSIPYTIEKFEAIQRPVAS

SEQ ID NO: 60911 - protein, 25 aa, synthetic construct
  source 1..25: note = Seed: VKLQTVHSIPLTINKEEALQRPVAS
VKLQTVHSIPYTIEKFEALQRPVAS

SEQ ID NO: 60912 - protein, 25 aa, synthetic construct
  source 1..25: note = Seed: VKLQTVHSIPLTINKEEALQRPVAS
VKLQTVHSIPYTIEKFEAMQRPVAS

SEQ ID NO: 60913 - protein, 25 aa, synthetic construct
  source 1..25: note = Seed: VKLQTVHSIPLTINKEEALQRPVAS
VKLQTVHSIPYTIEKFEATQRPVAS

SEQ ID NO: 60914 - protein, 25 aa, synthetic construct
  source 1..25: note = Seed: VKLQTVHSIPLTINKEEALQRPVAS
VKLQTVHSIPYTIEKFEAVQRPVAS

SEQ ID NO: 60915 - protein, 25 aa, synthetic construct
  source 1..25: note = Seed: VKLQTVHSIPLTINKEEALQRPVAS
VKLQTVHSIPYTIEKFEAYQRPVAS

SEQ ID NO: 60916 - protein, 25 aa, synthetic construct
  source 1..25: note = Seed: VKLQTVHSIPLTINKEEALQRPVAS
VKLQTVHSIPYTIEKLEALQRPVAS

SEQ ID NO: 60917 - protein, 25 aa, synthetic construct
  source 1..25: note = Seed: VKLQTVHSIPLTINKEEALQRPVAS
VKLQTVHSIPYTIEKYEALQRPVAS

SEQ ID NO: 60918 - protein, 25 aa, synthetic construct
  source 1..25: note = Seed: VKLQTVHSIPLTINKEEALQRPVAS
VKLQTVHSIPYTIFKAEAFQRPVAS

SEQ ID NO: 60919 - protein, 25 aa, synthetic construct
  source 1..25: note = Seed: VKLQTVHSIPLTINKEEALQRPVAS
VKLQTVHSIPYTIFKAEAIQRPVAS

SEQ ID NO: 60920 - protein, 25 aa, synthetic construct
  source 1..25: note = Seed: VKLQTVHSIPLTINKEEALQRPVAS
VKLQTVHSIPYTIFKAEALQRPVAS

SEQ ID NO: 60921 - protein, 25 aa, synthetic construct
  source 1..25: note = Seed: VKLQTVHSIPLTINKEEALQRPVAS
VKLQTVHSIPYTIFKAEAMQRPVAS

SEQ ID NO: 60922 - protein, 25 aa, synthetic construct
  source 1..25: note = Seed: VKLQTVHSIPLTINKEEALQRPVAS
VKLQTVHSIPYTIFKAEAVQRPVAS

SEQ ID NO: 60923 - protein, 25 aa, synthetic construct
  source 1..25: note = Seed: VKLQTVHSIPLTINKEEALQRPVAS
VKLQTVHSIPYTIFKAEAWQRPVAS

SEQ ID NO: 60924 - protein, 25 aa, synthetic construct
  source 1..25: note = Seed: VKLQTVHSIPLTINKEEALQRPVAS
VKLQTVHSIPYTIFKAEAYQRPVAS

SEQ ID NO: 60925 - protein, 25 aa, synthetic construct
  source 1..25: note = Seed: VKLQTVHSIPLTINKEEALQRPVAS
VKLQTVHSIPYTIFKDEAIQRPVAS

SEQ ID NO: 60926 - protein, 25 aa, synthetic construct
  source 1..25: note = Seed: VKLQTVHSIPLTINKEEALQRPVAS
VKLQTVHSIPYTIFKDEALQRPVAS

SEQ ID NO: 60927 - protein, 25 aa, synthetic construct
  source 1..25: note = Seed: VKLQTVHSIPLTINKEEALQRPVAS
VKLQTVHSIPYTIFKDEAVQRPVAS

SEQ ID NO: 60928 - protein, 25 aa, synthetic construct
  source 1..25: note = Seed: VKLQTVHSIPLTINKEEALQRPVAS
VKLQTVHSIPYTIFKEEAFQRPVAS

SEQ ID NO: 60929 - protein, 25 aa, synthetic construct
  source 1..25: note = Seed: VKLQTVHSIPLTINKEEALQRPVAS
VKLQTVHSIPYTIFKFEAAQRPVAS

SEQ ID NO: 60930 - protein, 25 aa, synthetic construct
  source 1..25: note = Seed: VKLQTVHSIPLTINKEEALQRPVAS
VKLQTVHSIPYTIFKFEACQRPVAS

SEQ ID NO: 60931 - protein, 25 aa, synthetic construct
  source 1..25: note = Seed: VKLQTVHSIPLTINKEEALQRPVAS
VKLQTVHSIPYTIFKFEADQRPVAS

SEQ ID NO: 60932 - protein, 25 aa, synthetic construct
  source 1..25: note = Seed: VKLQTVHSIPLTINKEEALQRPVAS
VKLQTVHSIPYTIFKFEAEQRPVAS

SEQ ID NO: 60933 - protein, 25 aa, synthetic construct
  source 1..25: note = Seed: VKLQTVHSIPLTINKEEALQRPVAS
VKLQTVHSIPYTIFKFEAFQRPVAS

SEQ ID NO: 60934 - protein, 25 aa, synthetic construct
  source 1..25: note = Seed: VKLQTVHSIPLTINKEEALQRPVAS
VKLQTVHSIPYTIFKFEAGQRPVAS

SEQ ID NO: 60935 - protein, 25 aa, synthetic construct
  source 1..25: note = Seed: VKLQTVHSIPLTINKEEALQRPVAS
VKLQTVHSIPYTIFKFEAHQRPVAS

SEQ ID NO: 60936 - protein, 25 aa, synthetic construct
  source 1..25: note = Seed: VKLQTVHSIPLTINKEEALQRPVAS
VKLQTVHSIPYTIFKFEAIQRPVAS

SEQ ID NO: 60937 - protein, 25 aa, synthetic construct
  source 1..25: note = Seed: VKLQTVHSIPLTINKEEALQRPVAS
VKLQTVHSIPYTIFKFEAKQRPVAS

SEQ ID NO: 60938 - protein, 25 aa, synthetic construct
  source 1..25: note = Seed: VKLQTVHSIPLTINKEEALQRPVAS
VKLQTVHSIPYTIFKFEALQRPVAS

SEQ ID NO: 60939 - protein, 25 aa, synthetic construct
  source 1..25: note = Seed: VKLQTVHSIPLTINKEEALQRPVAS
VKLQTVHSIPYTIFKFEAMQRPVAS

SEQ ID NO: 60940 - protein, 25 aa, synthetic construct
  source 1..25: note = Seed: VKLQTVHSIPLTINKEEALQRPVAS
VKLQTVHSIPYTIFKFEANQRPVAS

SEQ ID NO: 60941 - protein, 25 aa, synthetic construct
  source 1..25: note = Seed: VKLQTVHSIPLTINKEEALQRPVAS
VKLQTVHSIPYTIFKFEAPQRPVAS

SEQ ID NO: 60942 - protein, 25 aa, synthetic construct
  source 1..25: note = Seed: VKLQTVHSIPLTINKEEALQRPVAS
VKLQTVHSIPYTIFKFEAQQRPVAS

SEQ ID NO: 60943 - protein, 25 aa, synthetic construct
  source 1..25: note = Seed: VKLQTVHSIPLTINKEEALQRPVAS
VKLQTVHSIPYTIFKFEARQRPVAS

SEQ ID NO: 60944 - protein, 25 aa, synthetic construct
  source 1..25: note = Seed: VKLQTVHSIPLTINKEEALQRPVAS
VKLQTVHSIPYTIFKFEASQRPVAS

SEQ ID NO: 60945 - protein, 25 aa, synthetic construct
  source 1..25: note = Seed: VKLQTVHSIPLTINKEEALQRPVAS
VKLQTVHSIPYTIFKFEATQRPVAS

SEQ ID NO: 60946 - protein, 25 aa, synthetic construct
  source 1..25: note = Seed: VKLQTVHSIPLTINKEEALQRPVAS
VKLQTVHSIPYTIFKFEAVQRPVAS

SEQ ID NO: 60947 - protein, 25 aa, synthetic construct
  source 1..25: note = Seed: VKLQTVHSIPLTINKEEALQRPVAS
VKLQTVHSIPYTIFKFEAWQRPVAS

SEQ ID NO: 60948 - protein, 25 aa, synthetic construct
  source 1..25: note = Seed: VKLQTVHSIPLTINKEEALQRPVAS
VKLQTVHSIPYTIFKFEAYQRPVAS

SEQ ID NO: 60949 - protein, 25 aa, synthetic construct
  source 1..25: note = Seed: VKLQTVHSIPLTINKEEALQRPVAS
VKLQTVHSIPYTIFKGEAFQRPVAS

SEQ ID NO: 60950 - protein, 25 aa, synthetic construct
  source 1..25: note = Seed: VKLQTVHSIPLTINKEEALQRPVAS
VKLQTVHSIPYTIFKGEALQRPVAS

SEQ ID NO: 60951 - protein, 25 aa, synthetic construct
  source 1..25: note = Seed: VKLQTVHSIPLTINKEEALQRPVAS
VKLQTVHSIPYTIFKHEAFQRPVAS

SEQ ID NO: 60952 - protein, 25 aa, synthetic construct
  source 1..25: note = Seed: VKLQTVHSIPLTINKEEALQRPVAS
VKLQTVHSIPYTIFKHEAIQRPVAS

SEQ ID NO: 60953 - protein, 25 aa, synthetic construct
  source 1..25: note = Seed: VKLQTVHSIPLTINKEEALQRPVAS
VKLQTVHSIPYTIFKHEALQRPVAS

SEQ ID NO: 60954 - protein, 25 aa, synthetic construct
  source 1..25: note = Seed: VKLQTVHSIPLTINKEEALQRPVAS
VKLQTVHSIPYTIFKHEAMQRPVAS

SEQ ID NO: 60955 - protein, 25 aa, synthetic construct
  source 1..25: note = Seed: VKLQTVHSIPLTINKEEALQRPVAS
VKLQTVHSIPYTIFKHEAVQRPVAS

SEQ ID NO: 60956 - protein, 25 aa, synthetic construct
  source 1..25: note = Seed: VKLQTVHSIPLTINKEEALQRPVAS
VKLQTVHSIPYTIFKHEAYQRPVAS

SEQ ID NO: 60957 - protein, 25 aa, synthetic construct
  source 1..25: note = Seed: VKLQTVHSIPLTINKEEALQRPVAS
VKLQTVHSIPYTIFKIEAAQRPVAS

SEQ ID NO: 60958 - protein, 25 aa, synthetic construct
  source 1..25: note = Seed: VKLQTVHSIPLTINKEEALQRPVAS
VKLQTVHSIPYTIFKIEAEQRPVAS

SEQ ID NO: 60959 - protein, 25 aa, synthetic construct
  source 1..25: note = Seed: VKLQTVHSIPLTINKEEALQRPVAS
VKLQTVHSIPYTIFKIEAFQRPVAS

SEQ ID NO: 60960 - protein, 25 aa, synthetic construct
  source 1..25: note = Seed: VKLQTVHSIPLTINKEEALQRPVAS
VKLQTVHSIPYTIFKIEAHQRPVAS

SEQ ID NO: 60961 - protein, 25 aa, synthetic construct
  source 1..25: note = Seed: VKLQTVHSIPLTINKEEALQRPVAS
VKLQTVHSIPYTIFKIEAIQRPVAS

SEQ ID NO: 60962 - protein, 25 aa, synthetic construct
  source 1..25: note = Seed: VKLQTVHSIPLTINKEEALQRPVAS
VKLQTVHSIPYTIFKIEAKQRPVAS

SEQ ID NO: 60963 - protein, 25 aa, synthetic construct
  source 1..25: note = Seed: VKLQTVHSIPLTINKEEALQRPVAS
VKLQTVHSIPYTIFKIEALQRPVAS

SEQ ID NO: 60964 - protein, 25 aa, synthetic construct
  source 1..25: note = Seed: VKLQTVHSIPLTINKEEALQRPVAS
VKLQTVHSIPYTIFKIEAMQRPVAS

SEQ ID NO: 60965 - protein, 25 aa, synthetic construct
  source 1..25: note = Seed: VKLQTVHSIPLTINKEEALQRPVAS
VKLQTVHSIPYTIFKIEANQRPVAS

SEQ ID NO: 60966 - protein, 25 aa, synthetic construct
  source 1..25: note = Seed: VKLQTVHSIPLTINKEEALQRPVAS
VKLQTVHSIPYTIFKIEARQRPVAS

SEQ ID NO: 60967 - protein, 25 aa, synthetic construct
  source 1..25: note = Seed: VKLQTVHSIPLTINKEEALQRPVAS
VKLQTVHSIPYTIFKIEASQRPVAS

SEQ ID NO: 60968 - protein, 25 aa, synthetic construct
  source 1..25: note = Seed: VKLQTVHSIPLTINKEEALQRPVAS
VKLQTVHSIPYTIFKIEATQRPVAS

SEQ ID NO: 60969 - protein, 25 aa, synthetic construct
  source 1..25: note = Seed: VKLQTVHSIPLTINKEEALQRPVAS
VKLQTVHSIPYTIFKIEAVQRPVAS

SEQ ID NO: 60970 - protein, 25 aa, synthetic construct
  source 1..25: note = Seed: VKLQTVHSIPLTINKEEALQRPVAS
VKLQTVHSIPYTIFKIEAYQRPVAS

SEQ ID NO: 60971 - protein, 25 aa, synthetic construct
  source 1..25: note = Seed: VKLQTVHSIPLTINKEEALQRPVAS
VKLQTVHSIPYTIFKKEAFQRPVAS

SEQ ID NO: 60972 - protein, 25 aa, synthetic construct
  source 1..25: note = Seed: VKLQTVHSIPLTINKEEALQRPVAS
VKLQTVHSIPYTIFKKEALQRPVAS

SEQ ID NO: 60973 - protein, 25 aa, synthetic construct
  source 1..25: note = Seed: VKLQTVHSIPLTINKEEALQRPVAS
VKLQTVHSIPYTIFKLEAAQRPVAS

SEQ ID NO: 60974 - protein, 25 aa, synthetic construct
  source 1..25: note = Seed: VKLQTVHSIPLTINKEEALQRPVAS
VKLQTVHSIPYTIFKLEADQRPVAS

SEQ ID NO: 60975 - protein, 25 aa, synthetic construct
  source 1..25: note = Seed: VKLQTVHSIPLTINKEEALQRPVAS
VKLQTVHSIPYTIFKLEAEQRPVAS

SEQ ID NO: 60976 - protein, 25 aa, synthetic construct
  source 1..25: note = Seed: VKLQTVHSIPLTINKEEALQRPVAS
VKLQTVHSIPYTIFKLEAFQRPVAS

SEQ ID NO: 60977 - protein, 25 aa, synthetic construct
  source 1..25: note = Seed: VKLQTVHSIPLTINKEEALQRPVAS
VKLQTVHSIPYTIFKLEAHQRPVAS

SEQ ID NO: 60978 - protein, 25 aa, synthetic construct
  source 1..25: note = Seed: VKLQTVHSIPLTINKEEALQRPVAS
VKLQTVHSIPYTIFKLEAIQRPVAS

SEQ ID NO: 60979 - protein, 25 aa, synthetic construct
  source 1..25: note = Seed: VKLQTVHSIPLTINKEEALQRPVAS
VKLQTVHSIPYTIFKLEAKQRPVAS

SEQ ID NO: 60980 - protein, 25 aa, synthetic construct
  source 1..25: note = Seed: VKLQTVHSIPLTINKEEALQRPVAS
VKLQTVHSIPYTIFKLEALQRPVAS

SEQ ID NO: 60981 - protein, 25 aa, synthetic construct
  source 1..25: note = Seed: VKLQTVHSIPLTINKEEALQRPVAS
VKLQTVHSIPYTIFKLEAMQRPVAS

SEQ ID NO: 60982 - protein, 25 aa, synthetic construct
  source 1..25: note = Seed: VKLQTVHSIPLTINKEEALQRPVAS
VKLQTVHSIPYTIFKLEANQRPVAS

SEQ ID NO: 60983 - protein, 25 aa, synthetic construct
  source 1..25: note = Seed: VKLQTVHSIPLTINKEEALQRPVAS
VKLQTVHSIPYTIFKLEAPQRPVAS

SEQ ID NO: 60984 - protein, 25 aa, synthetic construct
  source 1..25: note = Seed: VKLQTVHSIPLTINKEEALQRPVAS
VKLQTVHSIPYTIFKLEAQQRPVAS

SEQ ID NO: 60985 - protein, 25 aa, synthetic construct
  source 1..25: note = Seed: VKLQTVHSIPLTINKEEALQRPVAS
VKLQTVHSIPYTIFKLEARQRPVAS

SEQ ID NO: 60986 - protein, 25 aa, synthetic construct
  source 1..25: note = Seed: VKLQTVHSIPLTINKEEALQRPVAS
VKLQTVHSIPYTIFKLEASQRPVAS

SEQ ID NO: 60987 - protein, 25 aa, synthetic construct
  source 1..25: note = Seed: VKLQTVHSIPLTINKEEALQRPVAS
VKLQTVHSIPYTIFKLEATQRPVAS

SEQ ID NO: 60988 - protein, 25 aa, synthetic construct
  source 1..25: note = Seed: VKLQTVHSIPLTINKEEALQRPVAS
VKLQTVHSIPYTIFKLEAVQRPVAS

SEQ ID NO: 60989 - protein, 25 aa, synthetic construct
  source 1..25: note = Seed: VKLQTVHSIPLTINKEEALQRPVAS
VKLQTVHSIPYTIFKLEAWQRPVAS

SEQ ID NO: 60990 - protein, 25 aa, synthetic construct
  source 1..25: note = Seed: VKLQTVHSIPLTINKEEALQRPVAS
VKLQTVHSIPYTIFKLEAYQRPVAS

SEQ ID NO: 60991 - protein, 25 aa, synthetic construct
  source 1..25: note = Seed: VKLQTVHSIPLTINKEEALQRPVAS
VKLQTVHSIPYTIFKMEAAQRPVAS

SEQ ID NO: 60992 - protein, 25 aa, synthetic construct
  source 1..25: note = Seed: VKLQTVHSIPLTINKEEALQRPVAS
VKLQTVHSIPYTIFKMEAFQRPVAS

SEQ ID NO: 60993 - protein, 25 aa, synthetic construct
  source 1..25: note = Seed: VKLQTVHSIPLTINKEEALQRPVAS
VKLQTVHSIPYTIFKMEAIQRPVAS

SEQ ID NO: 60994 - protein, 25 aa, synthetic construct
  source 1..25: note = Seed: VKLQTVHSIPLTINKEEALQRPVAS
VKLQTVHSIPYTIFKMEALQRPVAS

SEQ ID NO: 60995 - protein, 25 aa, synthetic construct
  source 1..25: note = Seed: VKLQTVHSIPLTINKEEALQRPVAS
VKLQTVHSIPYTIFKMEAMQRPVAS

SEQ ID NO: 60996 - protein, 25 aa, synthetic construct
  source 1..25: note = Seed: VKLQTVHSIPLTINKEEALQRPVAS
VKLQTVHSIPYTIFKMEARQRPVAS

SEQ ID NO: 60997 - protein, 25 aa, synthetic construct
  source 1..25: note = Seed: VKLQTVHSIPLTINKEEALQRPVAS
VKLQTVHSIPYTIFKMEASQRPVAS

SEQ ID NO: 60998 - protein, 25 aa, synthetic construct
  source 1..25: note = Seed: VKLQTVHSIPLTINKEEALQRPVAS
VKLQTVHSIPYTIFKMEATQRPVAS

SEQ ID NO: 60999 - protein, 25 aa, synthetic construct
  source 1..25: note = Seed: VKLQTVHSIPLTINKEEALQRPVAS
VKLQTVHSIPYTIFKMEAVQRPVAS

SEQ ID NO: 61000 - protein, 25 aa, synthetic construct
  source 1..25: note = Seed: VKLQTVHSIPLTINKEEALQRPVAS
VKLQTVHSIPYTIFKMEAYQRPVAS

SEQ ID NO: 61001 - protein, 25 aa, synthetic construct
  source 1..25: note = Seed: VKLQTVHSIPLTINKEEALQRPVAS
VKLQTVHSIPYTIFKNEAAQRPVAS

SEQ ID NO: 61002 - protein, 25 aa, synthetic construct
  source 1..25: note = Seed: VKLQTVHSIPLTINKEEALQRPVAS
VKLQTVHSIPYTIFKNEADQRPVAS

SEQ ID NO: 61003 - protein, 25 aa, synthetic construct
  source 1..25: note = Seed: VKLQTVHSIPLTINKEEALQRPVAS
VKLQTVHSIPYTIFKNEAFQRPVAS

SEQ ID NO: 61004 - protein, 25 aa, synthetic construct
  source 1..25: note = Seed: VKLQTVHSIPLTINKEEALQRPVAS
VKLQTVHSIPYTIFKNEALQRPVAS

SEQ ID NO: 61005 - protein, 25 aa, synthetic construct
  source 1..25: note = Seed: VKLQTVHSIPLTINKEEALQRPVAS
VKLQTVHSIPYTIFKPEAFQRPVAS

SEQ ID NO: 61006 - protein, 25 aa, synthetic construct
  source 1..25: note = Seed: VKLQTVHSIPLTINKEEALQRPVAS
VKLQTVHSIPYTIFKPEALQRPVAS

SEQ ID NO: 61007 - protein, 25 aa, synthetic construct
  source 1..25: note = Seed: VKLQTVHSIPLTINKEEALQRPVAS
VKLQTVHSIPYTIFKQEAFQRPVAS

SEQ ID NO: 61008 - protein, 25 aa, synthetic construct
  source 1..25: note = Seed: VKLQTVHSIPLTINKEEALQRPVAS
VKLQTVHSIPYTIFKQEALQRPVAS

SEQ ID NO: 61009 - protein, 25 aa, synthetic construct
  source 1..25: note = Seed: VKLQTVHSIPLTINKEEALQRPVAS
VKLQTVHSIPYTIFKREAFQRPVAS

SEQ ID NO: 61010 - protein, 25 aa, synthetic construct
  source 1..25: note = Seed: VKLQTVHSIPLTINKEEALQRPVAS
VKLQTVHSIPYTIFKREALQRPVAS

SEQ ID NO: 61011 - protein, 25 aa, synthetic construct
  source 1..25: note = Seed: VKLQTVHSIPLTINKEEALQRPVAS
VKLQTVHSIPYTIFKREARQRPVAS

SEQ ID NO: 61012 - protein, 25 aa, synthetic construct
  source 1..25: note = Seed: VKLQTVHSIPLTINKEEALQRPVAS
VKLQTVHSIPYTIFKSEAIQRPVAS

SEQ ID NO: 61013 - protein, 25 aa, synthetic construct
  source 1..25: note = Seed: VKLQTVHSIPLTINKEEALQRPVAS
VKLQTVHSIPYTIFKSEALQRPVAS

SEQ ID NO: 61014 - protein, 25 aa, synthetic construct
  source 1..25: note = Seed: VKLQTVHSIPLTINKEEALQRPVAS
VKLQTVHSIPYTIFKSEAMQRPVAS

SEQ ID NO: 61015 - protein, 25 aa, synthetic construct
  source 1..25: note = Seed: VKLQTVHSIPLTINKEEALQRPVAS
VKLQTVHSIPYTIFKSEAVQRPVAS

SEQ ID NO: 61016 - protein, 25 aa, synthetic construct
  source 1..25: note = Seed: VKLQTVHSIPLTINKEEALQRPVAS
VKLQTVHSIPYTIFKSEAYQRPVAS

SEQ ID NO: 61017 - protein, 25 aa, synthetic construct
  source 1..25: note = Seed: VKLQTVHSIPLTINKEEALQRPVAS
VKLQTVHSIPYTIFKTEAAQRPVAS

SEQ ID NO: 61018 - protein, 25 aa, synthetic construct
  source 1..25: note = Seed: VKLQTVHSIPLTINKEEALQRPVAS
VKLQTVHSIPYTIFKTEADQRPVAS

SEQ ID NO: 61019 - protein, 25 aa, synthetic construct
  source 1..25: note = Seed: VKLQTVHSIPLTINKEEALQRPVAS
VKLQTVHSIPYTIFKTEAIQRPVAS

SEQ ID NO: 61020 - protein, 25 aa, synthetic construct
  source 1..25: note = Seed: VKLQTVHSIPLTINKEEALQRPVAS
VKLQTVHSIPYTIFKTEALQRPVAS

SEQ ID NO: 61021 - protein, 25 aa, synthetic construct
  source 1..25: note = Seed: VKLQTVHSIPLTINKEEALQRPVAS
VKLQTVHSIPYTIFKTEAMQRPVAS

SEQ ID NO: 61022 - protein, 25 aa, synthetic construct
  source 1..25: note = Seed: VKLQTVHSIPLTINKEEALQRPVAS
VKLQTVHSIPYTIFKTEAYQRPVAS

SEQ ID NO: 61023 - protein, 25 aa, synthetic construct
  source 1..25: note = Seed: VKLQTVHSIPLTINKEEALQRPVAS
VKLQTVHSIPYTIFKVEAAQRPVAS

SEQ ID NO: 61024 - protein, 25 aa, synthetic construct
  source 1..25: note = Seed: VKLQTVHSIPLTINKEEALQRPVAS
VKLQTVHSIPYTIFKVEAEQRPVAS

SEQ ID NO: 61025 - protein, 25 aa, synthetic construct
  source 1..25: note = Seed: VKLQTVHSIPLTINKEEALQRPVAS
VKLQTVHSIPYTIFKVEAFQRPVAS

SEQ ID NO: 61026 - protein, 25 aa, synthetic construct
  source 1..25: note = Seed: VKLQTVHSIPLTINKEEALQRPVAS
VKLQTVHSIPYTIFKVEAIQRPVAS

SEQ ID NO: 61027 - protein, 25 aa, synthetic construct
  source 1..25: note = Seed: VKLQTVHSIPLTINKEEALQRPVAS
VKLQTVHSIPYTIFKVEALQRPVAS

SEQ ID NO: 61028 - protein, 25 aa, synthetic construct
  source 1..25: note = Seed: VKLQTVHSIPLTINKEEALQRPVAS
VKLQTVHSIPYTIFKVEAMQRPVAS

SEQ ID NO: 61029 - protein, 25 aa, synthetic construct
  source 1..25: note = Seed: VKLQTVHSIPLTINKEEALQRPVAS
VKLQTVHSIPYTIFKVEARQRPVAS

SEQ ID NO: 61030 - protein, 25 aa, synthetic construct
  source 1..25: note = Seed: VKLQTVHSIPLTINKEEALQRPVAS
VKLQTVHSIPYTIFKVEAVQRPVAS

SEQ ID NO: 61031 - protein, 25 aa, synthetic construct
  source 1..25: note = Seed: VKLQTVHSIPLTINKEEALQRPVAS
VKLQTVHSIPYTIFKVEAYQRPVAS

SEQ ID NO: 61032 - protein, 25 aa, synthetic construct
  source 1..25: note = Seed: VKLQTVHSIPLTINKEEALQRPVAS
VKLQTVHSIPYTIFKWEAAQRPVAS

SEQ ID NO: 61033 - protein, 25 aa, synthetic construct
  source 1..25: note = Seed: VKLQTVHSIPLTINKEEALQRPVAS
VKLQTVHSIPYTIFKWEAFQRPVAS

SEQ ID NO: 61034 - protein, 25 aa, synthetic construct
  source 1..25: note = Seed: VKLQTVHSIPLTINKEEALQRPVAS
VKLQTVHSIPYTIFKWEAIQRPVAS

SEQ ID NO: 61035 - protein, 25 aa, synthetic construct
  source 1..25: note = Seed: VKLQTVHSIPLTINKEEALQRPVAS
VKLQTVHSIPYTIFKWEALQRPVAS

SEQ ID NO: 61036 - protein, 25 aa, synthetic construct
  source 1..25: note = Seed: VKLQTVHSIPLTINKEEALQRPVAS
VKLQTVHSIPYTIFKWEAMQRPVAS

SEQ ID NO: 61037 - protein, 25 aa, synthetic construct
  source 1..25: note = Seed: VKLQTVHSIPLTINKEEALQRPVAS
VKLQTVHSIPYTIFKWEATQRPVAS

SEQ ID NO: 61038 - protein, 25 aa, synthetic construct
  source 1..25: note = Seed: VKLQTVHSIPLTINKEEALQRPVAS
VKLQTVHSIPYTIFKWEAVQRPVAS

SEQ ID NO: 61039 - protein, 25 aa, synthetic construct
  source 1..25: note = Seed: VKLQTVHSIPLTINKEEALQRPVAS
VKLQTVHSIPYTIFKWEAWQRPVAS

SEQ ID NO: 61040 - protein, 25 aa, synthetic construct
  source 1..25: note = Seed: VKLQTVHSIPLTINKEEALQRPVAS
VKLQTVHSIPYTIFKWEAYQRPVAS

SEQ ID NO: 61041 - protein, 25 aa, synthetic construct
  source 1..25: note = Seed: VKLQTVHSIPLTINKEEALQRPVAS
VKLQTVHSIPYTIFKYEAAQRPVAS

SEQ ID NO: 61042 - protein, 25 aa, synthetic construct
  source 1..25: note = Seed: VKLQTVHSIPLTINKEEALQRPVAS
VKLQTVHSIPYTIFKYEAEQRPVAS

SEQ ID NO: 61043 - protein, 25 aa, synthetic construct
  source 1..25: note = Seed: VKLQTVHSIPLTINKEEALQRPVAS
VKLQTVHSIPYTIFKYEAFQRPVAS

SEQ ID NO: 61044 - protein, 25 aa, synthetic construct
  source 1..25: note = Seed: VKLQTVHSIPLTINKEEALQRPVAS
VKLQTVHSIPYTIFKYEAIQRPVAS

SEQ ID NO: 61045 - protein, 25 aa, synthetic construct
  source 1..25: note = Seed: VKLQTVHSIPLTINKEEALQRPVAS
VKLQTVHSIPYTIFKYEALQRPVAS

SEQ ID NO: 61046 - protein, 25 aa, synthetic construct
  source 1..25: note = Seed: VKLQTVHSIPLTINKEEALQRPVAS
VKLQTVHSIPYTIFKYEAMQRPVAS

SEQ ID NO: 61047 - protein, 25 aa, synthetic construct
  source 1..25: note = Seed: VKLQTVHSIPLTINKEEALQRPVAS
VKLQTVHSIPYTIFKYEANQRPVAS

SEQ ID NO: 61048 - protein, 25 aa, synthetic construct
  source 1..25: note = Seed: VKLQTVHSIPLTINKEEALQRPVAS
VKLQTVHSIPYTIFKYEAPQRPVAS

SEQ ID NO: 61049 - protein, 25 aa, synthetic construct
  source 1..25: note = Seed: VKLQTVHSIPLTINKEEALQRPVAS
VKLQTVHSIPYTIFKYEAQQRPVAS

SEQ ID NO: 61050 - protein, 25 aa, synthetic construct
  source 1..25: note = Seed: VKLQTVHSIPLTINKEEALQRPVAS
VKLQTVHSIPYTIFKYEARQRPVAS

SEQ ID NO: 61051 - protein, 25 aa, synthetic construct
  source 1..25: note = Seed: VKLQTVHSIPLTINKEEALQRPVAS
VKLQTVHSIPYTIFKYEASQRPVAS

SEQ ID NO: 61052 - protein, 25 aa, synthetic construct
  source 1..25: note = Seed: VKLQTVHSIPLTINKEEALQRPVAS
VKLQTVHSIPYTIFKYEATQRPVAS

SEQ ID NO: 61053 - protein, 25 aa, synthetic construct
  source 1..25: note = Seed: VKLQTVHSIPLTINKEEALQRPVAS
VKLQTVHSIPYTIFKYEAVQRPVAS

SEQ ID NO: 61054 - protein, 25 aa, synthetic construct
  source 1..25: note = Seed: VKLQTVHSIPLTINKEEALQRPVAS
VKLQTVHSIPYTIFKYEAWQRPVAS

SEQ ID NO: 61055 - protein, 25 aa, synthetic construct
  source 1..25: note = Seed: VKLQTVHSIPLTINKEEALQRPVAS
VKLQTVHSIPYTIFKYEAYQRPVAS

SEQ ID NO: 61056 - protein, 25 aa, synthetic construct
  source 1..25: note = Seed: VKLQTVHSIPLTINKEEALQRPVAS
VKLQTVHSIPYTIGKFEAIQRPVAS

SEQ ID NO: 61057 - protein, 25 aa, synthetic construct
  source 1..25: note = Seed: VKLQTVHSIPLTINKEEALQRPVAS
VKLQTVHSIPYTIGKFEALQRPVAS

SEQ ID NO: 61058 - protein, 25 aa, synthetic construct
  source 1..25: note = Seed: VKLQTVHSIPLTINKEEALQRPVAS
VKLQTVHSIPYTIGKFEAVQRPVAS

SEQ ID NO: 61059 - protein, 25 aa, synthetic construct
  source 1..25: note = Seed: VKLQTVHSIPLTINKEEALQRPVAS
VKLQTVHSIPYTIHKFEAAQRPVAS

SEQ ID NO: 61060 - protein, 25 aa, synthetic construct
  source 1..25: note = Seed: VKLQTVHSIPLTINKEEALQRPVAS
VKLQTVHSIPYTIHKFEAEQRPVAS

SEQ ID NO: 61061 - protein, 25 aa, synthetic construct
  source 1..25: note = Seed: VKLQTVHSIPLTINKEEALQRPVAS
VKLQTVHSIPYTIHKFEAFQRPVAS

SEQ ID NO: 61062 - protein, 25 aa, synthetic construct
  source 1..25: note = Seed: VKLQTVHSIPLTINKEEALQRPVAS
VKLQTVHSIPYTIHKFEAIQRPVAS

SEQ ID NO: 61063 - protein, 25 aa, synthetic construct
  source 1..25: note = Seed: VKLQTVHSIPLTINKEEALQRPVAS
VKLQTVHSIPYTIHKFEALQRPVAS

SEQ ID NO: 61064 - protein, 25 aa, synthetic construct
  source 1..25: note = Seed: VKLQTVHSIPLTINKEEALQRPVAS
VKLQTVHSIPYTIHKFEAMQRPVAS

SEQ ID NO: 61065 - protein, 25 aa, synthetic construct
  source 1..25: note = Seed: VKLQTVHSIPLTINKEEALQRPVAS
VKLQTVHSIPYTIHKFEANQRPVAS

SEQ ID NO: 61066 - protein, 25 aa, synthetic construct
  source 1..25: note = Seed: VKLQTVHSIPLTINKEEALQRPVAS
VKLQTVHSIPYTIHKFEASQRPVAS

SEQ ID NO: 61067 - protein, 25 aa, synthetic construct
  source 1..25: note = Seed: VKLQTVHSIPLTINKEEALQRPVAS
VKLQTVHSIPYTIHKFEATQRPVAS

SEQ ID NO: 61068 - protein, 25 aa, synthetic construct
  source 1..25: note = Seed: VKLQTVHSIPLTINKEEALQRPVAS
VKLQTVHSIPYTIHKFEAVQRPVAS

SEQ ID NO: 61069 - protein, 25 aa, synthetic construct
  source 1..25: note = Seed: VKLQTVHSIPLTINKEEALQRPVAS
VKLQTVHSIPYTIHKFEAWQRPVAS

SEQ ID NO: 61070 - protein, 25 aa, synthetic construct
  source 1..25: note = Seed: VKLQTVHSIPLTINKEEALQRPVAS
VKLQTVHSIPYTIHKFEAYQRPVAS

SEQ ID NO: 61071 - protein, 25 aa, synthetic construct
  source 1..25: note = Seed: VKLQTVHSIPLTINKEEALQRPVAS
VKLQTVHSIPYTIHKIEALQRPVAS

SEQ ID NO: 61072 - protein, 25 aa, synthetic construct
  source 1..25: note = Seed: VKLQTVHSIPLTINKEEALQRPVAS
VKLQTVHSIPYTIHKLEAFQRPVAS

SEQ ID NO: 61073 - protein, 25 aa, synthetic construct
  source 1..25: note = Seed: VKLQTVHSIPLTINKEEALQRPVAS
VKLQTVHSIPYTIHKLEAIQRPVAS

SEQ ID NO: 61074 - protein, 25 aa, synthetic construct
  source 1..25: note = Seed: VKLQTVHSIPLTINKEEALQRPVAS
VKLQTVHSIPYTIHKLEALQRPVAS

SEQ ID NO: 61075 - protein, 25 aa, synthetic construct
  source 1..25: note = Seed: VKLQTVHSIPLTINKEEALQRPVAS
VKLQTVHSIPYTIHKLEAVQRPVAS

SEQ ID NO: 61076 - protein, 25 aa, synthetic construct
  source 1..25: note = Seed: VKLQTVHSIPLTINKEEALQRPVAS
VKLQTVHSIPYTIHKWEAIQRPVAS

SEQ ID NO: 61077 - protein, 25 aa, synthetic construct
  source 1..25: note = Seed: VKLQTVHSIPLTINKEEALQRPVAS
VKLQTVHSIPYTIHKWEALQRPVAS

SEQ ID NO: 61078 - protein, 25 aa, synthetic construct
  source 1..25: note = Seed: VKLQTVHSIPLTINKEEALQRPVAS
VKLQTVHSIPYTIHKYEAFQRPVAS

SEQ ID NO: 61079 - protein, 25 aa, synthetic construct
  source 1..25: note = Seed: VKLQTVHSIPLTINKEEALQRPVAS
VKLQTVHSIPYTIHKYEAIQRPVAS

SEQ ID NO: 61080 - protein, 25 aa, synthetic construct
  source 1..25: note = Seed: VKLQTVHSIPLTINKEEALQRPVAS
VKLQTVHSIPYTIHKYEALQRPVAS

SEQ ID NO: 61081 - protein, 25 aa, synthetic construct
  source 1..25: note = Seed: VKLQTVHSIPLTINKEEALQRPVAS
VKLQTVHSIPYTIIKAEAFQRPVAS

SEQ ID NO: 61082 - protein, 25 aa, synthetic construct
  source 1..25: note = Seed: VKLQTVHSIPLTINKEEALQRPVAS
VKLQTVHSIPYTIIKAEAIQRPVAS

SEQ ID NO: 61083 - protein, 25 aa, synthetic construct
  source 1..25: note = Seed: VKLQTVHSIPLTINKEEALQRPVAS
VKLQTVHSIPYTIIKAEALQRPVAS

SEQ ID NO: 61084 - protein, 25 aa, synthetic construct
  source 1..25: note = Seed: VKLQTVHSIPLTINKEEALQRPVAS
VKLQTVHSIPYTIIKAEARQRPVAS

SEQ ID NO: 61085 - protein, 25 aa, synthetic construct
  source 1..25: note = Seed: VKLQTVHSIPLTINKEEALQRPVAS
VKLQTVHSIPYTIIKAEAVQRPVAS

SEQ ID NO: 61086 - protein, 25 aa, synthetic construct
  source 1..25: note = Seed: VKLQTVHSIPLTINKEEALQRPVAS
VKLQTVHSIPYTIIKFEAAQRPVAS

SEQ ID NO: 61087 - protein, 25 aa, synthetic construct
  source 1..25: note = Seed: VKLQTVHSIPLTINKEEALQRPVAS
VKLQTVHSIPYTIIKFEACQRPVAS

SEQ ID NO: 61088 - protein, 25 aa, synthetic construct
  source 1..25: note = Seed: VKLQTVHSIPLTINKEEALQRPVAS
VKLQTVHSIPYTIIKFEADQRPVAS

SEQ ID NO: 61089 - protein, 25 aa, synthetic construct
  source 1..25: note = Seed: VKLQTVHSIPLTINKEEALQRPVAS
VKLQTVHSIPYTIIKFEAEQRPVAS

SEQ ID NO: 61090 - protein, 25 aa, synthetic construct
  source 1..25: note = Seed: VKLQTVHSIPLTINKEEALQRPVAS
VKLQTVHSIPYTIIKFEAFQRPVAS

SEQ ID NO: 61091 - protein, 25 aa, synthetic construct
  source 1..25: note = Seed: VKLQTVHSIPLTINKEEALQRPVAS
VKLQTVHSIPYTIIKFEAGQRPVAS

SEQ ID NO: 61092 - protein, 25 aa, synthetic construct
  source 1..25: note = Seed: VKLQTVHSIPLTINKEEALQRPVAS
VKLQTVHSIPYTIIKFEAHQRPVAS

SEQ ID NO: 61093 - protein, 25 aa, synthetic construct
  source 1..25: note = Seed: VKLQTVHSIPLTINKEEALQRPVAS
VKLQTVHSIPYTIIKFEAIQRPVAS

SEQ ID NO: 61094 - protein, 25 aa, synthetic construct
  source 1..25: note = Seed: VKLQTVHSIPLTINKEEALQRPVAS
VKLQTVHSIPYTIIKFEAKQRPVAS

SEQ ID NO: 61095 - protein, 25 aa, synthetic construct
  source 1..25: note = Seed: VKLQTVHSIPLTINKEEALQRPVAS
VKLQTVHSIPYTIIKFEALQRPVAS

SEQ ID NO: 61096 - protein, 25 aa, synthetic construct
  source 1..25: note = Seed: VKLQTVHSIPLTINKEEALQRPVAS
VKLQTVHSIPYTIIKFEAMQRPVAS

SEQ ID NO: 61097 - protein, 25 aa, synthetic construct
  source 1..25: note = Seed: VKLQTVHSIPLTINKEEALQRPVAS
VKLQTVHSIPYTIIKFEANQRPVAS

SEQ ID NO: 61098 - protein, 25 aa, synthetic construct
  source 1..25: note = Seed: VKLQTVHSIPLTINKEEALQRPVAS
VKLQTVHSIPYTIIKFEAPQRPVAS

SEQ ID NO: 61099 - protein, 25 aa, synthetic construct
  source 1..25: note = Seed: VKLQTVHSIPLTINKEEALQRPVAS
VKLQTVHSIPYTIIKFEAQQRPVAS

SEQ ID NO: 61100 - protein, 25 aa, synthetic construct
  source 1..25: note = Seed: VKLQTVHSIPLTINKEEALQRPVAS
VKLQTVHSIPYTIIKFEARQRPVAS

SEQ ID NO: 61101 - protein, 25 aa, synthetic construct
  source 1..25: note = Seed: VKLQTVHSIPLTINKEEALQRPVAS
VKLQTVHSIPYTIIKFEASQRPVAS

SEQ ID NO: 61102 - protein, 25 aa, synthetic construct
  source 1..25: note = Seed: VKLQTVHSIPLTINKEEALQRPVAS
VKLQTVHSIPYTIIKFEATQRPVAS

SEQ ID NO: 61103 - protein, 25 aa, synthetic construct
  source 1..25: note = Seed: VKLQTVHSIPLTINKEEALQRPVAS
VKLQTVHSIPYTIIKFEAVQRPVAS

SEQ ID NO: 61104 - protein, 25 aa, synthetic construct
  source 1..25: note = Seed: VKLQTVHSIPLTINKEEALQRPVAS
VKLQTVHSIPYTIIKFEAWQRPVAS

SEQ ID NO: 61105 - protein, 25 aa, synthetic construct
  source 1..25: note = Seed: VKLQTVHSIPLTINKEEALQRPVAS
VKLQTVHSIPYTIIKFEAYQRPVAS

SEQ ID NO: 61106 - protein, 25 aa, synthetic construct
  source 1..25: note = Seed: VKLQTVHSIPLTINKEEALQRPVAS
VKLQTVHSIPYTIIKIEAAQRPVAS

SEQ ID NO: 61107 - protein, 25 aa, synthetic construct
  source 1..25: note = Seed: VKLQTVHSIPLTINKEEALQRPVAS
VKLQTVHSIPYTIIKIEADQRPVAS

SEQ ID NO: 61108 - protein, 25 aa, synthetic construct
  source 1..25: note = Seed: VKLQTVHSIPLTINKEEALQRPVAS
VKLQTVHSIPYTIIKIEAFQRPVAS

SEQ ID NO: 61109 - protein, 25 aa, synthetic construct
  source 1..25: note = Seed: VKLQTVHSIPLTINKEEALQRPVAS
VKLQTVHSIPYTIIKIEAIQRPVAS

SEQ ID NO: 61110 - protein, 25 aa, synthetic construct
  source 1..25: note = Seed: VKLQTVHSIPLTINKEEALQRPVAS
VKLQTVHSIPYTIIKIEALQRPVAS

SEQ ID NO: 61111 - protein, 25 aa, synthetic construct
  source 1..25: note = Seed: VKLQTVHSIPLTINKEEALQRPVAS
VKLQTVHSIPYTIIKIEAMQRPVAS

SEQ ID NO: 61112 - protein, 25 aa, synthetic construct
  source 1..25: note = Seed: VKLQTVHSIPLTINKEEALQRPVAS
VKLQTVHSIPYTIIKIEANQRPVAS

SEQ ID NO: 61113 - protein, 25 aa, synthetic construct
  source 1..25: note = Seed: VKLQTVHSIPLTINKEEALQRPVAS
VKLQTVHSIPYTIIKIEASQRPVAS

SEQ ID NO: 61114 - protein, 25 aa, synthetic construct
  source 1..25: note = Seed: VKLQTVHSIPLTINKEEALQRPVAS
VKLQTVHSIPYTIIKIEATQRPVAS

SEQ ID NO: 61115 - protein, 25 aa, synthetic construct
  source 1..25: note = Seed: VKLQTVHSIPLTINKEEALQRPVAS
VKLQTVHSIPYTIIKIEAVQRPVAS

SEQ ID NO: 61116 - protein, 25 aa, synthetic construct
  source 1..25: note = Seed: VKLQTVHSIPLTINKEEALQRPVAS
VKLQTVHSIPYTIIKIEAYQRPVAS

SEQ ID NO: 61117 - protein, 25 aa, synthetic construct
  source 1..25: note = Seed: VKLQTVHSIPLTINKEEALQRPVAS
VKLQTVHSIPYTIIKKEAIQRPVAS

SEQ ID NO: 61118 - protein, 25 aa, synthetic construct
  source 1..25: note = Seed: VKLQTVHSIPLTINKEEALQRPVAS
VKLQTVHSIPYTIIKKEALQRPVAS

SEQ ID NO: 61119 - protein, 25 aa, synthetic construct
  source 1..25: note = Seed: VKLQTVHSIPLTINKEEALQRPVAS
VKLQTVHSIPYTIIKLEAAQRPVAS

SEQ ID NO: 61120 - protein, 25 aa, synthetic construct
  source 1..25: note = Seed: VKLQTVHSIPLTINKEEALQRPVAS
VKLQTVHSIPYTIIKLEADQRPVAS

SEQ ID NO: 61121 - protein, 25 aa, synthetic construct
  source 1..25: note = Seed: VKLQTVHSIPLTINKEEALQRPVAS
VKLQTVHSIPYTIIKLEAEQRPVAS

SEQ ID NO: 61122 - protein, 25 aa, synthetic construct
  source 1..25: note = Seed: VKLQTVHSIPLTINKEEALQRPVAS
VKLQTVHSIPYTIIKLEAFQRPVAS

SEQ ID NO: 61123 - protein, 25 aa, synthetic construct
  source 1..25: note = Seed: VKLQTVHSIPLTINKEEALQRPVAS
VKLQTVHSIPYTIIKLEAIQRPVAS

SEQ ID NO: 61124 - protein, 25 aa, synthetic construct
  source 1..25: note = Seed: VKLQTVHSIPLTINKEEALQRPVAS
VKLQTVHSIPYTIIKLEALQRPVAS

SEQ ID NO: 61125 - protein, 25 aa, synthetic construct
  source 1..25: note = Seed: VKLQTVHSIPLTINKEEALQRPVAS
VKLQTVHSIPYTIIKLEAMQRPVAS

SEQ ID NO: 61126 - protein, 25 aa, synthetic construct
  source 1..25: note = Seed: VKLQTVHSIPLTINKEEALQRPVAS
VKLQTVHSIPYTIIKLEANQRPVAS

SEQ ID NO: 61127 - protein, 25 aa, synthetic construct
  source 1..25: note = Seed: VKLQTVHSIPLTINKEEALQRPVAS
VKLQTVHSIPYTIIKLEASQRPVAS

SEQ ID NO: 61128 - protein, 25 aa, synthetic construct
  source 1..25: note = Seed: VKLQTVHSIPLTINKEEALQRPVAS
VKLQTVHSIPYTIIKLEATQRPVAS

SEQ ID NO: 61129 - protein, 25 aa, synthetic construct
  source 1..25: note = Seed: VKLQTVHSIPLTINKEEALQRPVAS
VKLQTVHSIPYTIIKLEAVQRPVAS

SEQ ID NO: 61130 - protein, 25 aa, synthetic construct
  source 1..25: note = Seed: VKLQTVHSIPLTINKEEALQRPVAS
VKLQTVHSIPYTIIKLEAWQRPVAS

SEQ ID NO: 61131 - protein, 25 aa, synthetic construct
  source 1..25: note = Seed: VKLQTVHSIPLTINKEEALQRPVAS
VKLQTVHSIPYTIIKLEAYQRPVAS

SEQ ID NO: 61132 - protein, 25 aa, synthetic construct
  source 1..25: note = Seed: VKLQTVHSIPLTINKEEALQRPVAS
VKLQTVHSIPYTIIKMEAAQRPVAS

SEQ ID NO: 61133 - protein, 25 aa, synthetic construct
  source 1..25: note = Seed: VKLQTVHSIPLTINKEEALQRPVAS
VKLQTVHSIPYTIIKMEADQRPVAS

SEQ ID NO: 61134 - protein, 25 aa, synthetic construct
  source 1..25: note = Seed: VKLQTVHSIPLTINKEEALQRPVAS
VKLQTVHSIPYTIIKMEAFQRPVAS

SEQ ID NO: 61135 - protein, 25 aa, synthetic construct
  source 1..25: note = Seed: VKLQTVHSIPLTINKEEALQRPVAS
VKLQTVHSIPYTIIKMEAIQRPVAS

SEQ ID NO: 61136 - protein, 25 aa, synthetic construct
  source 1..25: note = Seed: VKLQTVHSIPLTINKEEALQRPVAS
VKLQTVHSIPYTIIKMEALQRPVAS

SEQ ID NO: 61137 - protein, 25 aa, synthetic construct
  source 1..25: note = Seed: VKLQTVHSIPLTINKEEALQRPVAS
VKLQTVHSIPYTIIKMEAMQRPVAS

SEQ ID NO: 61138 - protein, 25 aa, synthetic construct
  source 1..25: note = Seed: VKLQTVHSIPLTINKEEALQRPVAS
VKLQTVHSIPYTIIKMEANQRPVAS

SEQ ID NO: 61139 - protein, 25 aa, synthetic construct
  source 1..25: note = Seed: VKLQTVHSIPLTINKEEALQRPVAS
VKLQTVHSIPYTIIKMEASQRPVAS

SEQ ID NO: 61140 - protein, 25 aa, synthetic construct
  source 1..25: note = Seed: VKLQTVHSIPLTINKEEALQRPVAS
VKLQTVHSIPYTIIKMEATQRPVAS

SEQ ID NO: 61141 - protein, 25 aa, synthetic construct
  source 1..25: note = Seed: VKLQTVHSIPLTINKEEALQRPVAS
VKLQTVHSIPYTIIKMEAVQRPVAS

SEQ ID NO: 61142 - protein, 25 aa, synthetic construct
  source 1..25: note = Seed: VKLQTVHSIPLTINKEEALQRPVAS
VKLQTVHSIPYTIIKMEAYQRPVAS

SEQ ID NO: 61143 - protein, 25 aa, synthetic construct
  source 1..25: note = Seed: VKLQTVHSIPLTINKEEALQRPVAS
VKLQTVHSIPYTIIKNEAAQRPVAS

SEQ ID NO: 61144 - protein, 25 aa, synthetic construct
  source 1..25: note = Seed: VKLQTVHSIPLTINKEEALQRPVAS
VKLQTVHSIPYTIIKNEADQRPVAS

SEQ ID NO: 61145 - protein, 25 aa, synthetic construct
  source 1..25: note = Seed: VKLQTVHSIPLTINKEEALQRPVAS
VKLQTVHSIPYTIIKNEAEQRPVAS

SEQ ID NO: 61146 - protein, 25 aa, synthetic construct
  source 1..25: note = Seed: VKLQTVHSIPLTINKEEALQRPVAS
VKLQTVHSIPYTIIKNEASQRPVAS

SEQ ID NO: 61147 - protein, 25 aa, synthetic construct
  source 1..25: note = Seed: VKLQTVHSIPLTINKEEALQRPVAS
VKLQTVHSIPYTIIKNEAVQRPVAS

SEQ ID NO: 61148 - protein, 25 aa, synthetic construct
  source 1..25: note = Seed: VKLQTVHSIPLTINKEEALQRPVAS
VKLQTVHSIPYTIIKREAFQRPVAS

SEQ ID NO: 61149 - protein, 25 aa, synthetic construct
  source 1..25: note = Seed: VKLQTVHSIPLTINKEEALQRPVAS
VKLQTVHSIPYTIIKREAIQRPVAS

SEQ ID NO: 61150 - protein, 25 aa, synthetic construct
  source 1..25: note = Seed: VKLQTVHSIPLTINKEEALQRPVAS
VKLQTVHSIPYTIIKREALQRPVAS

SEQ ID NO: 61151 - protein, 25 aa, synthetic construct
  source 1..25: note = Seed: VKLQTVHSIPLTINKEEALQRPVAS
VKLQTVHSIPYTIIKREARQRPVAS

SEQ ID NO: 61152 - protein, 25 aa, synthetic construct
  source 1..25: note = Seed: VKLQTVHSIPLTINKEEALQRPVAS
VKLQTVHSIPYTIIKSEAAQRPVAS

SEQ ID NO: 61153 - protein, 25 aa, synthetic construct
  source 1..25: note = Seed: VKLQTVHSIPLTINKEEALQRPVAS
VKLQTVHSIPYTIIKSEADQRPVAS

SEQ ID NO: 61154 - protein, 25 aa, synthetic construct
  source 1..25: note = Seed: VKLQTVHSIPLTINKEEALQRPVAS
VKLQTVHSIPYTIIKSEAEQRPVAS

SEQ ID NO: 61155 - protein, 25 aa, synthetic construct
  source 1..25: note = Seed: VKLQTVHSIPLTINKEEALQRPVAS
VKLQTVHSIPYTIIKSEALQRPVAS

SEQ ID NO: 61156 - protein, 25 aa, synthetic construct
  source 1..25: note = Seed: VKLQTVHSIPLTINKEEALQRPVAS
VKLQTVHSIPYTIIKSEAVQRPVAS

SEQ ID NO: 61157 - protein, 25 aa, synthetic construct
  source 1..25: note = Seed: VKLQTVHSIPLTINKEEALQRPVAS
VKLQTVHSIPYTIIKTEAAQRPVAS

SEQ ID NO: 61158 - protein, 25 aa, synthetic construct
  source 1..25: note = Seed: VKLQTVHSIPLTINKEEALQRPVAS
VKLQTVHSIPYTIIKTEADQRPVAS

SEQ ID NO: 61159 - protein, 25 aa, synthetic construct
  source 1..25: note = Seed: VKLQTVHSIPLTINKEEALQRPVAS
VKLQTVHSIPYTIIKTEAEQRPVAS

SEQ ID NO: 61160 - protein, 25 aa, synthetic construct
  source 1..25: note = Seed: VKLQTVHSIPLTINKEEALQRPVAS
VKLQTVHSIPYTIIKVEAFQRPVAS

SEQ ID NO: 61161 - protein, 25 aa, synthetic construct
  source 1..25: note = Seed: VKLQTVHSIPLTINKEEALQRPVAS
VKLQTVHSIPYTIIKVEAIQRPVAS

SEQ ID NO: 61162 - protein, 25 aa, synthetic construct
  source 1..25: note = Seed: VKLQTVHSIPLTINKEEALQRPVAS
VKLQTVHSIPYTIIKVEALQRPVAS

SEQ ID NO: 61163 - protein, 25 aa, synthetic construct
  source 1..25: note = Seed: VKLQTVHSIPLTINKEEALQRPVAS
VKLQTVHSIPYTIIKVEAVQRPVAS

SEQ ID NO: 61164 - protein, 25 aa, synthetic construct
  source 1..25: note = Seed: VKLQTVHSIPLTINKEEALQRPVAS
VKLQTVHSIPYTIIKWEAAQRPVAS

SEQ ID NO: 61165 - protein, 25 aa, synthetic construct
  source 1..25: note = Seed: VKLQTVHSIPLTINKEEALQRPVAS
VKLQTVHSIPYTIIKWEACQRPVAS

SEQ ID NO: 61166 - protein, 25 aa, synthetic construct
  source 1..25: note = Seed: VKLQTVHSIPLTINKEEALQRPVAS
VKLQTVHSIPYTIIKWEADQRPVAS

SEQ ID NO: 61167 - protein, 25 aa, synthetic construct
  source 1..25: note = Seed: VKLQTVHSIPLTINKEEALQRPVAS
VKLQTVHSIPYTIIKWEAEQRPVAS

SEQ ID NO: 61168 - protein, 25 aa, synthetic construct
  source 1..25: note = Seed: VKLQTVHSIPLTINKEEALQRPVAS
VKLQTVHSIPYTIIKWEAFQRPVAS

SEQ ID NO: 61169 - protein, 25 aa, synthetic construct
  source 1..25: note = Seed: VKLQTVHSIPLTINKEEALQRPVAS
VKLQTVHSIPYTIIKWEAHQRPVAS

SEQ ID NO: 61170 - protein, 25 aa, synthetic construct
  source 1..25: note = Seed: VKLQTVHSIPLTINKEEALQRPVAS
VKLQTVHSIPYTIIKWEAIQRPVAS

SEQ ID NO: 61171 - protein, 25 aa, synthetic construct
  source 1..25: note = Seed: VKLQTVHSIPLTINKEEALQRPVAS
VKLQTVHSIPYTIIKWEALQRPVAS

SEQ ID NO: 61172 - protein, 25 aa, synthetic construct
  source 1..25: note = Seed: VKLQTVHSIPLTINKEEALQRPVAS
VKLQTVHSIPYTIIKWEAMQRPVAS

SEQ ID NO: 61173 - protein, 25 aa, synthetic construct
  source 1..25: note = Seed: VKLQTVHSIPLTINKEEALQRPVAS
VKLQTVHSIPYTIIKWEANQRPVAS

SEQ ID NO: 61174 - protein, 25 aa, synthetic construct
  source 1..25: note = Seed: VKLQTVHSIPLTINKEEALQRPVAS
VKLQTVHSIPYTIIKWEAPQRPVAS

SEQ ID NO: 61175 - protein, 25 aa, synthetic construct
  source 1..25: note = Seed: VKLQTVHSIPLTINKEEALQRPVAS
VKLQTVHSIPYTIIKWEAQQRPVAS

SEQ ID NO: 61176 - protein, 25 aa, synthetic construct
  source 1..25: note = Seed: VKLQTVHSIPLTINKEEALQRPVAS
VKLQTVHSIPYTIIKWEASQRPVAS

SEQ ID NO: 61177 - protein, 25 aa, synthetic construct
  source 1..25: note = Seed: VKLQTVHSIPLTINKEEALQRPVAS
VKLQTVHSIPYTIIKWEATQRPVAS

SEQ ID NO: 61178 - protein, 25 aa, synthetic construct
  source 1..25: note = Seed: VKLQTVHSIPLTINKEEALQRPVAS
VKLQTVHSIPYTIIKWEAVQRPVAS

SEQ ID NO: 61179 - protein, 25 aa, synthetic construct
  source 1..25: note = Seed: VKLQTVHSIPLTINKEEALQRPVAS
VKLQTVHSIPYTIIKWEAYQRPVAS

SEQ ID NO: 61180 - protein, 25 aa, synthetic construct
  source 1..25: note = Seed: VKLQTVHSIPLTINKEEALQRPVAS
VKLQTVHSIPYTIIKYEAAQRPVAS

SEQ ID NO: 61181 - protein, 25 aa, synthetic construct
  source 1..25: note = Seed: VKLQTVHSIPLTINKEEALQRPVAS
VKLQTVHSIPYTIIKYEACQRPVAS

SEQ ID NO: 61182 - protein, 25 aa, synthetic construct
  source 1..25: note = Seed: VKLQTVHSIPLTINKEEALQRPVAS
VKLQTVHSIPYTIIKYEADQRPVAS

SEQ ID NO: 61183 - protein, 25 aa, synthetic construct
  source 1..25: note = Seed: VKLQTVHSIPLTINKEEALQRPVAS
VKLQTVHSIPYTIIKYEAEQRPVAS

SEQ ID NO: 61184 - protein, 25 aa, synthetic construct
  source 1..25: note = Seed: VKLQTVHSIPLTINKEEALQRPVAS
VKLQTVHSIPYTIIKYEAFQRPVAS

SEQ ID NO: 61185 - protein, 25 aa, synthetic construct
  source 1..25: note = Seed: VKLQTVHSIPLTINKEEALQRPVAS
VKLQTVHSIPYTIIKYEAGQRPVAS

SEQ ID NO: 61186 - protein, 25 aa, synthetic construct
  source 1..25: note = Seed: VKLQTVHSIPLTINKEEALQRPVAS
VKLQTVHSIPYTIIKYEAHQRPVAS

SEQ ID NO: 61187 - protein, 25 aa, synthetic construct
  source 1..25: note = Seed: VKLQTVHSIPLTINKEEALQRPVAS
VKLQTVHSIPYTIIKYEAIQRPVAS

SEQ ID NO: 61188 - protein, 25 aa, synthetic construct
  source 1..25: note = Seed: VKLQTVHSIPLTINKEEALQRPVAS
VKLQTVHSIPYTIIKYEALQRPVAS

SEQ ID NO: 61189 - protein, 25 aa, synthetic construct
  source 1..25: note = Seed: VKLQTVHSIPLTINKEEALQRPVAS
VKLQTVHSIPYTIIKYEAMQRPVAS

SEQ ID NO: 61190 - protein, 25 aa, synthetic construct
  source 1..25: note = Seed: VKLQTVHSIPLTINKEEALQRPVAS
VKLQTVHSIPYTIIKYEANQRPVAS

SEQ ID NO: 61191 - protein, 25 aa, synthetic construct
  source 1..25: note = Seed: VKLQTVHSIPLTINKEEALQRPVAS
VKLQTVHSIPYTIIKYEAPQRPVAS

SEQ ID NO: 61192 - protein, 25 aa, synthetic construct
  source 1..25: note = Seed: VKLQTVHSIPLTINKEEALQRPVAS
VKLQTVHSIPYTIIKYEAQQRPVAS

SEQ ID NO: 61193 - protein, 25 aa, synthetic construct
  source 1..25: note = Seed: VKLQTVHSIPLTINKEEALQRPVAS
VKLQTVHSIPYTIIKYEASQRPVAS

SEQ ID NO: 61194 - protein, 25 aa, synthetic construct
  source 1..25: note = Seed: VKLQTVHSIPLTINKEEALQRPVAS
VKLQTVHSIPYTIIKYEATQRPVAS

SEQ ID NO: 61195 - protein, 25 aa, synthetic construct
  source 1..25: note = Seed: VKLQTVHSIPLTINKEEALQRPVAS
VKLQTVHSIPYTIIKYEAVQRPVAS

SEQ ID NO: 61196 - protein, 25 aa, synthetic construct
  source 1..25: note = Seed: VKLQTVHSIPLTINKEEALQRPVAS
VKLQTVHSIPYTIIKYEAWQRPVAS

SEQ ID NO: 61197 - protein, 25 aa, synthetic construct
  source 1..25: note = Seed: VKLQTVHSIPLTINKEEALQRPVAS
VKLQTVHSIPYTIIKYEAYQRPVAS

SEQ ID NO: 61198 - protein, 25 aa, synthetic construct
  source 1..25: note = Seed: VKLQTVHSIPLTINKEEALQRPVAS
VKLQTVHSIPYTIKKFEAFQRPVAS

SEQ ID NO: 61199 - protein, 25 aa, synthetic construct
  source 1..25: note = Seed: VKLQTVHSIPLTINKEEALQRPVAS
VKLQTVHSIPYTIKKFEAIQRPVAS

SEQ ID NO: 61200 - protein, 25 aa, synthetic construct
  source 1..25: note = Seed: VKLQTVHSIPLTINKEEALQRPVAS
VKLQTVHSIPYTIKKFEALQRPVAS

SEQ ID NO: 61201 - protein, 25 aa, synthetic construct
  source 1..25: note = Seed: VKLQTVHSIPLTINKEEALQRPVAS
VKLQTVHSIPYTIKKFEAMQRPVAS

SEQ ID NO: 61202 - protein, 25 aa, synthetic construct
  source 1..25: note = Seed: VKLQTVHSIPLTINKEEALQRPVAS
VKLQTVHSIPYTIKKFEAVQRPVAS

SEQ ID NO: 61203 - protein, 25 aa, synthetic construct
  source 1..25: note = Seed: VKLQTVHSIPLTINKEEALQRPVAS
VKLQTVHSIPYTILKAEAFQRPVAS

SEQ ID NO: 61204 - protein, 25 aa, synthetic construct
  source 1..25: note = Seed: VKLQTVHSIPLTINKEEALQRPVAS
VKLQTVHSIPYTILKAEAIQRPVAS

SEQ ID NO: 61205 - protein, 25 aa, synthetic construct
  source 1..25: note = Seed: VKLQTVHSIPLTINKEEALQRPVAS
VKLQTVHSIPYTILKAEALQRPVAS

SEQ ID NO: 61206 - protein, 25 aa, synthetic construct
  source 1..25: note = Seed: VKLQTVHSIPLTINKEEALQRPVAS
VKLQTVHSIPYTILKAEAVQRPVAS

SEQ ID NO: 61207 - protein, 25 aa, synthetic construct
  source 1..25: note = Seed: VKLQTVHSIPLTINKEEALQRPVAS
VKLQTVHSIPYTILKFEAAQRPVAS

SEQ ID NO: 61208 - protein, 25 aa, synthetic construct
  source 1..25: note = Seed: VKLQTVHSIPLTINKEEALQRPVAS
VKLQTVHSIPYTILKFEACQRPVAS

SEQ ID NO: 61209 - protein, 25 aa, synthetic construct
  source 1..25: note = Seed: VKLQTVHSIPLTINKEEALQRPVAS
VKLQTVHSIPYTILKFEADQRPVAS

SEQ ID NO: 61210 - protein, 25 aa, synthetic construct
  source 1..25: note = Seed: VKLQTVHSIPLTINKEEALQRPVAS
VKLQTVHSIPYTILKFEAEQRPVAS

SEQ ID NO: 61211 - protein, 25 aa, synthetic construct
  source 1..25: note = Seed: VKLQTVHSIPLTINKEEALQRPVAS
VKLQTVHSIPYTILKFEAFQRPVAS

SEQ ID NO: 61212 - protein, 25 aa, synthetic construct
  source 1..25: note = Seed: VKLQTVHSIPLTINKEEALQRPVAS
VKLQTVHSIPYTILKFEAGQRPVAS

SEQ ID NO: 61213 - protein, 25 aa, synthetic construct
  source 1..25: note = Seed: VKLQTVHSIPLTINKEEALQRPVAS
VKLQTVHSIPYTILKFEAHQRPVAS

SEQ ID NO: 61214 - protein, 25 aa, synthetic construct
  source 1..25: note = Seed: VKLQTVHSIPLTINKEEALQRPVAS
VKLQTVHSIPYTILKFEAIQRPVAS

SEQ ID NO: 61215 - protein, 25 aa, synthetic construct
  source 1..25: note = Seed: VKLQTVHSIPLTINKEEALQRPVAS
VKLQTVHSIPYTILKFEAKQRPVAS

SEQ ID NO: 61216 - protein, 25 aa, synthetic construct
  source 1..25: note = Seed: VKLQTVHSIPLTINKEEALQRPVAS
VKLQTVHSIPYTILKFEALQRPVAS

SEQ ID NO: 61217 - protein, 25 aa, synthetic construct
  source 1..25: note = Seed: VKLQTVHSIPLTINKEEALQRPVAS
VKLQTVHSIPYTILKFEAMQRPVAS

SEQ ID NO: 61218 - protein, 25 aa, synthetic construct
  source 1..25: note = Seed: VKLQTVHSIPLTINKEEALQRPVAS
VKLQTVHSIPYTILKFEANQRPVAS

SEQ ID NO: 61219 - protein, 25 aa, synthetic construct
  source 1..25: note = Seed: VKLQTVHSIPLTINKEEALQRPVAS
VKLQTVHSIPYTILKFEAPQRPVAS

SEQ ID NO: 61220 - protein, 25 aa, synthetic construct
  source 1..25: note = Seed: VKLQTVHSIPLTINKEEALQRPVAS
VKLQTVHSIPYTILKFEAQQRPVAS

SEQ ID NO: 61221 - protein, 25 aa, synthetic construct
  source 1..25: note = Seed: VKLQTVHSIPLTINKEEALQRPVAS
VKLQTVHSIPYTILKFEARQRPVAS

SEQ ID NO: 61222 - protein, 25 aa, synthetic construct
  source 1..25: note = Seed: VKLQTVHSIPLTINKEEALQRPVAS
VKLQTVHSIPYTILKFEASQRPVAS

SEQ ID NO: 61223 - protein, 25 aa, synthetic construct
  source 1..25: note = Seed: VKLQTVHSIPLTINKEEALQRPVAS
VKLQTVHSIPYTILKFEATQRPVAS

SEQ ID NO: 61224 - protein, 25 aa, synthetic construct
  source 1..25: note = Seed: VKLQTVHSIPLTINKEEALQRPVAS
VKLQTVHSIPYTILKFEAVQRPVAS

SEQ ID NO: 61225 - protein, 25 aa, synthetic construct
  source 1..25: note = Seed: VKLQTVHSIPLTINKEEALQRPVAS
VKLQTVHSIPYTILKFEAWQRPVAS

SEQ ID NO: 61226 - protein, 25 aa, synthetic construct
  source 1..25: note = Seed: VKLQTVHSIPLTINKEEALQRPVAS
VKLQTVHSIPYTILKFEAYQRPVAS

SEQ ID NO: 61227 - protein, 25 aa, synthetic construct
  source 1..25: note = Seed: VKLQTVHSIPLTINKEEALQRPVAS
VKLQTVHSIPYTILKIEAFQRPVAS

SEQ ID NO: 61228 - protein, 25 aa, synthetic construct
  source 1..25: note = Seed: VKLQTVHSIPLTINKEEALQRPVAS
VKLQTVHSIPYTILKIEAIQRPVAS

SEQ ID NO: 61229 - protein, 25 aa, synthetic construct
  source 1..25: note = Seed: VKLQTVHSIPLTINKEEALQRPVAS
VKLQTVHSIPYTILKIEALQRPVAS

SEQ ID NO: 61230 - protein, 25 aa, synthetic construct
  source 1..25: note = Seed: VKLQTVHSIPLTINKEEALQRPVAS
VKLQTVHSIPYTILKIEAMQRPVAS

SEQ ID NO: 61231 - protein, 25 aa, synthetic construct
  source 1..25: note = Seed: VKLQTVHSIPLTINKEEALQRPVAS
VKLQTVHSIPYTILKIEATQRPVAS

SEQ ID NO: 61232 - protein, 25 aa, synthetic construct
  source 1..25: note = Seed: VKLQTVHSIPLTINKEEALQRPVAS
VKLQTVHSIPYTILKIEAVQRPVAS

SEQ ID NO: 61233 - protein, 25 aa, synthetic construct
  source 1..25: note = Seed: VKLQTVHSIPLTINKEEALQRPVAS
VKLQTVHSIPYTILKIEAYQRPVAS

SEQ ID NO: 61234 - protein, 25 aa, synthetic construct
  source 1..25: note = Seed: VKLQTVHSIPLTINKEEALQRPVAS
VKLQTVHSIPYTILKKEALQRPVAS

SEQ ID NO: 61235 - protein, 25 aa, synthetic construct
  source 1..25: note = Seed: VKLQTVHSIPLTINKEEALQRPVAS
VKLQTVHSIPYTILKLEAAQRPVAS

SEQ ID NO: 61236 - protein, 25 aa, synthetic construct
  source 1..25: note = Seed: VKLQTVHSIPLTINKEEALQRPVAS
VKLQTVHSIPYTILKLEADQRPVAS

SEQ ID NO: 61237 - protein, 25 aa, synthetic construct
  source 1..25: note = Seed: VKLQTVHSIPLTINKEEALQRPVAS
VKLQTVHSIPYTILKLEAFQRPVAS

SEQ ID NO: 61238 - protein, 25 aa, synthetic construct
  source 1..25: note = Seed: VKLQTVHSIPLTINKEEALQRPVAS
VKLQTVHSIPYTILKLEAIQRPVAS

SEQ ID NO: 61239 - protein, 25 aa, synthetic construct
  source 1..25: note = Seed: VKLQTVHSIPLTINKEEALQRPVAS
VKLQTVHSIPYTILKLEALQRPVAS

SEQ ID NO: 61240 - protein, 25 aa, synthetic construct
  source 1..25: note = Seed: VKLQTVHSIPLTINKEEALQRPVAS
VKLQTVHSIPYTILKLEAMQRPVAS

SEQ ID NO: 61241 - protein, 25 aa, synthetic construct
  source 1..25: note = Seed: VKLQTVHSIPLTINKEEALQRPVAS
VKLQTVHSIPYTILKLEANQRPVAS

SEQ ID NO: 61242 - protein, 25 aa, synthetic construct
  source 1..25: note = Seed: VKLQTVHSIPLTINKEEALQRPVAS
VKLQTVHSIPYTILKLEASQRPVAS

SEQ ID NO: 61243 - protein, 25 aa, synthetic construct
  source 1..25: note = Seed: VKLQTVHSIPLTINKEEALQRPVAS
VKLQTVHSIPYTILKLEATQRPVAS

SEQ ID NO: 61244 - protein, 25 aa, synthetic construct
  source 1..25: note = Seed: VKLQTVHSIPLTINKEEALQRPVAS
VKLQTVHSIPYTILKLEAVQRPVAS

SEQ ID NO: 61245 - protein, 25 aa, synthetic construct
  source 1..25: note = Seed: VKLQTVHSIPLTINKEEALQRPVAS
VKLQTVHSIPYTILKLEAYQRPVAS

SEQ ID NO: 61246 - protein, 25 aa, synthetic construct
  source 1..25: note = Seed: VKLQTVHSIPLTINKEEALQRPVAS
VKLQTVHSIPYTILKMEADQRPVAS

SEQ ID NO: 61247 - protein, 25 aa, synthetic construct
  source 1..25: note = Seed: VKLQTVHSIPLTINKEEALQRPVAS
VKLQTVHSIPYTILKMEAFQRPVAS

SEQ ID NO: 61248 - protein, 25 aa, synthetic construct
  source 1..25: note = Seed: VKLQTVHSIPLTINKEEALQRPVAS
VKLQTVHSIPYTILKMEAIQRPVAS

SEQ ID NO: 61249 - protein, 25 aa, synthetic construct
  source 1..25: note = Seed: VKLQTVHSIPLTINKEEALQRPVAS
VKLQTVHSIPYTILKMEALQRPVAS

SEQ ID NO: 61250 - protein, 25 aa, synthetic construct
  source 1..25: note = Seed: VKLQTVHSIPLTINKEEALQRPVAS
VKLQTVHSIPYTILKMEAMQRPVAS

SEQ ID NO: 61251 - protein, 25 aa, synthetic construct
  source 1..25: note = Seed: VKLQTVHSIPLTINKEEALQRPVAS
VKLQTVHSIPYTILKMEANQRPVAS

SEQ ID NO: 61252 - protein, 25 aa, synthetic construct
  source 1..25: note = Seed: VKLQTVHSIPLTINKEEALQRPVAS
VKLQTVHSIPYTILKMEATQRPVAS

SEQ ID NO: 61253 - protein, 25 aa, synthetic construct
  source 1..25: note = Seed: VKLQTVHSIPLTINKEEALQRPVAS
VKLQTVHSIPYTILKMEAVQRPVAS

SEQ ID NO: 61254 - protein, 25 aa, synthetic construct
  source 1..25: note = Seed: VKLQTVHSIPLTINKEEALQRPVAS
VKLQTVHSIPYTILKMEAYQRPVAS

SEQ ID NO: 61255 - protein, 25 aa, synthetic construct
  source 1..25: note = Seed: VKLQTVHSIPLTINKEEALQRPVAS
VKLQTVHSIPYTILKNEAAQRPVAS

SEQ ID NO: 61256 - protein, 25 aa, synthetic construct
  source 1..25: note = Seed: VKLQTVHSIPLTINKEEALQRPVAS
VKLQTVHSIPYTILKNEADQRPVAS

SEQ ID NO: 61257 - protein, 25 aa, synthetic construct
  source 1..25: note = Seed: VKLQTVHSIPLTINKEEALQRPVAS
VKLQTVHSIPYTILKNEAEQRPVAS

SEQ ID NO: 61258 - protein, 25 aa, synthetic construct
  source 1..25: note = Seed: VKLQTVHSIPLTINKEEALQRPVAS
VKLQTVHSIPYTILKREAFQRPVAS

SEQ ID NO: 61259 - protein, 25 aa, synthetic construct
  source 1..25: note = Seed: VKLQTVHSIPLTINKEEALQRPVAS
VKLQTVHSIPYTILKREAIQRPVAS

SEQ ID NO: 61260 - protein, 25 aa, synthetic construct
  source 1..25: note = Seed: VKLQTVHSIPLTINKEEALQRPVAS
VKLQTVHSIPYTILKREALQRPVAS

SEQ ID NO: 61261 - protein, 25 aa, synthetic construct
  source 1..25: note = Seed: VKLQTVHSIPLTINKEEALQRPVAS
VKLQTVHSIPYTILKREARQRPVAS

SEQ ID NO: 61262 - protein, 25 aa, synthetic construct
  source 1..25: note = Seed: VKLQTVHSIPLTINKEEALQRPVAS
VKLQTVHSIPYTILKSEADQRPVAS

SEQ ID NO: 61263 - protein, 25 aa, synthetic construct
  source 1..25: note = Seed: VKLQTVHSIPLTINKEEALQRPVAS
VKLQTVHSIPYTILKSEALQRPVAS

SEQ ID NO: 61264 - protein, 25 aa, synthetic construct
  source 1..25: note = Seed: VKLQTVHSIPLTINKEEALQRPVAS
VKLQTVHSIPYTILKSEAVQRPVAS

SEQ ID NO: 61265 - protein, 25 aa, synthetic construct
  source 1..25: note = Seed: VKLQTVHSIPLTINKEEALQRPVAS
VKLQTVHSIPYTILKTEADQRPVAS

SEQ ID NO: 61266 - protein, 25 aa, synthetic construct
  source 1..25: note = Seed: VKLQTVHSIPLTINKEEALQRPVAS
VKLQTVHSIPYTILKTEAEQRPVAS

SEQ ID NO: 61267 - protein, 25 aa, synthetic construct
  source 1..25: note = Seed: VKLQTVHSIPLTINKEEALQRPVAS
VKLQTVHSIPYTILKTEALQRPVAS

SEQ ID NO: 61268 - protein, 25 aa, synthetic construct
  source 1..25: note = Seed: VKLQTVHSIPLTINKEEALQRPVAS
VKLQTVHSIPYTILKVEAFQRPVAS

SEQ ID NO: 61269 - protein, 25 aa, synthetic construct
  source 1..25: note = Seed: VKLQTVHSIPLTINKEEALQRPVAS
VKLQTVHSIPYTILKVEAIQRPVAS

SEQ ID NO: 61270 - protein, 25 aa, synthetic construct
  source 1..25: note = Seed: VKLQTVHSIPLTINKEEALQRPVAS
VKLQTVHSIPYTILKVEALQRPVAS

SEQ ID NO: 61271 - protein, 25 aa, synthetic construct
  source 1..25: note = Seed: VKLQTVHSIPLTINKEEALQRPVAS
VKLQTVHSIPYTILKVEAMQRPVAS

SEQ ID NO: 61272 - protein, 25 aa, synthetic construct
  source 1..25: note = Seed: VKLQTVHSIPLTINKEEALQRPVAS
VKLQTVHSIPYTILKVEAVQRPVAS

SEQ ID NO: 61273 - protein, 25 aa, synthetic construct
  source 1..25: note = Seed: VKLQTVHSIPLTINKEEALQRPVAS
VKLQTVHSIPYTILKVEAYQRPVAS

SEQ ID NO: 61274 - protein, 25 aa, synthetic construct
  source 1..25: note = Seed: VKLQTVHSIPLTINKEEALQRPVAS
VKLQTVHSIPYTILKWEAAQRPVAS

SEQ ID NO: 61275 - protein, 25 aa, synthetic construct
  source 1..25: note = Seed: VKLQTVHSIPLTINKEEALQRPVAS
VKLQTVHSIPYTILKWEADQRPVAS

SEQ ID NO: 61276 - protein, 25 aa, synthetic construct
  source 1..25: note = Seed: VKLQTVHSIPLTINKEEALQRPVAS
VKLQTVHSIPYTILKWEAEQRPVAS

SEQ ID NO: 61277 - protein, 25 aa, synthetic construct
  source 1..25: note = Seed: VKLQTVHSIPLTINKEEALQRPVAS
VKLQTVHSIPYTILKWEAFQRPVAS

SEQ ID NO: 61278 - protein, 25 aa, synthetic construct
  source 1..25: note = Seed: VKLQTVHSIPLTINKEEALQRPVAS
VKLQTVHSIPYTILKWEAHQRPVAS

SEQ ID NO: 61279 - protein, 25 aa, synthetic construct
  source 1..25: note = Seed: VKLQTVHSIPLTINKEEALQRPVAS
VKLQTVHSIPYTILKWEAIQRPVAS

SEQ ID NO: 61280 - protein, 25 aa, synthetic construct
  source 1..25: note = Seed: VKLQTVHSIPLTINKEEALQRPVAS
VKLQTVHSIPYTILKWEALQRPVAS

SEQ ID NO: 61281 - protein, 25 aa, synthetic construct
  source 1..25: note = Seed: VKLQTVHSIPLTINKEEALQRPVAS
VKLQTVHSIPYTILKWEAMQRPVAS

SEQ ID NO: 61282 - protein, 25 aa, synthetic construct
  source 1..25: note = Seed: VKLQTVHSIPLTINKEEALQRPVAS
VKLQTVHSIPYTILKWEANQRPVAS

SEQ ID NO: 61283 - protein, 25 aa, synthetic construct
  source 1..25: note = Seed: VKLQTVHSIPLTINKEEALQRPVAS
VKLQTVHSIPYTILKWEAQQRPVAS

SEQ ID NO: 61284 - protein, 25 aa, synthetic construct
  source 1..25: note = Seed: VKLQTVHSIPLTINKEEALQRPVAS
VKLQTVHSIPYTILKWEASQRPVAS

SEQ ID NO: 61285 - protein, 25 aa, synthetic construct
  source 1..25: note = Seed: VKLQTVHSIPLTINKEEALQRPVAS
VKLQTVHSIPYTILKWEATQRPVAS

SEQ ID NO: 61286 - protein, 25 aa, synthetic construct
  source 1..25: note = Seed: VKLQTVHSIPLTINKEEALQRPVAS
VKLQTVHSIPYTILKWEAVQRPVAS

SEQ ID NO: 61287 - protein, 25 aa, synthetic construct
  source 1..25: note = Seed: VKLQTVHSIPLTINKEEALQRPVAS
VKLQTVHSIPYTILKWEAYQRPVAS

SEQ ID NO: 61288 - protein, 25 aa, synthetic construct
  source 1..25: note = Seed: VKLQTVHSIPLTINKEEALQRPVAS
VKLQTVHSIPYTILKYEAAQRPVAS

SEQ ID NO: 61289 - protein, 25 aa, synthetic construct
  source 1..25: note = Seed: VKLQTVHSIPLTINKEEALQRPVAS
VKLQTVHSIPYTILKYEACQRPVAS

SEQ ID NO: 61290 - protein, 25 aa, synthetic construct
  source 1..25: note = Seed: VKLQTVHSIPLTINKEEALQRPVAS
VKLQTVHSIPYTILKYEADQRPVAS

SEQ ID NO: 61291 - protein, 25 aa, synthetic construct
  source 1..25: note = Seed: VKLQTVHSIPLTINKEEALQRPVAS
VKLQTVHSIPYTILKYEAEQRPVAS

SEQ ID NO: 61292 - protein, 25 aa, synthetic construct
  source 1..25: note = Seed: VKLQTVHSIPLTINKEEALQRPVAS
VKLQTVHSIPYTILKYEAFQRPVAS

SEQ ID NO: 61293 - protein, 25 aa, synthetic construct
  source 1..25: note = Seed: VKLQTVHSIPLTINKEEALQRPVAS
VKLQTVHSIPYTILKYEAGQRPVAS

SEQ ID NO: 61294 - protein, 25 aa, synthetic construct
  source 1..25: note = Seed: VKLQTVHSIPLTINKEEALQRPVAS
VKLQTVHSIPYTILKYEAHQRPVAS

SEQ ID NO: 61295 - protein, 25 aa, synthetic construct
  source 1..25: note = Seed: VKLQTVHSIPLTINKEEALQRPVAS
VKLQTVHSIPYTILKYEAIQRPVAS

SEQ ID NO: 61296 - protein, 25 aa, synthetic construct
  source 1..25: note = Seed: VKLQTVHSIPLTINKEEALQRPVAS
VKLQTVHSIPYTILKYEALQRPVAS

SEQ ID NO: 61297 - protein, 25 aa, synthetic construct
  source 1..25: note = Seed: VKLQTVHSIPLTINKEEALQRPVAS
VKLQTVHSIPYTILKYEAMQRPVAS

SEQ ID NO: 61298 - protein, 25 aa, synthetic construct
  source 1..25: note = Seed: VKLQTVHSIPLTINKEEALQRPVAS
VKLQTVHSIPYTILKYEANQRPVAS

SEQ ID NO: 61299 - protein, 25 aa, synthetic construct
  source 1..25: note = Seed: VKLQTVHSIPLTINKEEALQRPVAS
VKLQTVHSIPYTILKYEAPQRPVAS

SEQ ID NO: 61300 - protein, 25 aa, synthetic construct
  source 1..25: note = Seed: VKLQTVHSIPLTINKEEALQRPVAS
VKLQTVHSIPYTILKYEAQQRPVAS

SEQ ID NO: 61301 - protein, 25 aa, synthetic construct
  source 1..25: note = Seed: VKLQTVHSIPLTINKEEALQRPVAS
VKLQTVHSIPYTILKYEASQRPVAS

SEQ ID NO: 61302 - protein, 25 aa, synthetic construct
  source 1..25: note = Seed: VKLQTVHSIPLTINKEEALQRPVAS
VKLQTVHSIPYTILKYEATQRPVAS

SEQ ID NO: 61303 - protein, 25 aa, synthetic construct
  source 1..25: note = Seed: VKLQTVHSIPLTINKEEALQRPVAS
VKLQTVHSIPYTILKYEAVQRPVAS

SEQ ID NO: 61304 - protein, 25 aa, synthetic construct
  source 1..25: note = Seed: VKLQTVHSIPLTINKEEALQRPVAS
VKLQTVHSIPYTILKYEAWQRPVAS

SEQ ID NO: 61305 - protein, 25 aa, synthetic construct
  source 1..25: note = Seed: VKLQTVHSIPLTINKEEALQRPVAS
VKLQTVHSIPYTILKYEAYQRPVAS

SEQ ID NO: 61306 - protein, 25 aa, synthetic construct
  source 1..25: note = Seed: VKLQTVHSIPLTINKEEALQRPVAS
VKLQTVHSIPYTIMKAEAFQRPVAS

SEQ ID NO: 61307 - protein, 25 aa, synthetic construct
  source 1..25: note = Seed: VKLQTVHSIPLTINKEEALQRPVAS
VKLQTVHSIPYTIMKAEAIQRPVAS

SEQ ID NO: 61308 - protein, 25 aa, synthetic construct
  source 1..25: note = Seed: VKLQTVHSIPLTINKEEALQRPVAS
VKLQTVHSIPYTIMKFEAAQRPVAS

SEQ ID NO: 61309 - protein, 25 aa, synthetic construct
  source 1..25: note = Seed: VKLQTVHSIPLTINKEEALQRPVAS
VKLQTVHSIPYTIMKFEADQRPVAS

SEQ ID NO: 61310 - protein, 25 aa, synthetic construct
  source 1..25: note = Seed: VKLQTVHSIPLTINKEEALQRPVAS
VKLQTVHSIPYTIMKFEAEQRPVAS

SEQ ID NO: 61311 - protein, 25 aa, synthetic construct
  source 1..25: note = Seed: VKLQTVHSIPLTINKEEALQRPVAS
VKLQTVHSIPYTIMKFEAFQRPVAS

SEQ ID NO: 61312 - protein, 25 aa, synthetic construct
  source 1..25: note = Seed: VKLQTVHSIPLTINKEEALQRPVAS
VKLQTVHSIPYTIMKFEAHQRPVAS

SEQ ID NO: 61313 - protein, 25 aa, synthetic construct
  source 1..25: note = Seed: VKLQTVHSIPLTINKEEALQRPVAS
VKLQTVHSIPYTIMKFEAIQRPVAS

SEQ ID NO: 61314 - protein, 25 aa, synthetic construct
  source 1..25: note = Seed: VKLQTVHSIPLTINKEEALQRPVAS
VKLQTVHSIPYTIMKFEALQRPVAS

SEQ ID NO: 61315 - protein, 25 aa, synthetic construct
  source 1..25: note = Seed: VKLQTVHSIPLTINKEEALQRPVAS
VKLQTVHSIPYTIMKFEAMQRPVAS

SEQ ID NO: 61316 - protein, 25 aa, synthetic construct
  source 1..25: note = Seed: VKLQTVHSIPLTINKEEALQRPVAS
VKLQTVHSIPYTIMKFEANQRPVAS

SEQ ID NO: 61317 - protein, 25 aa, synthetic construct
  source 1..25: note = Seed: VKLQTVHSIPLTINKEEALQRPVAS
VKLQTVHSIPYTIMKFEAPQRPVAS

SEQ ID NO: 61318 - protein, 25 aa, synthetic construct
  source 1..25: note = Seed: VKLQTVHSIPLTINKEEALQRPVAS
VKLQTVHSIPYTIMKFEARQRPVAS

SEQ ID NO: 61319 - protein, 25 aa, synthetic construct
  source 1..25: note = Seed: VKLQTVHSIPLTINKEEALQRPVAS
VKLQTVHSIPYTIMKFEASQRPVAS

SEQ ID NO: 61320 - protein, 25 aa, synthetic construct
  source 1..25: note = Seed: VKLQTVHSIPLTINKEEALQRPVAS
VKLQTVHSIPYTIMKFEATQRPVAS

SEQ ID NO: 61321 - protein, 25 aa, synthetic construct
  source 1..25: note = Seed: VKLQTVHSIPLTINKEEALQRPVAS
VKLQTVHSIPYTIMKFEAVQRPVAS

SEQ ID NO: 61322 - protein, 25 aa, synthetic construct
  source 1..25: note = Seed: VKLQTVHSIPLTINKEEALQRPVAS
VKLQTVHSIPYTIMKFEAWQRPVAS

SEQ ID NO: 61323 - protein, 25 aa, synthetic construct
  source 1..25: note = Seed: VKLQTVHSIPLTINKEEALQRPVAS
VKLQTVHSIPYTIMKFEAYQRPVAS

SEQ ID NO: 61324 - protein, 25 aa, synthetic construct
  source 1..25: note = Seed: VKLQTVHSIPLTINKEEALQRPVAS
VKLQTVHSIPYTIMKIEAAQRPVAS

SEQ ID NO: 61325 - protein, 25 aa, synthetic construct
  source 1..25: note = Seed: VKLQTVHSIPLTINKEEALQRPVAS
VKLQTVHSIPYTIMKIEAFQRPVAS

SEQ ID NO: 61326 - protein, 25 aa, synthetic construct
  source 1..25: note = Seed: VKLQTVHSIPLTINKEEALQRPVAS
VKLQTVHSIPYTIMKIEAIQRPVAS

SEQ ID NO: 61327 - protein, 25 aa, synthetic construct
  source 1..25: note = Seed: VKLQTVHSIPLTINKEEALQRPVAS
VKLQTVHSIPYTIMKIEALQRPVAS

SEQ ID NO: 61328 - protein, 25 aa, synthetic construct
  source 1..25: note = Seed: VKLQTVHSIPLTINKEEALQRPVAS
VKLQTVHSIPYTIMKIEAMQRPVAS

SEQ ID NO: 61329 - protein, 25 aa, synthetic construct
  source 1..25: note = Seed: VKLQTVHSIPLTINKEEALQRPVAS
VKLQTVHSIPYTIMKIEAVQRPVAS

SEQ ID NO: 61330 - protein, 25 aa, synthetic construct
  source 1..25: note = Seed: VKLQTVHSIPLTINKEEALQRPVAS
VKLQTVHSIPYTIMKIEAYQRPVAS

SEQ ID NO: 61331 - protein, 25 aa, synthetic construct
  source 1..25: note = Seed: VKLQTVHSIPLTINKEEALQRPVAS
VKLQTVHSIPYTIMKLEAFQRPVAS

SEQ ID NO: 61332 - protein, 25 aa, synthetic construct
  source 1..25: note = Seed: VKLQTVHSIPLTINKEEALQRPVAS
VKLQTVHSIPYTIMKLEAIQRPVAS

SEQ ID NO: 61333 - protein, 25 aa, synthetic construct
  source 1..25: note = Seed: VKLQTVHSIPLTINKEEALQRPVAS
VKLQTVHSIPYTIMKLEALQRPVAS

SEQ ID NO: 61334 - protein, 25 aa, synthetic construct
  source 1..25: note = Seed: VKLQTVHSIPLTINKEEALQRPVAS
VKLQTVHSIPYTIMKLEAMQRPVAS

SEQ ID NO: 61335 - protein, 25 aa, synthetic construct
  source 1..25: note = Seed: VKLQTVHSIPLTINKEEALQRPVAS
VKLQTVHSIPYTIMKLEAVQRPVAS

SEQ ID NO: 61336 - protein, 25 aa, synthetic construct
  source 1..25: note = Seed: VKLQTVHSIPLTINKEEALQRPVAS
VKLQTVHSIPYTIMKLEAYQRPVAS

SEQ ID NO: 61337 - protein, 25 aa, synthetic construct
  source 1..25: note = Seed: VKLQTVHSIPLTINKEEALQRPVAS
VKLQTVHSIPYTIMKMEAFQRPVAS

SEQ ID NO: 61338 - protein, 25 aa, synthetic construct
  source 1..25: note = Seed: VKLQTVHSIPLTINKEEALQRPVAS
VKLQTVHSIPYTIMKMEAIQRPVAS

SEQ ID NO: 61339 - protein, 25 aa, synthetic construct
  source 1..25: note = Seed: VKLQTVHSIPLTINKEEALQRPVAS
VKLQTVHSIPYTIMKMEALQRPVAS

SEQ ID NO: 61340 - protein, 25 aa, synthetic construct
  source 1..25: note = Seed: VKLQTVHSIPLTINKEEALQRPVAS
VKLQTVHSIPYTIMKMEAVQRPVAS

SEQ ID NO: 61341 - protein, 25 aa, synthetic construct
  source 1..25: note = Seed: VKLQTVHSIPLTINKEEALQRPVAS
VKLQTVHSIPYTIMKNEAAQRPVAS

SEQ ID NO: 61342 - protein, 25 aa, synthetic construct
  source 1..25: note = Seed: VKLQTVHSIPLTINKEEALQRPVAS
VKLQTVHSIPYTIMKNEADQRPVAS

SEQ ID NO: 61343 - protein, 25 aa, synthetic construct
  source 1..25: note = Seed: VKLQTVHSIPLTINKEEALQRPVAS
VKLQTVHSIPYTIMKNEAEQRPVAS

SEQ ID NO: 61344 - protein, 25 aa, synthetic construct
  source 1..25: note = Seed: VKLQTVHSIPLTINKEEALQRPVAS
VKLQTVHSIPYTIMKNEAIQRPVAS

SEQ ID NO: 61345 - protein, 25 aa, synthetic construct
  source 1..25: note = Seed: VKLQTVHSIPLTINKEEALQRPVAS
VKLQTVHSIPYTIMKNEALQRPVAS

SEQ ID NO: 61346 - protein, 25 aa, synthetic construct
  source 1..25: note = Seed: VKLQTVHSIPLTINKEEALQRPVAS
VKLQTVHSIPYTIMKNEAMQRPVAS

SEQ ID NO: 61347 - protein, 25 aa, synthetic construct
  source 1..25: note = Seed: VKLQTVHSIPLTINKEEALQRPVAS
VKLQTVHSIPYTIMKNEASQRPVAS

SEQ ID NO: 61348 - protein, 25 aa, synthetic construct
  source 1..25: note = Seed: VKLQTVHSIPLTINKEEALQRPVAS
VKLQTVHSIPYTIMKNEAVQRPVAS

SEQ ID NO: 61349 - protein, 25 aa, synthetic construct
  source 1..25: note = Seed: VKLQTVHSIPLTINKEEALQRPVAS
VKLQTVHSIPYTIMKREALQRPVAS

SEQ ID NO: 61350 - protein, 25 aa, synthetic construct
  source 1..25: note = Seed: VKLQTVHSIPLTINKEEALQRPVAS
VKLQTVHSIPYTIMKSEAAQRPVAS

SEQ ID NO: 61351 - protein, 25 aa, synthetic construct
  source 1..25: note = Seed: VKLQTVHSIPLTINKEEALQRPVAS
VKLQTVHSIPYTIMKSEADQRPVAS

SEQ ID NO: 61352 - protein, 25 aa, synthetic construct
  source 1..25: note = Seed: VKLQTVHSIPLTINKEEALQRPVAS
VKLQTVHSIPYTIMKSEAEQRPVAS

SEQ ID NO: 61353 - protein, 25 aa, synthetic construct
  source 1..25: note = Seed: VKLQTVHSIPLTINKEEALQRPVAS
VKLQTVHSIPYTIMKTEAAQRPVAS

SEQ ID NO: 61354 - protein, 25 aa, synthetic construct
  source 1..25: note = Seed: VKLQTVHSIPLTINKEEALQRPVAS
VKLQTVHSIPYTIMKTEADQRPVAS

SEQ ID NO: 61355 - protein, 25 aa, synthetic construct
  source 1..25: note = Seed: VKLQTVHSIPLTINKEEALQRPVAS
VKLQTVHSIPYTIMKTEAEQRPVAS

SEQ ID NO: 61356 - protein, 25 aa, synthetic construct
  source 1..25: note = Seed: VKLQTVHSIPLTINKEEALQRPVAS
VKLQTVHSIPYTIMKTEALQRPVAS

SEQ ID NO: 61357 - protein, 25 aa, synthetic construct
  source 1..25: note = Seed: VKLQTVHSIPLTINKEEALQRPVAS
VKLQTVHSIPYTIMKTEAVQRPVAS

SEQ ID NO: 61358 - protein, 25 aa, synthetic construct
  source 1..25: note = Seed: VKLQTVHSIPLTINKEEALQRPVAS
VKLQTVHSIPYTIMKVEADQRPVAS

SEQ ID NO: 61359 - protein, 25 aa, synthetic construct
  source 1..25: note = Seed: VKLQTVHSIPLTINKEEALQRPVAS
VKLQTVHSIPYTIMKVEAFQRPVAS

SEQ ID NO: 61360 - protein, 25 aa, synthetic construct
  source 1..25: note = Seed: VKLQTVHSIPLTINKEEALQRPVAS
VKLQTVHSIPYTIMKVEAIQRPVAS

SEQ ID NO: 61361 - protein, 25 aa, synthetic construct
  source 1..25: note = Seed: VKLQTVHSIPLTINKEEALQRPVAS
VKLQTVHSIPYTIMKVEALQRPVAS

SEQ ID NO: 61362 - protein, 25 aa, synthetic construct
  source 1..25: note = Seed: VKLQTVHSIPLTINKEEALQRPVAS
VKLQTVHSIPYTIMKVEAVQRPVAS

SEQ ID NO: 61363 - protein, 25 aa, synthetic construct
  source 1..25: note = Seed: VKLQTVHSIPLTINKEEALQRPVAS
VKLQTVHSIPYTIMKWEAFQRPVAS

SEQ ID NO: 61364 - protein, 25 aa, synthetic construct
  source 1..25: note = Seed: VKLQTVHSIPLTINKEEALQRPVAS
VKLQTVHSIPYTIMKWEAIQRPVAS

SEQ ID NO: 61365 - protein, 25 aa, synthetic construct
  source 1..25: note = Seed: VKLQTVHSIPLTINKEEALQRPVAS
VKLQTVHSIPYTIMKWEALQRPVAS

SEQ ID NO: 61366 - protein, 25 aa, synthetic construct
  source 1..25: note = Seed: VKLQTVHSIPLTINKEEALQRPVAS
VKLQTVHSIPYTIMKWEAMQRPVAS

SEQ ID NO: 61367 - protein, 25 aa, synthetic construct
  source 1..25: note = Seed: VKLQTVHSIPLTINKEEALQRPVAS
VKLQTVHSIPYTIMKWEAVQRPVAS

SEQ ID NO: 61368 - protein, 25 aa, synthetic construct
  source 1..25: note = Seed: VKLQTVHSIPLTINKEEALQRPVAS
VKLQTVHSIPYTIMKYEAFQRPVAS

SEQ ID NO: 61369 - protein, 25 aa, synthetic construct
  source 1..25: note = Seed: VKLQTVHSIPLTINKEEALQRPVAS
VKLQTVHSIPYTIMKYEAIQRPVAS

SEQ ID NO: 61370 - protein, 25 aa, synthetic construct
  source 1..25: note = Seed: VKLQTVHSIPLTINKEEALQRPVAS
VKLQTVHSIPYTIMKYEALQRPVAS

SEQ ID NO: 61371 - protein, 25 aa, synthetic construct
  source 1..25: note = Seed: VKLQTVHSIPLTINKEEALQRPVAS
VKLQTVHSIPYTIMKYEAMQRPVAS

SEQ ID NO: 61372 - protein, 25 aa, synthetic construct
  source 1..25: note = Seed: VKLQTVHSIPLTINKEEALQRPVAS
VKLQTVHSIPYTIMKYEAVQRPVAS

SEQ ID NO: 61373 - protein, 25 aa, synthetic construct
  source 1..25: note = Seed: VKLQTVHSIPLTINKEEALQRPVAS
VKLQTVHSIPYTIMKYEAYQRPVAS

SEQ ID NO: 61374 - protein, 25 aa, synthetic construct
  source 1..25: note = Seed: VKLQTVHSIPLTINKEEALQRPVAS
VKLQTVHSIPYTINKAEAFQRPVAS

SEQ ID NO: 61375 - protein, 25 aa, synthetic construct
  source 1..25: note = Seed: VKLQTVHSIPLTINKEEALQRPVAS
VKLQTVHSIPYTINKAEAIQRPVAS

SEQ ID NO: 61376 - protein, 25 aa, synthetic construct
  source 1..25: note = Seed: VKLQTVHSIPLTINKEEALQRPVAS
VKLQTVHSIPYTINKAEALQRPVAS

SEQ ID NO: 61377 - protein, 25 aa, synthetic construct
  source 1..25: note = Seed: VKLQTVHSIPLTINKEEALQRPVAS
VKLQTVHSIPYTINKAEAMQRPVAS

SEQ ID NO: 61378 - protein, 25 aa, synthetic construct
  source 1..25: note = Seed: VKLQTVHSIPLTINKEEALQRPVAS
VKLQTVHSIPYTINKAEAVQRPVAS

SEQ ID NO: 61379 - protein, 25 aa, synthetic construct
  source 1..25: note = Seed: VKLQTVHSIPLTINKEEALQRPVAS
VKLQTVHSIPYTINKAEAYQRPVAS

SEQ ID NO: 61380 - protein, 25 aa, synthetic construct
  source 1..25: note = Seed: VKLQTVHSIPLTINKEEALQRPVAS
VKLQTVHSIPYTINKFEAAQRPVAS

SEQ ID NO: 61381 - protein, 25 aa, synthetic construct
  source 1..25: note = Seed: VKLQTVHSIPLTINKEEALQRPVAS
VKLQTVHSIPYTINKFEAFQRPVAS

SEQ ID NO: 61382 - protein, 25 aa, synthetic construct
  source 1..25: note = Seed: VKLQTVHSIPLTINKEEALQRPVAS
VKLQTVHSIPYTINKFEAIQRPVAS

SEQ ID NO: 61383 - protein, 25 aa, synthetic construct
  source 1..25: note = Seed: VKLQTVHSIPLTINKEEALQRPVAS
VKLQTVHSIPYTINKFEALQRPVAS

SEQ ID NO: 61384 - protein, 25 aa, synthetic construct
  source 1..25: note = Seed: VKLQTVHSIPLTINKEEALQRPVAS
VKLQTVHSIPYTINKFEAMQRPVAS

SEQ ID NO: 61385 - protein, 25 aa, synthetic construct
  source 1..25: note = Seed: VKLQTVHSIPLTINKEEALQRPVAS
VKLQTVHSIPYTINKFEAVQRPVAS

SEQ ID NO: 61386 - protein, 25 aa, synthetic construct
  source 1..25: note = Seed: VKLQTVHSIPLTINKEEALQRPVAS
VKLQTVHSIPYTINKFEAYQRPVAS

SEQ ID NO: 61387 - protein, 25 aa, synthetic construct
  source 1..25: note = Seed: VKLQTVHSIPLTINKEEALQRPVAS
VKLQTVHSIPYTINKGEAIQRPVAS

SEQ ID NO: 61388 - protein, 25 aa, synthetic construct
  source 1..25: note = Seed: VKLQTVHSIPLTINKEEALQRPVAS
VKLQTVHSIPYTINKGEALQRPVAS

SEQ ID NO: 61389 - protein, 25 aa, synthetic construct
  source 1..25: note = Seed: VKLQTVHSIPLTINKEEALQRPVAS
VKLQTVHSIPYTINKGEAVQRPVAS

SEQ ID NO: 61390 - protein, 25 aa, synthetic construct
  source 1..25: note = Seed: VKLQTVHSIPLTINKEEALQRPVAS
VKLQTVHSIPYTINKIEAFQRPVAS

SEQ ID NO: 61391 - protein, 25 aa, synthetic construct
  source 1..25: note = Seed: VKLQTVHSIPLTINKEEALQRPVAS
VKLQTVHSIPYTINKIEAIQRPVAS

SEQ ID NO: 61392 - protein, 25 aa, synthetic construct
  source 1..25: note = Seed: VKLQTVHSIPLTINKEEALQRPVAS
VKLQTVHSIPYTINKIEALQRPVAS

SEQ ID NO: 61393 - protein, 25 aa, synthetic construct
  source 1..25: note = Seed: VKLQTVHSIPLTINKEEALQRPVAS
VKLQTVHSIPYTINKIEAVQRPVAS

SEQ ID NO: 61394 - protein, 25 aa, synthetic construct
  source 1..25: note = Seed: VKLQTVHSIPLTINKEEALQRPVAS
VKLQTVHSIPYTINKNEAAQRPVAS

SEQ ID NO: 61395 - protein, 25 aa, synthetic construct
  source 1..25: note = Seed: VKLQTVHSIPLTINKEEALQRPVAS
VKLQTVHSIPYTINKNEAFQRPVAS

SEQ ID NO: 61396 - protein, 25 aa, synthetic construct
  source 1..25: note = Seed: VKLQTVHSIPLTINKEEALQRPVAS
VKLQTVHSIPYTINKNEAIQRPVAS

SEQ ID NO: 61397 - protein, 25 aa, synthetic construct
  source 1..25: note = Seed: VKLQTVHSIPLTINKEEALQRPVAS
VKLQTVHSIPYTINKNEALQRPVAS

SEQ ID NO: 61398 - protein, 25 aa, synthetic construct
  source 1..25: note = Seed: VKLQTVHSIPLTINKEEALQRPVAS
VKLQTVHSIPYTINKNEAMQRPVAS

SEQ ID NO: 61399 - protein, 25 aa, synthetic construct
  source 1..25: note = Seed: VKLQTVHSIPLTINKEEALQRPVAS
VKLQTVHSIPYTINKNEAVQRPVAS

SEQ ID NO: 61400 - protein, 25 aa, synthetic construct
  source 1..25: note = Seed: VKLQTVHSIPLTINKEEALQRPVAS
VKLQTVHSIPYTINKNEAYQRPVAS

SEQ ID NO: 61401 - protein, 25 aa, synthetic construct
  source 1..25: note = Seed: VKLQTVHSIPLTINKEEALQRPVAS
VKLQTVHSIPYTINKPEAIQRPVAS

SEQ ID NO: 61402 - protein, 25 aa, synthetic construct
  source 1..25: note = Seed: VKLQTVHSIPLTINKEEALQRPVAS
VKLQTVHSIPYTINKSEAFQRPVAS

SEQ ID NO: 61403 - protein, 25 aa, synthetic construct
  source 1..25: note = Seed: VKLQTVHSIPLTINKEEALQRPVAS
VKLQTVHSIPYTINKSEAIQRPVAS

SEQ ID NO: 61404 - protein, 25 aa, synthetic construct
  source 1..25: note = Seed: VKLQTVHSIPLTINKEEALQRPVAS
VKLQTVHSIPYTINKSEALQRPVAS

SEQ ID NO: 61405 - protein, 25 aa, synthetic construct
  source 1..25: note = Seed: VKLQTVHSIPLTINKEEALQRPVAS
VKLQTVHSIPYTINKSEAMQRPVAS

SEQ ID NO: 61406 - protein, 25 aa, synthetic construct
  source 1..25: note = Seed: VKLQTVHSIPLTINKEEALQRPVAS
VKLQTVHSIPYTINKSEAVQRPVAS

SEQ ID NO: 61407 - protein, 25 aa, synthetic construct
  source 1..25: note = Seed: VKLQTVHSIPLTINKEEALQRPVAS
VKLQTVHSIPYTINKSEAYQRPVAS

SEQ ID NO: 61408 - protein, 25 aa, synthetic construct
  source 1..25: note = Seed: VKLQTVHSIPLTINKEEALQRPVAS
VKLQTVHSIPYTINKTEAIQRPVAS

SEQ ID NO: 61409 - protein, 25 aa, synthetic construct
  source 1..25: note = Seed: VKLQTVHSIPLTINKEEALQRPVAS
VKLQTVHSIPYTINKTEALQRPVAS

SEQ ID NO: 61410 - protein, 25 aa, synthetic construct
  source 1..25: note = Seed: VKLQTVHSIPLTINKEEALQRPVAS
VKLQTVHSIPYTINKTEAVQRPVAS

SEQ ID NO: 61411 - protein, 25 aa, synthetic construct
  source 1..25: note = Seed: VKLQTVHSIPLTINKEEALQRPVAS
VKLQTVHSIPYTINKVEAFQRPVAS

SEQ ID NO: 61412 - protein, 25 aa, synthetic construct
  source 1..25: note = Seed: VKLQTVHSIPLTINKEEALQRPVAS
VKLQTVHSIPYTINKVEAIQRPVAS

SEQ ID NO: 61413 - protein, 25 aa, synthetic construct
  source 1..25: note = Seed: VKLQTVHSIPLTINKEEALQRPVAS
VKLQTVHSIPYTINKVEALQRPVAS

SEQ ID NO: 61414 - protein, 25 aa, synthetic construct
  source 1..25: note = Seed: VKLQTVHSIPLTINKEEALQRPVAS
VKLQTVHSIPYTINKVEAVQRPVAS

SEQ ID NO: 61415 - protein, 25 aa, synthetic construct
  source 1..25: note = Seed: VKLQTVHSIPLTINKEEALQRPVAS
VKLQTVHSIPYTIQKFEAFQRPVAS

SEQ ID NO: 61416 - protein, 25 aa, synthetic construct
  source 1..25: note = Seed: VKLQTVHSIPLTINKEEALQRPVAS
VKLQTVHSIPYTIQKFEAIQRPVAS

SEQ ID NO: 61417 - protein, 25 aa, synthetic construct
  source 1..25: note = Seed: VKLQTVHSIPLTINKEEALQRPVAS
VKLQTVHSIPYTIQKFEALQRPVAS

SEQ ID NO: 61418 - protein, 25 aa, synthetic construct
  source 1..25: note = Seed: VKLQTVHSIPLTINKEEALQRPVAS
VKLQTVHSIPYTIQKFEAMQRPVAS

SEQ ID NO: 61419 - protein, 25 aa, synthetic construct
  source 1..25: note = Seed: VKLQTVHSIPLTINKEEALQRPVAS
VKLQTVHSIPYTIQKFEAVQRPVAS

SEQ ID NO: 61420 - protein, 25 aa, synthetic construct
  source 1..25: note = Seed: VKLQTVHSIPLTINKEEALQRPVAS
VKLQTVHSIPYTIQKFEAYQRPVAS

SEQ ID NO: 61421 - protein, 25 aa, synthetic construct
  source 1..25: note = Seed: VKLQTVHSIPLTINKEEALQRPVAS
VKLQTVHSIPYTIQKLEALQRPVAS

SEQ ID NO: 61422 - protein, 25 aa, synthetic construct
  source 1..25: note = Seed: VKLQTVHSIPLTINKEEALQRPVAS
VKLQTVHSIPYTIQKYEALQRPVAS

SEQ ID NO: 61423 - protein, 25 aa, synthetic construct
  source 1..25: note = Seed: VKLQTVHSIPLTINKEEALQRPVAS
VKLQTVHSIPYTIRKFEAFQRPVAS

SEQ ID NO: 61424 - protein, 25 aa, synthetic construct
  source 1..25: note = Seed: VKLQTVHSIPLTINKEEALQRPVAS
VKLQTVHSIPYTIRKFEAIQRPVAS

SEQ ID NO: 61425 - protein, 25 aa, synthetic construct
  source 1..25: note = Seed: VKLQTVHSIPLTINKEEALQRPVAS
VKLQTVHSIPYTIRKFEALQRPVAS

SEQ ID NO: 61426 - protein, 25 aa, synthetic construct
  source 1..25: note = Seed: VKLQTVHSIPLTINKEEALQRPVAS
VKLQTVHSIPYTIRKFEAVQRPVAS

SEQ ID NO: 61427 - protein, 25 aa, synthetic construct
  source 1..25: note = Seed: VKLQTVHSIPLTINKEEALQRPVAS
VKLQTVHSIPYTIRKREAFQRPVAS

SEQ ID NO: 61428 - protein, 25 aa, synthetic construct
  source 1..25: note = Seed: VKLQTVHSIPLTINKEEALQRPVAS
VKLQTVHSIPYTIRKREAIQRPVAS

SEQ ID NO: 61429 - protein, 25 aa, synthetic construct
  source 1..25: note = Seed: VKLQTVHSIPLTINKEEALQRPVAS
VKLQTVHSIPYTIRKREALQRPVAS

SEQ ID NO: 61430 - protein, 25 aa, synthetic construct
  source 1..25: note = Seed: VKLQTVHSIPLTINKEEALQRPVAS
VKLQTVHSIPYTISKFEAAQRPVAS

SEQ ID NO: 61431 - protein, 25 aa, synthetic construct
  source 1..25: note = Seed: VKLQTVHSIPLTINKEEALQRPVAS
VKLQTVHSIPYTISKFEAEQRPVAS

SEQ ID NO: 61432 - protein, 25 aa, synthetic construct
  source 1..25: note = Seed: VKLQTVHSIPLTINKEEALQRPVAS
VKLQTVHSIPYTISKFEAFQRPVAS

SEQ ID NO: 61433 - protein, 25 aa, synthetic construct
  source 1..25: note = Seed: VKLQTVHSIPLTINKEEALQRPVAS
VKLQTVHSIPYTISKFEAIQRPVAS

SEQ ID NO: 61434 - protein, 25 aa, synthetic construct
  source 1..25: note = Seed: VKLQTVHSIPLTINKEEALQRPVAS
VKLQTVHSIPYTISKFEALQRPVAS

SEQ ID NO: 61435 - protein, 25 aa, synthetic construct
  source 1..25: note = Seed: VKLQTVHSIPLTINKEEALQRPVAS
VKLQTVHSIPYTISKFEAMQRPVAS

SEQ ID NO: 61436 - protein, 25 aa, synthetic construct
  source 1..25: note = Seed: VKLQTVHSIPLTINKEEALQRPVAS
VKLQTVHSIPYTISKFEANQRPVAS

SEQ ID NO: 61437 - protein, 25 aa, synthetic construct
  source 1..25: note = Seed: VKLQTVHSIPLTINKEEALQRPVAS
VKLQTVHSIPYTISKFEASQRPVAS

SEQ ID NO: 61438 - protein, 25 aa, synthetic construct
  source 1..25: note = Seed: VKLQTVHSIPLTINKEEALQRPVAS
VKLQTVHSIPYTISKFEATQRPVAS

SEQ ID NO: 61439 - protein, 25 aa, synthetic construct
  source 1..25: note = Seed: VKLQTVHSIPLTINKEEALQRPVAS
VKLQTVHSIPYTISKFEAVQRPVAS

SEQ ID NO: 61440 - protein, 25 aa, synthetic construct
  source 1..25: note = Seed: VKLQTVHSIPLTINKEEALQRPVAS
VKLQTVHSIPYTISKFEAYQRPVAS

SEQ ID NO: 61441 - protein, 25 aa, synthetic construct
  source 1..25: note = Seed: VKLQTVHSIPLTINKEEALQRPVAS
VKLQTVHSIPYTISKLEAIQRPVAS

SEQ ID NO: 61442 - protein, 25 aa, synthetic construct
  source 1..25: note = Seed: VKLQTVHSIPLTINKEEALQRPVAS
VKLQTVHSIPYTISKLEALQRPVAS

SEQ ID NO: 61443 - protein, 25 aa, synthetic construct
  source 1..25: note = Seed: VKLQTVHSIPLTINKEEALQRPVAS
VKLQTVHSIPYTISKLEAVQRPVAS

SEQ ID NO: 61444 - protein, 25 aa, synthetic construct
  source 1..25: note = Seed: VKLQTVHSIPLTINKEEALQRPVAS
VKLQTVHSIPYTISKWEAIQRPVAS

SEQ ID NO: 61445 - protein, 25 aa, synthetic construct
  source 1..25: note = Seed: VKLQTVHSIPLTINKEEALQRPVAS
VKLQTVHSIPYTISKWEALQRPVAS

SEQ ID NO: 61446 - protein, 25 aa, synthetic construct
  source 1..25: note = Seed: VKLQTVHSIPLTINKEEALQRPVAS
VKLQTVHSIPYTISKWEAVQRPVAS

SEQ ID NO: 61447 - protein, 25 aa, synthetic construct
  source 1..25: note = Seed: VKLQTVHSIPLTINKEEALQRPVAS
VKLQTVHSIPYTISKYEAFQRPVAS

SEQ ID NO: 61448 - protein, 25 aa, synthetic construct
  source 1..25: note = Seed: VKLQTVHSIPLTINKEEALQRPVAS
VKLQTVHSIPYTISKYEAIQRPVAS

SEQ ID NO: 61449 - protein, 25 aa, synthetic construct
  source 1..25: note = Seed: VKLQTVHSIPLTINKEEALQRPVAS
VKLQTVHSIPYTISKYEALQRPVAS

SEQ ID NO: 61450 - protein, 25 aa, synthetic construct
  source 1..25: note = Seed: VKLQTVHSIPLTINKEEALQRPVAS
VKLQTVHSIPYTISKYEAVQRPVAS

SEQ ID NO: 61451 - protein, 25 aa, synthetic construct
  source 1..25: note = Seed: VKLQTVHSIPLTINKEEALQRPVAS
VKLQTVHSIPYTITKFEAAQRPVAS

SEQ ID NO: 61452 - protein, 25 aa, synthetic construct
  source 1..25: note = Seed: VKLQTVHSIPLTINKEEALQRPVAS
VKLQTVHSIPYTITKFEACQRPVAS

SEQ ID NO: 61453 - protein, 25 aa, synthetic construct
  source 1..25: note = Seed: VKLQTVHSIPLTINKEEALQRPVAS
VKLQTVHSIPYTITKFEADQRPVAS

SEQ ID NO: 61454 - protein, 25 aa, synthetic construct
  source 1..25: note = Seed: VKLQTVHSIPLTINKEEALQRPVAS
VKLQTVHSIPYTITKFEAEQRPVAS

SEQ ID NO: 61455 - protein, 25 aa, synthetic construct
  source 1..25: note = Seed: VKLQTVHSIPLTINKEEALQRPVAS
VKLQTVHSIPYTITKFEAFQRPVAS

SEQ ID NO: 61456 - protein, 25 aa, synthetic construct
  source 1..25: note = Seed: VKLQTVHSIPLTINKEEALQRPVAS
VKLQTVHSIPYTITKFEAIQRPVAS

SEQ ID NO: 61457 - protein, 25 aa, synthetic construct
  source 1..25: note = Seed: VKLQTVHSIPLTINKEEALQRPVAS
VKLQTVHSIPYTITKFEALQRPVAS

SEQ ID NO: 61458 - protein, 25 aa, synthetic construct
  source 1..25: note = Seed: VKLQTVHSIPLTINKEEALQRPVAS
VKLQTVHSIPYTITKFEAMQRPVAS

SEQ ID NO: 61459 - protein, 25 aa, synthetic construct
  source 1..25: note = Seed: VKLQTVHSIPLTINKEEALQRPVAS
VKLQTVHSIPYTITKFEANQRPVAS

SEQ ID NO: 61460 - protein, 25 aa, synthetic construct
  source 1..25: note = Seed: VKLQTVHSIPLTINKEEALQRPVAS
VKLQTVHSIPYTITKFEASQRPVAS

SEQ ID NO: 61461 - protein, 25 aa, synthetic construct
  source 1..25: note = Seed: VKLQTVHSIPLTINKEEALQRPVAS
VKLQTVHSIPYTITKFEATQRPVAS

SEQ ID NO: 61462 - protein, 25 aa, synthetic construct
  source 1..25: note = Seed: VKLQTVHSIPLTINKEEALQRPVAS
VKLQTVHSIPYTITKFEAVQRPVAS

SEQ ID NO: 61463 - protein, 25 aa, synthetic construct
  source 1..25: note = Seed: VKLQTVHSIPLTINKEEALQRPVAS
VKLQTVHSIPYTITKFEAWQRPVAS

SEQ ID NO: 61464 - protein, 25 aa, synthetic construct
  source 1..25: note = Seed: VKLQTVHSIPLTINKEEALQRPVAS
VKLQTVHSIPYTITKFEAYQRPVAS

SEQ ID NO: 61465 - protein, 25 aa, synthetic construct
  source 1..25: note = Seed: VKLQTVHSIPLTINKEEALQRPVAS
VKLQTVHSIPYTITKIEAIQRPVAS

SEQ ID NO: 61466 - protein, 25 aa, synthetic construct
  source 1..25: note = Seed: VKLQTVHSIPLTINKEEALQRPVAS
VKLQTVHSIPYTITKIEALQRPVAS

SEQ ID NO: 61467 - protein, 25 aa, synthetic construct
  source 1..25: note = Seed: VKLQTVHSIPLTINKEEALQRPVAS
VKLQTVHSIPYTITKIEAVQRPVAS

SEQ ID NO: 61468 - protein, 25 aa, synthetic construct
  source 1..25: note = Seed: VKLQTVHSIPLTINKEEALQRPVAS
VKLQTVHSIPYTITKLEAFQRPVAS

SEQ ID NO: 61469 - protein, 25 aa, synthetic construct
  source 1..25: note = Seed: VKLQTVHSIPLTINKEEALQRPVAS
VKLQTVHSIPYTITKLEAIQRPVAS

SEQ ID NO: 61470 - protein, 25 aa, synthetic construct
  source 1..25: note = Seed: VKLQTVHSIPLTINKEEALQRPVAS
VKLQTVHSIPYTITKLEALQRPVAS

SEQ ID NO: 61471 - protein, 25 aa, synthetic construct
  source 1..25: note = Seed: VKLQTVHSIPLTINKEEALQRPVAS
VKLQTVHSIPYTITKLEAVQRPVAS

SEQ ID NO: 61472 - protein, 25 aa, synthetic construct
  source 1..25: note = Seed: VKLQTVHSIPLTINKEEALQRPVAS
VKLQTVHSIPYTITKMEAIQRPVAS

SEQ ID NO: 61473 - protein, 25 aa, synthetic construct
  source 1..25: note = Seed: VKLQTVHSIPLTINKEEALQRPVAS
VKLQTVHSIPYTITKMEALQRPVAS

SEQ ID NO: 61474 - protein, 25 aa, synthetic construct
  source 1..25: note = Seed: VKLQTVHSIPLTINKEEALQRPVAS
VKLQTVHSIPYTITKWEAFQRPVAS

SEQ ID NO: 61475 - protein, 25 aa, synthetic construct
  source 1..25: note = Seed: VKLQTVHSIPLTINKEEALQRPVAS
VKLQTVHSIPYTITKWEAIQRPVAS

SEQ ID NO: 61476 - protein, 25 aa, synthetic construct
  source 1..25: note = Seed: VKLQTVHSIPLTINKEEALQRPVAS
VKLQTVHSIPYTITKWEALQRPVAS

SEQ ID NO: 61477 - protein, 25 aa, synthetic construct
  source 1..25: note = Seed: VKLQTVHSIPLTINKEEALQRPVAS
VKLQTVHSIPYTITKWEAVQRPVAS

SEQ ID NO: 61478 - protein, 25 aa, synthetic construct
  source 1..25: note = Seed: VKLQTVHSIPLTINKEEALQRPVAS
VKLQTVHSIPYTITKYEAFQRPVAS

SEQ ID NO: 61479 - protein, 25 aa, synthetic construct
  source 1..25: note = Seed: VKLQTVHSIPLTINKEEALQRPVAS
VKLQTVHSIPYTITKYEAIQRPVAS

SEQ ID NO: 61480 - protein, 25 aa, synthetic construct
  source 1..25: note = Seed: VKLQTVHSIPLTINKEEALQRPVAS
VKLQTVHSIPYTITKYEALQRPVAS

SEQ ID NO: 61481 - protein, 25 aa, synthetic construct
  source 1..25: note = Seed: VKLQTVHSIPLTINKEEALQRPVAS
VKLQTVHSIPYTITKYEAMQRPVAS

SEQ ID NO: 61482 - protein, 25 aa, synthetic construct
  source 1..25: note = Seed: VKLQTVHSIPLTINKEEALQRPVAS
VKLQTVHSIPYTITKYEAVQRPVAS

SEQ ID NO: 61483 - protein, 25 aa, synthetic construct
  source 1..25: note = Seed: VKLQTVHSIPLTINKEEALQRPVAS
VKLQTVHSIPYTIVKAEAFQRPVAS

SEQ ID NO: 61484 - protein, 25 aa, synthetic construct
  source 1..25: note = Seed: VKLQTVHSIPLTINKEEALQRPVAS
VKLQTVHSIPYTIVKAEAIQRPVAS

SEQ ID NO: 61485 - protein, 25 aa, synthetic construct
  source 1..25: note = Seed: VKLQTVHSIPLTINKEEALQRPVAS
VKLQTVHSIPYTIVKAEAVQRPVAS

SEQ ID NO: 61486 - protein, 25 aa, synthetic construct
  source 1..25: note = Seed: VKLQTVHSIPLTINKEEALQRPVAS
VKLQTVHSIPYTIVKFEAAQRPVAS

SEQ ID NO: 61487 - protein, 25 aa, synthetic construct
  source 1..25: note = Seed: VKLQTVHSIPLTINKEEALQRPVAS
VKLQTVHSIPYTIVKFEACQRPVAS

SEQ ID NO: 61488 - protein, 25 aa, synthetic construct
  source 1..25: note = Seed: VKLQTVHSIPLTINKEEALQRPVAS
VKLQTVHSIPYTIVKFEADQRPVAS

SEQ ID NO: 61489 - protein, 25 aa, synthetic construct
  source 1..25: note = Seed: VKLQTVHSIPLTINKEEALQRPVAS
VKLQTVHSIPYTIVKFEAEQRPVAS

SEQ ID NO: 61490 - protein, 25 aa, synthetic construct
  source 1..25: note = Seed: VKLQTVHSIPLTINKEEALQRPVAS
VKLQTVHSIPYTIVKFEAFQRPVAS

SEQ ID NO: 61491 - protein, 25 aa, synthetic construct
  source 1..25: note = Seed: VKLQTVHSIPLTINKEEALQRPVAS
VKLQTVHSIPYTIVKFEAGQRPVAS

SEQ ID NO: 61492 - protein, 25 aa, synthetic construct
  source 1..25: note = Seed: VKLQTVHSIPLTINKEEALQRPVAS
VKLQTVHSIPYTIVKFEAHQRPVAS

SEQ ID NO: 61493 - protein, 25 aa, synthetic construct
  source 1..25: note = Seed: VKLQTVHSIPLTINKEEALQRPVAS
VKLQTVHSIPYTIVKFEAIQRPVAS

SEQ ID NO: 61494 - protein, 25 aa, synthetic construct
  source 1..25: note = Seed: VKLQTVHSIPLTINKEEALQRPVAS
VKLQTVHSIPYTIVKFEAKQRPVAS

SEQ ID NO: 61495 - protein, 25 aa, synthetic construct
  source 1..25: note = Seed: VKLQTVHSIPLTINKEEALQRPVAS
VKLQTVHSIPYTIVKFEALQRPVAS

SEQ ID NO: 61496 - protein, 25 aa, synthetic construct
  source 1..25: note = Seed: VKLQTVHSIPLTINKEEALQRPVAS
VKLQTVHSIPYTIVKFEAMQRPVAS

SEQ ID NO: 61497 - protein, 25 aa, synthetic construct
  source 1..25: note = Seed: VKLQTVHSIPLTINKEEALQRPVAS
VKLQTVHSIPYTIVKFEANQRPVAS

SEQ ID NO: 61498 - protein, 25 aa, synthetic construct
  source 1..25: note = Seed: VKLQTVHSIPLTINKEEALQRPVAS
VKLQTVHSIPYTIVKFEAPQRPVAS

SEQ ID NO: 61499 - protein, 25 aa, synthetic construct
  source 1..25: note = Seed: VKLQTVHSIPLTINKEEALQRPVAS
VKLQTVHSIPYTIVKFEAQQRPVAS

SEQ ID NO: 61500 - protein, 25 aa, synthetic construct
  source 1..25: note = Seed: VKLQTVHSIPLTINKEEALQRPVAS
VKLQTVHSIPYTIVKFEARQRPVAS

SEQ ID NO: 61501 - protein, 25 aa, synthetic construct
  source 1..25: note = Seed: VKLQTVHSIPLTINKEEALQRPVAS
VKLQTVHSIPYTIVKFEASQRPVAS

SEQ ID NO: 61502 - protein, 25 aa, synthetic construct
  source 1..25: note = Seed: VKLQTVHSIPLTINKEEALQRPVAS
VKLQTVHSIPYTIVKFEATQRPVAS

SEQ ID NO: 61503 - protein, 25 aa, synthetic construct
  source 1..25: note = Seed: VKLQTVHSIPLTINKEEALQRPVAS
VKLQTVHSIPYTIVKFEAVQRPVAS

SEQ ID NO: 61504 - protein, 25 aa, synthetic construct
  source 1..25: note = Seed: VKLQTVHSIPLTINKEEALQRPVAS
VKLQTVHSIPYTIVKFEAWQRPVAS

SEQ ID NO: 61505 - protein, 25 aa, synthetic construct
  source 1..25: note = Seed: VKLQTVHSIPLTINKEEALQRPVAS
VKLQTVHSIPYTIVKFEAYQRPVAS

SEQ ID NO: 61506 - protein, 25 aa, synthetic construct
  source 1..25: note = Seed: VKLQTVHSIPLTINKEEALQRPVAS
VKLQTVHSIPYTIVKIEAFQRPVAS

SEQ ID NO: 61507 - protein, 25 aa, synthetic construct
  source 1..25: note = Seed: VKLQTVHSIPLTINKEEALQRPVAS
VKLQTVHSIPYTIVKIEAIQRPVAS

SEQ ID NO: 61508 - protein, 25 aa, synthetic construct
  source 1..25: note = Seed: VKLQTVHSIPLTINKEEALQRPVAS
VKLQTVHSIPYTIVKIEALQRPVAS

SEQ ID NO: 61509 - protein, 25 aa, synthetic construct
  source 1..25: note = Seed: VKLQTVHSIPLTINKEEALQRPVAS
VKLQTVHSIPYTIVKIEANQRPVAS

SEQ ID NO: 61510 - protein, 25 aa, synthetic construct
  source 1..25: note = Seed: VKLQTVHSIPLTINKEEALQRPVAS
VKLQTVHSIPYTIVKIEATQRPVAS

SEQ ID NO: 61511 - protein, 25 aa, synthetic construct
  source 1..25: note = Seed: VKLQTVHSIPLTINKEEALQRPVAS
VKLQTVHSIPYTIVKIEAVQRPVAS

SEQ ID NO: 61512 - protein, 25 aa, synthetic construct
  source 1..25: note = Seed: VKLQTVHSIPLTINKEEALQRPVAS
VKLQTVHSIPYTIVKLEAAQRPVAS

SEQ ID NO: 61513 - protein, 25 aa, synthetic construct
  source 1..25: note = Seed: VKLQTVHSIPLTINKEEALQRPVAS
VKLQTVHSIPYTIVKLEADQRPVAS

SEQ ID NO: 61514 - protein, 25 aa, synthetic construct
  source 1..25: note = Seed: VKLQTVHSIPLTINKEEALQRPVAS
VKLQTVHSIPYTIVKLEAEQRPVAS

SEQ ID NO: 61515 - protein, 25 aa, synthetic construct
  source 1..25: note = Seed: VKLQTVHSIPLTINKEEALQRPVAS
VKLQTVHSIPYTIVKLEAFQRPVAS

SEQ ID NO: 61516 - protein, 25 aa, synthetic construct
  source 1..25: note = Seed: VKLQTVHSIPLTINKEEALQRPVAS
VKLQTVHSIPYTIVKLEAIQRPVAS

SEQ ID NO: 61517 - protein, 25 aa, synthetic construct
  source 1..25: note = Seed: VKLQTVHSIPLTINKEEALQRPVAS
VKLQTVHSIPYTIVKLEALQRPVAS

SEQ ID NO: 61518 - protein, 25 aa, synthetic construct
  source 1..25: note = Seed: VKLQTVHSIPLTINKEEALQRPVAS
VKLQTVHSIPYTIVKLEAMQRPVAS

SEQ ID NO: 61519 - protein, 25 aa, synthetic construct
  source 1..25: note = Seed: VKLQTVHSIPLTINKEEALQRPVAS
VKLQTVHSIPYTIVKLEANQRPVAS

SEQ ID NO: 61520 - protein, 25 aa, synthetic construct
  source 1..25: note = Seed: VKLQTVHSIPLTINKEEALQRPVAS
VKLQTVHSIPYTIVKLEASQRPVAS

SEQ ID NO: 61521 - protein, 25 aa, synthetic construct
  source 1..25: note = Seed: VKLQTVHSIPLTINKEEALQRPVAS
VKLQTVHSIPYTIVKLEATQRPVAS

SEQ ID NO: 61522 - protein, 25 aa, synthetic construct
  source 1..25: note = Seed: VKLQTVHSIPLTINKEEALQRPVAS
VKLQTVHSIPYTIVKLEAVQRPVAS

SEQ ID NO: 61523 - protein, 25 aa, synthetic construct
  source 1..25: note = Seed: VKLQTVHSIPLTINKEEALQRPVAS
VKLQTVHSIPYTIVKLEAYQRPVAS

SEQ ID NO: 61524 - protein, 25 aa, synthetic construct
  source 1..25: note = Seed: VKLQTVHSIPLTINKEEALQRPVAS
VKLQTVHSIPYTIVKMEAAQRPVAS

SEQ ID NO: 61525 - protein, 25 aa, synthetic construct
  source 1..25: note = Seed: VKLQTVHSIPLTINKEEALQRPVAS
VKLQTVHSIPYTIVKMEAFQRPVAS

SEQ ID NO: 61526 - protein, 25 aa, synthetic construct
  source 1..25: note = Seed: VKLQTVHSIPLTINKEEALQRPVAS
VKLQTVHSIPYTIVKMEAIQRPVAS

SEQ ID NO: 61527 - protein, 25 aa, synthetic construct
  source 1..25: note = Seed: VKLQTVHSIPLTINKEEALQRPVAS
VKLQTVHSIPYTIVKMEALQRPVAS

SEQ ID NO: 61528 - protein, 25 aa, synthetic construct
  source 1..25: note = Seed: VKLQTVHSIPLTINKEEALQRPVAS
VKLQTVHSIPYTIVKMEANQRPVAS

SEQ ID NO: 61529 - protein, 25 aa, synthetic construct
  source 1..25: note = Seed: VKLQTVHSIPLTINKEEALQRPVAS
VKLQTVHSIPYTIVKMEATQRPVAS

SEQ ID NO: 61530 - protein, 25 aa, synthetic construct
  source 1..25: note = Seed: VKLQTVHSIPLTINKEEALQRPVAS
VKLQTVHSIPYTIVKMEAVQRPVAS

SEQ ID NO: 61531 - protein, 25 aa, synthetic construct
  source 1..25: note = Seed: VKLQTVHSIPLTINKEEALQRPVAS
VKLQTVHSIPYTIVKVEAFQRPVAS

SEQ ID NO: 61532 - protein, 25 aa, synthetic construct
  source 1..25: note = Seed: VKLQTVHSIPLTINKEEALQRPVAS
VKLQTVHSIPYTIVKVEAIQRPVAS

SEQ ID NO: 61533 - protein, 25 aa, synthetic construct
  source 1..25: note = Seed: VKLQTVHSIPLTINKEEALQRPVAS
VKLQTVHSIPYTIVKVEALQRPVAS

SEQ ID NO: 61534 - protein, 25 aa, synthetic construct
  source 1..25: note = Seed: VKLQTVHSIPLTINKEEALQRPVAS
VKLQTVHSIPYTIVKVEAVQRPVAS

SEQ ID NO: 61535 - protein, 25 aa, synthetic construct
  source 1..25: note = Seed: VKLQTVHSIPLTINKEEALQRPVAS
VKLQTVHSIPYTIVKWEAAQRPVAS

SEQ ID NO: 61536 - protein, 25 aa, synthetic construct
  source 1..25: note = Seed: VKLQTVHSIPLTINKEEALQRPVAS
VKLQTVHSIPYTIVKWEADQRPVAS

SEQ ID NO: 61537 - protein, 25 aa, synthetic construct
  source 1..25: note = Seed: VKLQTVHSIPLTINKEEALQRPVAS
VKLQTVHSIPYTIVKWEAEQRPVAS

SEQ ID NO: 61538 - protein, 25 aa, synthetic construct
  source 1..25: note = Seed: VKLQTVHSIPLTINKEEALQRPVAS
VKLQTVHSIPYTIVKWEAFQRPVAS

SEQ ID NO: 61539 - protein, 25 aa, synthetic construct
  source 1..25: note = Seed: VKLQTVHSIPLTINKEEALQRPVAS
VKLQTVHSIPYTIVKWEAIQRPVAS

SEQ ID NO: 61540 - protein, 25 aa, synthetic construct
  source 1..25: note = Seed: VKLQTVHSIPLTINKEEALQRPVAS
VKLQTVHSIPYTIVKWEALQRPVAS

SEQ ID NO: 61541 - protein, 25 aa, synthetic construct
  source 1..25: note = Seed: VKLQTVHSIPLTINKEEALQRPVAS
VKLQTVHSIPYTIVKWEAMQRPVAS

SEQ ID NO: 61542 - protein, 25 aa, synthetic construct
  source 1..25: note = Seed: VKLQTVHSIPLTINKEEALQRPVAS
VKLQTVHSIPYTIVKWEANQRPVAS

SEQ ID NO: 61543 - protein, 25 aa, synthetic construct
  source 1..25: note = Seed: VKLQTVHSIPLTINKEEALQRPVAS
VKLQTVHSIPYTIVKWEAQQRPVAS

SEQ ID NO: 61544 - protein, 25 aa, synthetic construct
  source 1..25: note = Seed: VKLQTVHSIPLTINKEEALQRPVAS
VKLQTVHSIPYTIVKWEASQRPVAS

SEQ ID NO: 61545 - protein, 25 aa, synthetic construct
  source 1..25: note = Seed: VKLQTVHSIPLTINKEEALQRPVAS
VKLQTVHSIPYTIVKWEATQRPVAS

SEQ ID NO: 61546 - protein, 25 aa, synthetic construct
  source 1..25: note = Seed: VKLQTVHSIPLTINKEEALQRPVAS
VKLQTVHSIPYTIVKWEAVQRPVAS

SEQ ID NO: 61547 - protein, 25 aa, synthetic construct
  source 1..25: note = Seed: VKLQTVHSIPLTINKEEALQRPVAS
VKLQTVHSIPYTIVKWEAYQRPVAS

SEQ ID NO: 61548 - protein, 25 aa, synthetic construct
  source 1..25: note = Seed: VKLQTVHSIPLTINKEEALQRPVAS
VKLQTVHSIPYTIVKYEAAQRPVAS

SEQ ID NO: 61549 - protein, 25 aa, synthetic construct
  source 1..25: note = Seed: VKLQTVHSIPLTINKEEALQRPVAS
VKLQTVHSIPYTIVKYEACQRPVAS

SEQ ID NO: 61550 - protein, 25 aa, synthetic construct
  source 1..25: note = Seed: VKLQTVHSIPLTINKEEALQRPVAS
VKLQTVHSIPYTIVKYEADQRPVAS

SEQ ID NO: 61551 - protein, 25 aa, synthetic construct
  source 1..25: note = Seed: VKLQTVHSIPLTINKEEALQRPVAS
VKLQTVHSIPYTIVKYEAEQRPVAS

SEQ ID NO: 61552 - protein, 25 aa, synthetic construct
  source 1..25: note = Seed: VKLQTVHSIPLTINKEEALQRPVAS
VKLQTVHSIPYTIVKYEAFQRPVAS

SEQ ID NO: 61553 - protein, 25 aa, synthetic construct
  source 1..25: note = Seed: VKLQTVHSIPLTINKEEALQRPVAS
VKLQTVHSIPYTIVKYEAGQRPVAS

SEQ ID NO: 61554 - protein, 25 aa, synthetic construct
  source 1..25: note = Seed: VKLQTVHSIPLTINKEEALQRPVAS
VKLQTVHSIPYTIVKYEAHQRPVAS

SEQ ID NO: 61555 - protein, 25 aa, synthetic construct
  source 1..25: note = Seed: VKLQTVHSIPLTINKEEALQRPVAS
VKLQTVHSIPYTIVKYEAIQRPVAS

SEQ ID NO: 61556 - protein, 25 aa, synthetic construct
  source 1..25: note = Seed: VKLQTVHSIPLTINKEEALQRPVAS
VKLQTVHSIPYTIVKYEALQRPVAS

SEQ ID NO: 61557 - protein, 25 aa, synthetic construct
  source 1..25: note = Seed: VKLQTVHSIPLTINKEEALQRPVAS
VKLQTVHSIPYTIVKYEAMQRPVAS

SEQ ID NO: 61558 - protein, 25 aa, synthetic construct
  source 1..25: note = Seed: VKLQTVHSIPLTINKEEALQRPVAS
VKLQTVHSIPYTIVKYEANQRPVAS

SEQ ID NO: 61559 - protein, 25 aa, synthetic construct
  source 1..25: note = Seed: VKLQTVHSIPLTINKEEALQRPVAS
VKLQTVHSIPYTIVKYEAPQRPVAS

SEQ ID NO: 61560 - protein, 25 aa, synthetic construct
  source 1..25: note = Seed: VKLQTVHSIPLTINKEEALQRPVAS
VKLQTVHSIPYTIVKYEAQQRPVAS

SEQ ID NO: 61561 - protein, 25 aa, synthetic construct
  source 1..25: note = Seed: VKLQTVHSIPLTINKEEALQRPVAS
VKLQTVHSIPYTIVKYEASQRPVAS

SEQ ID NO: 61562 - protein, 25 aa, synthetic construct
  source 1..25: note = Seed: VKLQTVHSIPLTINKEEALQRPVAS
VKLQTVHSIPYTIVKYEATQRPVAS

SEQ ID NO: 61563 - protein, 25 aa, synthetic construct
  source 1..25: note = Seed: VKLQTVHSIPLTINKEEALQRPVAS
VKLQTVHSIPYTIVKYEAVQRPVAS

SEQ ID NO: 61564 - protein, 25 aa, synthetic construct
  source 1..25: note = Seed: VKLQTVHSIPLTINKEEALQRPVAS
VKLQTVHSIPYTIVKYEAYQRPVAS

SEQ ID NO: 61565 - protein, 25 aa, synthetic construct
  source 1..25: note = Seed: VKLQTVHSIPLTINKEEALQRPVAS
VKLQTVHSIPYTIWKAEAFQRPVAS

SEQ ID NO: 61566 - protein, 25 aa, synthetic construct
  source 1..25: note = Seed: VKLQTVHSIPLTINKEEALQRPVAS
VKLQTVHSIPYTIWKFEAAQRPVAS

SEQ ID NO: 61567 - protein, 25 aa, synthetic construct
  source 1..25: note = Seed: VKLQTVHSIPLTINKEEALQRPVAS
VKLQTVHSIPYTIWKFEAFQRPVAS

SEQ ID NO: 61568 - protein, 25 aa, synthetic construct
  source 1..25: note = Seed: VKLQTVHSIPLTINKEEALQRPVAS
VKLQTVHSIPYTIWKFEAIQRPVAS

SEQ ID NO: 61569 - protein, 25 aa, synthetic construct
  source 1..25: note = Seed: VKLQTVHSIPLTINKEEALQRPVAS
VKLQTVHSIPYTIWKFEALQRPVAS

SEQ ID NO: 61570 - protein, 25 aa, synthetic construct
  source 1..25: note = Seed: VKLQTVHSIPLTINKEEALQRPVAS
VKLQTVHSIPYTIWKFEAMQRPVAS

SEQ ID NO: 61571 - protein, 25 aa, synthetic construct
  source 1..25: note = Seed: VKLQTVHSIPLTINKEEALQRPVAS
VKLQTVHSIPYTIWKFEAVQRPVAS

SEQ ID NO: 61572 - protein, 25 aa, synthetic construct
  source 1..25: note = Seed: VKLQTVHSIPLTINKEEALQRPVAS
VKLQTVHSIPYTIWKFEAYQRPVAS

SEQ ID NO: 61573 - protein, 25 aa, synthetic construct
  source 1..25: note = Seed: VKLQTVHSIPLTINKEEALQRPVAS
VKLQTVHSIPYTIWKIEAFQRPVAS

SEQ ID NO: 61574 - protein, 25 aa, synthetic construct
  source 1..25: note = Seed: VKLQTVHSIPLTINKEEALQRPVAS
VKLQTVHSIPYTIWKIEAIQRPVAS

SEQ ID NO: 61575 - protein, 25 aa, synthetic construct
  source 1..25: note = Seed: VKLQTVHSIPLTINKEEALQRPVAS
VKLQTVHSIPYTIWKIEALQRPVAS

SEQ ID NO: 61576 - protein, 25 aa, synthetic construct
  source 1..25: note = Seed: VKLQTVHSIPLTINKEEALQRPVAS
VKLQTVHSIPYTIWKIEAVQRPVAS

SEQ ID NO: 61577 - protein, 25 aa, synthetic construct
  source 1..25: note = Seed: VKLQTVHSIPLTINKEEALQRPVAS
VKLQTVHSIPYTIWKLEAFQRPVAS

SEQ ID NO: 61578 - protein, 25 aa, synthetic construct
  source 1..25: note = Seed: VKLQTVHSIPLTINKEEALQRPVAS
VKLQTVHSIPYTIWKLEAIQRPVAS

SEQ ID NO: 61579 - protein, 25 aa, synthetic construct
  source 1..25: note = Seed: VKLQTVHSIPLTINKEEALQRPVAS
VKLQTVHSIPYTIWKLEALQRPVAS

SEQ ID NO: 61580 - protein, 25 aa, synthetic construct
  source 1..25: note = Seed: VKLQTVHSIPLTINKEEALQRPVAS
VKLQTVHSIPYTIWKLEAVQRPVAS

SEQ ID NO: 61581 - protein, 25 aa, synthetic construct
  source 1..25: note = Seed: VKLQTVHSIPLTINKEEALQRPVAS
VKLQTVHSIPYTIWKMEAFQRPVAS

SEQ ID NO: 61582 - protein, 25 aa, synthetic construct
  source 1..25: note = Seed: VKLQTVHSIPLTINKEEALQRPVAS
VKLQTVHSIPYTIWKMEALQRPVAS

SEQ ID NO: 61583 - protein, 25 aa, synthetic construct
  source 1..25: note = Seed: VKLQTVHSIPLTINKEEALQRPVAS
VKLQTVHSIPYTIWKVEAFQRPVAS

SEQ ID NO: 61584 - protein, 25 aa, synthetic construct
  source 1..25: note = Seed: VKLQTVHSIPLTINKEEALQRPVAS
VKLQTVHSIPYTIWKWEAFQRPVAS

SEQ ID NO: 61585 - protein, 25 aa, synthetic construct
  source 1..25: note = Seed: VKLQTVHSIPLTINKEEALQRPVAS
VKLQTVHSIPYTIWKWEAIQRPVAS

SEQ ID NO: 61586 - protein, 25 aa, synthetic construct
  source 1..25: note = Seed: VKLQTVHSIPLTINKEEALQRPVAS
VKLQTVHSIPYTIWKWEALQRPVAS

SEQ ID NO: 61587 - protein, 25 aa, synthetic construct
  source 1..25: note = Seed: VKLQTVHSIPLTINKEEALQRPVAS
VKLQTVHSIPYTIWKYEAFQRPVAS

SEQ ID NO: 61588 - protein, 25 aa, synthetic construct
  source 1..25: note = Seed: VKLQTVHSIPLTINKEEALQRPVAS
VKLQTVHSIPYTIWKYEAIQRPVAS

SEQ ID NO: 61589 - protein, 25 aa, synthetic construct
  source 1..25: note = Seed: VKLQTVHSIPLTINKEEALQRPVAS
VKLQTVHSIPYTIWKYEALQRPVAS

SEQ ID NO: 61590 - protein, 25 aa, synthetic construct
  source 1..25: note = Seed: VKLQTVHSIPLTINKEEALQRPVAS
VKLQTVHSIPYTIYKAEAIQRPVAS

SEQ ID NO: 61591 - protein, 25 aa, synthetic construct
  source 1..25: note = Seed: VKLQTVHSIPLTINKEEALQRPVAS
VKLQTVHSIPYTIYKAEALQRPVAS

SEQ ID NO: 61592 - protein, 25 aa, synthetic construct
  source 1..25: note = Seed: VKLQTVHSIPLTINKEEALQRPVAS
VKLQTVHSIPYTIYKAEAVQRPVAS

SEQ ID NO: 61593 - protein, 25 aa, synthetic construct
  source 1..25: note = Seed: VKLQTVHSIPLTINKEEALQRPVAS
VKLQTVHSIPYTIYKDEAIQRPVAS

SEQ ID NO: 61594 - protein, 25 aa, synthetic construct
  source 1..25: note = Seed: VKLQTVHSIPLTINKEEALQRPVAS
VKLQTVHSIPYTIYKDEAVQRPVAS

SEQ ID NO: 61595 - protein, 25 aa, synthetic construct
  source 1..25: note = Seed: VKLQTVHSIPLTINKEEALQRPVAS
VKLQTVHSIPYTIYKFEAAQRPVAS

SEQ ID NO: 61596 - protein, 25 aa, synthetic construct
  source 1..25: note = Seed: VKLQTVHSIPLTINKEEALQRPVAS
VKLQTVHSIPYTIYKFEAEQRPVAS

SEQ ID NO: 61597 - protein, 25 aa, synthetic construct
  source 1..25: note = Seed: VKLQTVHSIPLTINKEEALQRPVAS
VKLQTVHSIPYTIYKFEAFQRPVAS

SEQ ID NO: 61598 - protein, 25 aa, synthetic construct
  source 1..25: note = Seed: VKLQTVHSIPLTINKEEALQRPVAS
VKLQTVHSIPYTIYKFEAIQRPVAS

SEQ ID NO: 61599 - protein, 25 aa, synthetic construct
  source 1..25: note = Seed: VKLQTVHSIPLTINKEEALQRPVAS
VKLQTVHSIPYTIYKFEALQRPVAS

SEQ ID NO: 61600 - protein, 25 aa, synthetic construct
  source 1..25: note = Seed: VKLQTVHSIPLTINKEEALQRPVAS
VKLQTVHSIPYTIYKFEAMQRPVAS

SEQ ID NO: 61601 - protein, 25 aa, synthetic construct
  source 1..25: note = Seed: VKLQTVHSIPLTINKEEALQRPVAS
VKLQTVHSIPYTIYKFEANQRPVAS

SEQ ID NO: 61602 - protein, 25 aa, synthetic construct
  source 1..25: note = Seed: VKLQTVHSIPLTINKEEALQRPVAS
VKLQTVHSIPYTIYKFEASQRPVAS

SEQ ID NO: 61603 - protein, 25 aa, synthetic construct
  source 1..25: note = Seed: VKLQTVHSIPLTINKEEALQRPVAS
VKLQTVHSIPYTIYKFEATQRPVAS

SEQ ID NO: 61604 - protein, 25 aa, synthetic construct
  source 1..25: note = Seed: VKLQTVHSIPLTINKEEALQRPVAS
VKLQTVHSIPYTIYKFEAVQRPVAS

SEQ ID NO: 61605 - protein, 25 aa, synthetic construct
  source 1..25: note = Seed: VKLQTVHSIPLTINKEEALQRPVAS
VKLQTVHSIPYTIYKFEAWQRPVAS

SEQ ID NO: 61606 - protein, 25 aa, synthetic construct
  source 1..25: note = Seed: VKLQTVHSIPLTINKEEALQRPVAS
VKLQTVHSIPYTIYKFEAYQRPVAS

SEQ ID NO: 61607 - protein, 25 aa, synthetic construct
  source 1..25: note = Seed: VKLQTVHSIPLTINKEEALQRPVAS
VKLQTVHSIPYTIYKHEAFQRPVAS

SEQ ID NO: 61608 - protein, 25 aa, synthetic construct
  source 1..25: note = Seed: VKLQTVHSIPLTINKEEALQRPVAS
VKLQTVHSIPYTIYKIEAFQRPVAS

SEQ ID NO: 61609 - protein, 25 aa, synthetic construct
  source 1..25: note = Seed: VKLQTVHSIPLTINKEEALQRPVAS
VKLQTVHSIPYTIYKIEAIQRPVAS

SEQ ID NO: 61610 - protein, 25 aa, synthetic construct
  source 1..25: note = Seed: VKLQTVHSIPLTINKEEALQRPVAS
VKLQTVHSIPYTIYKIEALQRPVAS

SEQ ID NO: 61611 - protein, 25 aa, synthetic construct
  source 1..25: note = Seed: VKLQTVHSIPLTINKEEALQRPVAS
VKLQTVHSIPYTIYKIEAMQRPVAS

SEQ ID NO: 61612 - protein, 25 aa, synthetic construct
  source 1..25: note = Seed: VKLQTVHSIPLTINKEEALQRPVAS
VKLQTVHSIPYTIYKIEARQRPVAS

SEQ ID NO: 61613 - protein, 25 aa, synthetic construct
  source 1..25: note = Seed: VKLQTVHSIPLTINKEEALQRPVAS
VKLQTVHSIPYTIYKIEAVQRPVAS

SEQ ID NO: 61614 - protein, 25 aa, synthetic construct
  source 1..25: note = Seed: VKLQTVHSIPLTINKEEALQRPVAS
VKLQTVHSIPYTIYKLEAFQRPVAS

SEQ ID NO: 61615 - protein, 25 aa, synthetic construct
  source 1..25: note = Seed: VKLQTVHSIPLTINKEEALQRPVAS
VKLQTVHSIPYTIYKLEAIQRPVAS

SEQ ID NO: 61616 - protein, 25 aa, synthetic construct
  source 1..25: note = Seed: VKLQTVHSIPLTINKEEALQRPVAS
VKLQTVHSIPYTIYKLEALQRPVAS

SEQ ID NO: 61617 - protein, 25 aa, synthetic construct
  source 1..25: note = Seed: VKLQTVHSIPLTINKEEALQRPVAS
VKLQTVHSIPYTIYKLEAMQRPVAS

SEQ ID NO: 61618 - protein, 25 aa, synthetic construct
  source 1..25: note = Seed: VKLQTVHSIPLTINKEEALQRPVAS
VKLQTVHSIPYTIYKLEAVQRPVAS

SEQ ID NO: 61619 - protein, 25 aa, synthetic construct
  source 1..25: note = Seed: VKLQTVHSIPLTINKEEALQRPVAS
VKLQTVHSIPYTIYKLEAYQRPVAS

SEQ ID NO: 61620 - protein, 25 aa, synthetic construct
  source 1..25: note = Seed: VKLQTVHSIPLTINKEEALQRPVAS
VKLQTVHSIPYTIYKMEAFQRPVAS

SEQ ID NO: 61621 - protein, 25 aa, synthetic construct
  source 1..25: note = Seed: VKLQTVHSIPLTINKEEALQRPVAS
VKLQTVHSIPYTIYKMEAIQRPVAS

SEQ ID NO: 61622 - protein, 25 aa, synthetic construct
  source 1..25: note = Seed: VKLQTVHSIPLTINKEEALQRPVAS
VKLQTVHSIPYTIYKMEALQRPVAS

SEQ ID NO: 61623 - protein, 25 aa, synthetic construct
  source 1..25: note = Seed: VKLQTVHSIPLTINKEEALQRPVAS
VKLQTVHSIPYTIYKMEAMQRPVAS

SEQ ID NO: 61624 - protein, 25 aa, synthetic construct
  source 1..25: note = Seed: VKLQTVHSIPLTINKEEALQRPVAS
VKLQTVHSIPYTIYKMEARQRPVAS

SEQ ID NO: 61625 - protein, 25 aa, synthetic construct
  source 1..25: note = Seed: VKLQTVHSIPLTINKEEALQRPVAS
VKLQTVHSIPYTIYKMEAVQRPVAS

SEQ ID NO: 61626 - protein, 25 aa, synthetic construct
  source 1..25: note = Seed: VKLQTVHSIPLTINKEEALQRPVAS
VKLQTVHSIPYTIYKVEAFQRPVAS

SEQ ID NO: 61627 - protein, 25 aa, synthetic construct
  source 1..25: note = Seed: VKLQTVHSIPLTINKEEALQRPVAS
VKLQTVHSIPYTIYKVEAIQRPVAS

SEQ ID NO: 61628 - protein, 25 aa, synthetic construct
  source 1..25: note = Seed: VKLQTVHSIPLTINKEEALQRPVAS
VKLQTVHSIPYTIYKVEALQRPVAS

SEQ ID NO: 61629 - protein, 25 aa, synthetic construct
  source 1..25: note = Seed: VKLQTVHSIPLTINKEEALQRPVAS
VKLQTVHSIPYTIYKVEARQRPVAS

SEQ ID NO: 61630 - protein, 25 aa, synthetic construct
  source 1..25: note = Seed: VKLQTVHSIPLTINKEEALQRPVAS
VKLQTVHSIPYTIYKVEAVQRPVAS

SEQ ID NO: 61631 - protein, 25 aa, synthetic construct
  source 1..25: note = Seed: VKLQTVHSIPLTINKEEALQRPVAS
VKLQTVHSIPYTIYKWEAFQRPVAS

SEQ ID NO: 61632 - protein, 25 aa, synthetic construct
  source 1..25: note = Seed: VKLQTVHSIPLTINKEEALQRPVAS
VKLQTVHSIPYTIYKWEAIQRPVAS

SEQ ID NO: 61633 - protein, 25 aa, synthetic construct
  source 1..25: note = Seed: VKLQTVHSIPLTINKEEALQRPVAS
VKLQTVHSIPYTIYKWEALQRPVAS

SEQ ID NO: 61634 - protein, 25 aa, synthetic construct
  source 1..25: note = Seed: VKLQTVHSIPLTINKEEALQRPVAS
VKLQTVHSIPYTIYKWEAMQRPVAS

SEQ ID NO: 61635 - protein, 25 aa, synthetic construct
  source 1..25: note = Seed: VKLQTVHSIPLTINKEEALQRPVAS
VKLQTVHSIPYTIYKWEAVQRPVAS

SEQ ID NO: 61636 - protein, 25 aa, synthetic construct
  source 1..25: note = Seed: VKLQTVHSIPLTINKEEALQRPVAS
VKLQTVHSIPYTIYKYEAFQRPVAS

SEQ ID NO: 61637 - protein, 25 aa, synthetic construct
  source 1..25: note = Seed: VKLQTVHSIPLTINKEEALQRPVAS
VKLQTVHSIPYTIYKYEAIQRPVAS

SEQ ID NO: 61638 - protein, 25 aa, synthetic construct
  source 1..25: note = Seed: VKLQTVHSIPLTINKEEALQRPVAS
VKLQTVHSIPYTIYKYEALQRPVAS

SEQ ID NO: 61639 - protein, 25 aa, synthetic construct
  source 1..25: note = Seed: VKLQTVHSIPLTINKEEALQRPVAS
VKLQTVHSIPYTIYKYEAMQRPVAS

SEQ ID NO: 61640 - protein, 25 aa, synthetic construct
  source 1..25: note = Seed: VKLQTVHSIPLTINKEEALQRPVAS
VKLQTVHSIPYTIYKYEAVQRPVAS

SEQ ID NO: 61641 - protein, 25 aa, synthetic construct
  source 1..25: note = Seed: VKLQTVHSIPLTINKEEALQRPVAS
VKLQTVHSIPYTIYKYEAYQRPVAS

SEQ ID NO: 61642 - protein, 13 aa, synthetic construct
  source 1..13: note = Seed: ATGFKQSSKALQR, Core: FKQSSKALQ
  VARIANT 4: note = C, F, I, L, M, V, W, or Y
  VARIANT 7: note = A, C, E, F, G, H, I, K, L, M, N, Q, R, S, T, V, W, or Y
  VARIANT 9: note = A, G, H, I, K, L, M, N, P, Q, R, S, T, or V
  VARIANT 12: note = A, C, D, E, F, G, H, I, K, L, M, N, P, Q, R, S, T, V, W, or Y
ATGXKQXSXALXR

SEQ ID NO: 61643 - protein, 14 aa, synthetic construct
  source 1..14: note = Seed: ATGFKQSSKALQRP, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, Q, R, S, T, V, W, or Y
  VARIANT 9: note = A, C, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRP

SEQ ID NO: 61644 - protein, 15 aa, synthetic construct
  source 1..15: note = Seed: ATGFKQSSKALQRPV, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPV

SEQ ID NO: 61645 - protein, 16 aa, synthetic construct
  source 1..16: note = Seed: ATGFKQSSKALQRPVA, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPVA

SEQ ID NO: 61646 - protein, 16 aa, synthetic construct
  source 1..16: note = Seed: ATGFKQSSKALQRPVA, Core: KQSSKALQR
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
ATGFXQSXKXLQXPVA

SEQ ID NO: 61647 - protein, 17 aa, synthetic construct
  source 1..17: note = Seed: ATGFKQSSKALQRPVAS, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPVAS

SEQ ID NO: 61648 - protein, 17 aa, synthetic construct
  source 1..17: note = Seed: ATGFKQSSKALQRPVAS, Core: KQSSKALQR
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
ATGFXQSXKXLQXPVAS

SEQ ID NO: 61649 - protein, 18 aa, synthetic construct
  source 1..18: note = Seed: ATGFKQSSKALQRPVASD, Core: FKQSSKALQ
  VARIANT 4: note = A, F, H, I, L, M, V, W, or Y
  VARIANT 7: note = A, C, E, F, G, H, I, K, L, M, N, Q, R, S, T, V, W, or Y
  VARIANT 9: note = A, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPVASD

SEQ ID NO: 61650 - protein, 19 aa, synthetic construct
  source 1..19: note = Seed: ATGFKQSSKALQRPVASDF, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPVASDF

SEQ ID NO: 61651 - protein, 19 aa, synthetic construct
  source 1..19: note = Seed: ATGFKQSSKALQRPVASDF, Core: KALQRPVAS
  VARIANT 9: note = E, F, H, K, M, Q, R, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, or Y
ATGFKQSSXALXRXVAXDF

SEQ ID NO: 61652 - protein, 19 aa, synthetic construct
  source 1..19: note = Seed: ATGFKQSSKALQRPVASDF, Core: KQSSKALQR
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
ATGFXQSXKXLQXPVASDF

SEQ ID NO: 61653 - protein, 20 aa, synthetic construct
  source 1..20: note = Seed: ATGFKQSSKALQRPVASDFE, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPVASDFE

SEQ ID NO: 61654 - protein, 20 aa, synthetic construct
  source 1..20: note = Seed: ATGFKQSSKALQRPVASDFE, Core: KALQRPVAS
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
ATGFKQSSXALXRXVAXDFE

SEQ ID NO: 61655 - protein, 20 aa, synthetic construct
  source 1..20: note = Seed: ATGFKQSSKALQRPVASDFE, Core: KQSSKALQR
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
ATGFXQSXKXLQXPVASDFE

SEQ ID NO: 61656 - protein, 20 aa, synthetic construct
  source 1..20: note = Seed: ATGFKQSSKALQRPVASDFE, Core: SSKALQRPV
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
ATGFKQXSKXLXRPXASDFE

SEQ ID NO: 61657 - protein, 21 aa, synthetic construct
  source 1..21: note = Seed: ATGFKQSSKALQRPVASDFEP, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPVASDFEP

SEQ ID NO: 61658 - protein, 21 aa, synthetic construct
  source 1..21: note = Seed: ATGFKQSSKALQRPVASDFEP, Core: KALQRPVAS
  VARIANT 9: note = A, C, D, E, F, G, H, I, K, L, M, N, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
ATGFKQSSXALXRXVAXDFEP

SEQ ID NO: 61659 - protein, 22 aa, synthetic construct
  source 1..22: note = Seed: ATGFKQSSKALQRPVASDFEPQ, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPVASDFEPQ

SEQ ID NO: 61660 - protein, 22 aa, synthetic construct
  source 1..22: note = Seed: ATGFKQSSKALQRPVASDFEPQ, Core: KALQRPVAS
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
ATGFKQSSXALXRXVAXDFEPQ

SEQ ID NO: 61661 - protein, 23 aa, synthetic construct
  source 1..23: note = Seed: ATGFKQSSKALQRPVASDFEPQG, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPVASDFEPQG

SEQ ID NO: 61662 - protein, 23 aa, synthetic construct
  source 1..23: note = Seed: ATGFKQSSKALQRPVASDFEPQG, Core: KALQRPVAS
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
ATGFKQSSXALXRXVAXDFEPQG

SEQ ID NO: 61663 - protein, 24 aa, synthetic construct
  source 1..24: note = Seed: ATGFKQSSKALQRPVASDFEPQGL, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPVASDFEPQGL

SEQ ID NO: 61664 - protein, 24 aa, synthetic construct
  source 1..24: note = Seed: ATGFKQSSKALQRPVASDFEPQGL, Core: KALQRPVAS
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
ATGFKQSSXALXRXVAXDFEPQGL

SEQ ID NO: 61665 - protein, 25 aa, synthetic construct
  source 1..25: note = Seed: ATGFKQSSKALQRPVASDFEPQGLS, Core: FKQSSKALQ
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
ATGXKQXSXALXRPVASDFEPQGLS

SEQ ID NO: 61666 - protein, 25 aa, synthetic construct
  source 1..25: note = Seed: ATGFKQSSKALQRPVASDFEPQGLS, Core: KALQRPVAS
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
ATGFKQSSXALXRXVAXDFEPQGLS

SEQ ID NO: 61667 - protein, 14 aa, synthetic construct
  source 1..14: note = Seed: FKQSSKALQRPVAS, Core: SKALQRPVA
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXS

SEQ ID NO: 61668 - protein, 15 aa, synthetic construct
  source 1..15: note = Seed: FKQSSKALQRPVASD, Core: KALQRPVAS
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
FKQSSXALXRXVAXD

SEQ ID NO: 61669 - protein, 15 aa, synthetic construct
  source 1..15: note = Seed: FKQSSKALQRPVASD, Core: SKALQRPVA
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXSD

SEQ ID NO: 61670 - protein, 15 aa, synthetic construct
  source 1..15: note = Seed: FKQSSKALQRPVASD, Core: SSKALQRPV
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
FKQXSKXLXRPXASD

SEQ ID NO: 61671 - protein, 16 aa, synthetic construct
  source 1..16: note = Seed: FKQSSKALQRPVASDF, Core: KALQRPVAS
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
FKQSSXALXRXVAXDF

SEQ ID NO: 61672 - protein, 16 aa, synthetic construct
  source 1..16: note = Seed: FKQSSKALQRPVASDF, Core: SKALQRPVA
  VARIANT 5: note = A, C, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXSDF

SEQ ID NO: 61673 - protein, 16 aa, synthetic construct
  source 1..16: note = Seed: FKQSSKALQRPVASDF, Core: SSKALQRPV
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
FKQXSKXLXRPXASDF

SEQ ID NO: 61674 - protein, 17 aa, synthetic construct
  source 1..17: note = Seed: FKQSSKALQRPVASDFE, Core: KALQRPVAS
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
FKQSSXALXRXVAXDFE

SEQ ID NO: 61675 - protein, 17 aa, synthetic construct
  source 1..17: note = Seed: FKQSSKALQRPVASDFE, Core: SKALQRPVA
  VARIANT 5: note = A, C, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXSDFE

SEQ ID NO: 61676 - protein, 19 aa, synthetic construct
  source 1..19: note = Seed: FKQSSKALQRPVASDFEPQ, Core: KALQRPVAS
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
FKQSSXALXRXVAXDFEPQ

SEQ ID NO: 61677 - protein, 19 aa, synthetic construct
  source 1..19: note = Seed: FKQSSKALQRPVASDFEPQ, Core: SKALQRPVA
  VARIANT 5: note = A, C, F, H, I, K, L, M, N, Q, R, S, T, V, W, or Y
  VARIANT 8: note = A, C, E, F, G, H, I, K, L, M, N, Q, R, S, T, V, W, or Y
  VARIANT 10: note = A, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXSDFEPQ

SEQ ID NO: 61678 - protein, 20 aa, synthetic construct
  source 1..20: note = Seed: FKQSSKALQRPVASDFEPQG, Core: KALQRPVAS
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
FKQSSXALXRXVAXDFEPQG

SEQ ID NO: 61679 - protein, 20 aa, synthetic construct
  source 1..20: note = Seed: FKQSSKALQRPVASDFEPQG, Core: SKALQRPVA
  VARIANT 5: note = A, C, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXSDFEPQG

SEQ ID NO: 61680 - protein, 21 aa, synthetic construct
  source 1..21: note = Seed: FKQSSKALQRPVASDFEPQGL, Core: KALQRPVAS
  VARIANT 6: note = A, C, D, E, F, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
FKQSSXALXRXVAXDFEPQGL

SEQ ID NO: 61681 - protein, 21 aa, synthetic construct
  source 1..21: note = Seed: FKQSSKALQRPVASDFEPQGL, Core: SKALQRPVA
  VARIANT 5: note = A, C, F, H, I, K, L, M, N, Q, R, S, T, V, W, or Y
  VARIANT 8: note = A, C, D, E, F, G, H, I, K, L, M, N, Q, R, S, T, V, W, or Y
  VARIANT 10: note = A, C, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXSDFEPQGL

SEQ ID NO: 61682 - protein, 22 aa, synthetic construct
  source 1..22: note = Seed: FKQSSKALQRPVASDFEPQGLS, Core: KALQRPVAS
  VARIANT 6: note = A, C, D, E, F, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
FKQSSXALXRXVAXDFEPQGLS

SEQ ID NO: 61683 - protein, 22 aa, synthetic construct
  source 1..22: note = Seed: FKQSSKALQRPVASDFEPQGLS, Core: SKALQRPVA
  VARIANT 5: note = A, C, F, G, H, I, K, L, M, N, Q, R, S, T, V, W, or Y
  VARIANT 8: note = A, C, D, E, F, G, H, I, K, L, M, N, Q, R, S, T, V, W, or Y
  VARIANT 10: note = A, C, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXSDFEPQGLS

SEQ ID NO: 61684 - protein, 23 aa, synthetic construct
  source 1..23: note = Seed: FKQSSKALQRPVASDFEPQGLSE, Core: KALQRPVAS
  VARIANT 6: note = A, D, E, F, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
FKQSSXALXRXVAXDFEPQGLSE

SEQ ID NO: 61685 - protein, 23 aa, synthetic construct
  source 1..23: note = Seed: FKQSSKALQRPVASDFEPQGLSE, Core: SKALQRPVA
  VARIANT 5: note = A, C, F, G, H, I, K, L, M, N, Q, R, S, T, V, W, or Y
  VARIANT 8: note = A, C, D, E, F, G, H, I, K, L, M, N, Q, R, S, T, V, W, or Y
  VARIANT 10: note = A, C, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXSDFEPQGLSE

SEQ ID NO: 61686 - protein, 24 aa, synthetic construct
  source 1..24: note = Seed: FKQSSKALQRPVASDFEPQGLSEA, Core: KALQRPVAS
  VARIANT 6: note = A, D, E, F, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
FKQSSXALXRXVAXDFEPQGLSEA

SEQ ID NO: 61687 - protein, 24 aa, synthetic construct
  source 1..24: note = Seed: FKQSSKALQRPVASDFEPQGLSEA, Core: SKALQRPVA
  VARIANT 5: note = A, C, F, G, H, I, K, L, M, N, Q, R, S, T, V, W, or Y
  VARIANT 8: note = A, C, D, E, F, G, H, I, K, L, M, N, Q, R, S, T, V, W, or Y
  VARIANT 10: note = A, C, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXSDFEPQGLSEA

SEQ ID NO: 61688 - protein, 25 aa, synthetic construct
  source 1..25: note = Seed: FKQSSKALQRPVASDFEPQGLSEAA, Core: KALQRPVAS
  VARIANT 6: note = A, D, E, F, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
FKQSSXALXRXVAXDFEPQGLSEAA

SEQ ID NO: 61689 - protein, 25 aa, synthetic construct
  source 1..25: note = Seed: FKQSSKALQRPVASDFEPQGLSEAA, Core: SKALQRPVA
  VARIANT 5: note = A, C, F, G, H, I, K, L, M, N, Q, R, S, T, V, W, or Y
  VARIANT 8: note = A, C, D, E, F, G, H, I, K, L, M, N, Q, R, S, T, V, W, or Y
  VARIANT 10: note = A, C, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
FKQSXKAXQXPVXSDFEPQGLSEAA

SEQ ID NO: 61690 - protein, 20 aa, synthetic construct
  source 1..20: note = Seed: FLNVIVHSATGFKQSSKALQ, Core: FKQSSKALQ
  VARIANT 12: note = F, I, L, M, V, W, or Y
  VARIANT 15: note = A, C, D, E, F, G, H, I, K, L, M, N, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
FLNVIVHSATGXKQXSXALX

SEQ ID NO: 61691 - protein, 21 aa, synthetic construct
  source 1..21: note = Seed: FLNVIVHSATGFKQSSKALQR, Core: FKQSSKALQ
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
FLNVIVHSATGXKQXSXALXR

SEQ ID NO: 61692 - protein, 22 aa, synthetic construct
  source 1..22: note = Seed: FLNVIVHSATGFKQSSKALQRP, Core: FKQSSKALQ
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
FLNVIVHSATGXKQXSXALXRP

SEQ ID NO: 61693 - protein, 23 aa, synthetic construct
  source 1..23: note = Seed: FLNVIVHSATGFKQSSKALQRPV, Core: FKQSSKALQ
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
FLNVIVHSATGXKQXSXALXRPV

SEQ ID NO: 61694 - protein, 24 aa, synthetic construct
  source 1..24: note = Seed: FLNVIVHSATGFKQSSKALQRPVA, Core: FKQSSKALQ
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
FLNVIVHSATGXKQXSXALXRPVA

SEQ ID NO: 61695 - protein, 24 aa, synthetic construct
  source 1..24: note = Seed: FLNVIVHSATGFKQSSKALQRPVA, Core: KQSSKALQR
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
FLNVIVHSATGFXQSXKXLQXPVA

SEQ ID NO: 61696 - protein, 25 aa, synthetic construct
  source 1..25: note = Seed: FLNVIVHSATGFKQSSKALQRPVAS, Core: FKQSSKALQ
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
FLNVIVHSATGXKQXSXALXRPVAS

SEQ ID NO: 61697 - protein, 25 aa, synthetic construct
  source 1..25: note = Seed: FLNVIVHSATGFKQSSKALQRPVAS, Core: KQSSKALQR
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
FLNVIVHSATGFXQSXKXLQXPVAS

SEQ ID NO: 61698 - protein, 13 aa, synthetic construct
  source 1..13: note = Seed: GFKQSSKALQRPV, Core: FKQSSKALQ
  VARIANT 2: note = F, I, L, M, V, W, or Y
  VARIANT 5: note = A, C, E, F, G, H, I, K, L, M, N, Q, R, S, T, V, W, or Y
  VARIANT 7: note = A, G, H, I, K, L, M, N, P, Q, R, S, T, V, W, or Y
  VARIANT 10: note = A, C, D, E, F, G, H, I, K, L, M, N, P, Q, R, S, T, V, W, or Y
GXKQXSXALXRPV

SEQ ID NO: 61699 - protein, 14 aa, synthetic construct
  source 1..14: note = Seed: GFKQSSKALQRPVA, Core: FKQSSKALQ
  VARIANT 2: note = A, C, D, E, F, G, H, I, K, L, M, N, P, Q, R, S, T, V, W, or Y
  VARIANT 5: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
GXKQXSXALXRPVA

SEQ ID NO: 61700 - protein, 14 aa, synthetic construct
  source 1..14: note = Seed: GFKQSSKALQRPVA, Core: KQSSKALQR
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
GFXQSXKXLQXPVA

SEQ ID NO: 61701 - protein, 15 aa, synthetic construct
  source 1..15: note = Seed: GFKQSSKALQRPVAS, Core: FKQSSKALQ
  VARIANT 2: note = A, C, D, E, F, G, H, I, K, L, M, N, P, Q, R, S, T, V, W, or Y
  VARIANT 5: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
GXKQXSXALXRPVAS

SEQ ID NO: 61702 - protein, 15 aa, synthetic construct
  source 1..15: note = Seed: GFKQSSKALQRPVAS, Core: KQSSKALQR
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
GFXQSXKXLQXPVAS

SEQ ID NO: 61703 - protein, 15 aa, synthetic construct
  source 1..15: note = Seed: GFKQSSKALQRPVAS, Core: SSKALQRPV
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
GFKQXSKXLXRPXAS

SEQ ID NO: 61704 - protein, 16 aa, synthetic construct
  source 1..16: note = Seed: GFKQSSKALQRPVASD, Core: FKQSSKALQ
  VARIANT 2: note = E, F, I, L, M, Q, R, V, W, or Y
  VARIANT 5: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
GXKQXSXALXRPVASD

SEQ ID NO: 61705 - protein, 16 aa, synthetic construct
  source 1..16: note = Seed: GFKQSSKALQRPVASD, Core: KALQRPVAS
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
GFKQSSXALXRXVAXD

SEQ ID NO: 61706 - protein, 16 aa, synthetic construct
  source 1..16: note = Seed: GFKQSSKALQRPVASD, Core: KQSSKALQR
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
GFXQSXKXLQXPVASD

SEQ ID NO: 61707 - protein, 16 aa, synthetic construct
  source 1..16: note = Seed: GFKQSSKALQRPVASD, Core: SKALQRPVA
  VARIANT 6: note = A, C, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
GFKQSXKAXQXPVXSD

SEQ ID NO: 61708 - protein, 16 aa, synthetic construct
  source 1..16: note = Seed: GFKQSSKALQRPVASD, Core: SSKALQRPV
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
GFKQXSKXLXRPXASD

SEQ ID NO: 61709 - protein, 17 aa, synthetic construct
  source 1..17: note = Seed: GFKQSSKALQRPVASDF, Core: FKQSSKALQ
  VARIANT 2: note = F, I, L, M, V, W, or Y
  VARIANT 5: note = A, C, D, E, F, G, H, I, K, L, M, N, P, Q, R, S, T, V, W, or Y
  VARIANT 7: note = A, C, D, E, G, H, I, K, L, M, N, P, Q, R, S, T, or V
  VARIANT 10: note = A, C, D, E, F, G, H, I, K, L, M, N, P, Q, R, S, T, V, W, or Y
GXKQXSXALXRPVASDF

SEQ ID NO: 61710 - protein, 17 aa, synthetic construct
  source 1..17: note = Seed: GFKQSSKALQRPVASDF, Core: KALQRPVAS
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
GFKQSSXALXRXVAXDF

SEQ ID NO: 61711 - protein, 17 aa, synthetic construct
  source 1..17: note = Seed: GFKQSSKALQRPVASDF, Core: KQSSKALQR
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, S, T, V, W, or Y
  VARIANT 11: note = A, C, D, E, F, G, H, I, K, L, M, N, P, Q, R, S, T, V, W, or Y
GFXQSXKXLQXPVASDF

SEQ ID NO: 61712 - protein, 17 aa, synthetic construct
  source 1..17: note = Seed: GFKQSSKALQRPVASDF, Core: SKALQRPVA
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
GFKQSXKAXQXPVXSDF

SEQ ID NO: 61713 - protein, 17 aa, synthetic construct
  source 1..17: note = Seed: GFKQSSKALQRPVASDF, Core: SSKALQRPV
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
GFKQXSKXLXRPXASDF

SEQ ID NO: 61714 - protein, 18 aa, synthetic construct
  source 1..18: note = Seed: GFKQSSKALQRPVASDFE, Core: FKQSSKALQ
  VARIANT 2: note = F, I, L, M, V, W, or Y
  VARIANT 5: note = A, C, E, F, I, K, L, M, N, Q, S, T, V, W, or Y
  VARIANT 7: note = A, G, H, K, N, P, Q, R, S, or T
  VARIANT 10: note = A, C, D, E, F, G, H, I, L, M, N, P, Q, R, S, T, V, W, or Y
GXKQXSXALXRPVASDFE

SEQ ID NO: 61715 - protein, 19 aa, synthetic construct
  source 1..19: note = Seed: GFKQSSKALQRPVASDFEP, Core: FKQSSKALQ
  VARIANT 2: note = F, I, L, M, V, W, or Y
  VARIANT 5: note = A, C, E, F, G, H, I, K, L, M, N, Q, R, S, T, V, W, or Y
  VARIANT 7: note = A, G, H, I, K, L, M, N, P, Q, R, S, T, or V
  VARIANT 10: note = A, C, D, E, F, G, H, I, L, M, N, P, Q, R, S, T, V, W, or Y
GXKQXSXALXRPVASDFEP

SEQ ID NO: 61716 - protein, 19 aa, synthetic construct
  source 1..19: note = Seed: GFKQSSKALQRPVASDFEP, Core: KALQRPVAS
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
GFKQSSXALXRXVAXDFEP

SEQ ID NO: 61717 - protein, 19 aa, synthetic construct
  source 1..19: note = Seed: GFKQSSKALQRPVASDFEP, Core: SKALQRPVA
  VARIANT 6: note = A, C, F, G, H, I, K, L, M, N, P, Q, R, S, T, V, W, or Y
  VARIANT 9: note = A, C, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
GFKQSXKAXQXPVXSDFEP

SEQ ID NO: 61718 - protein, 20 aa, synthetic construct
  source 1..20: note = Seed: GFKQSSKALQRPVASDFEPQ, Core: FKQSSKALQ
  VARIANT 2: note = F, I, L, M, V, W, or Y
  VARIANT 5: note = A, C, D, E, F, G, H, I, K, L, M, N, Q, R, S, T, V, W, or Y
  VARIANT 7: note = A, D, E, G, H, I, K, L, M, N, P, Q, R, S, T, or V
  VARIANT 10: note = A, C, D, E, F, G, H, I, K, L, M, N, P, Q, R, S, T, V, W, or Y
GXKQXSXALXRPVASDFEPQ

SEQ ID NO: 61719 - protein, 20 aa, synthetic construct
  source 1..20: note = Seed: GFKQSSKALQRPVASDFEPQ, Core: KALQRPVAS
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
GFKQSSXALXRXVAXDFEPQ

SEQ ID NO: 61720 - protein, 20 aa, synthetic construct
  source 1..20: note = Seed: GFKQSSKALQRPVASDFEPQ, Core: KQSSKALQR
  VARIANT 3: note = A, C, E, F, H, I, K, L, M, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
GFXQSXKXLQXPVASDFEPQ

SEQ ID NO: 61721 - protein, 20 aa, synthetic construct
  source 1..20: note = Seed: GFKQSSKALQRPVASDFEPQ, Core: SKALQRPVA
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
GFKQSXKAXQXPVXSDFEPQ

SEQ ID NO: 61722 - protein, 21 aa, synthetic construct
  source 1..21: note = Seed: GFKQSSKALQRPVASDFEPQG, Core: FKQSSKALQ
  VARIANT 2: note = F, I, L, M, V, W, or Y
  VARIANT 5: note = A, C, D, E, F, G, H, I, K, L, M, N, Q, R, S, T, V, W, or Y
  VARIANT 7: note = A, C, D, E, G, H, I, K, L, M, N, P, Q, R, S, T, or V
  VARIANT 10: note = A, C, D, E, F, G, H, I, K, L, M, N, P, Q, R, S, T, V, W, or Y
GXKQXSXALXRPVASDFEPQG

SEQ ID NO: 61723 - protein, 21 aa, synthetic construct
  source 1..21: note = Seed: GFKQSSKALQRPVASDFEPQG, Core: KALQRPVAS
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
GFKQSSXALXRXVAXDFEPQG

SEQ ID NO: 61724 - protein, 21 aa, synthetic construct
  source 1..21: note = Seed: GFKQSSKALQRPVASDFEPQG, Core: SKALQRPVA
  VARIANT 6: note = A, C, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
GFKQSXKAXQXPVXSDFEPQG

SEQ ID NO: 61725 - protein, 22 aa, synthetic construct
  source 1..22: note = Seed: GFKQSSKALQRPVASDFEPQGL, Core: FKQSSKALQ
  VARIANT 2: note = F, I, L, M, V, W, or Y
  VARIANT 5: note = A, C, D, E, F, G, H, I, K, L, M, N, Q, R, S, T, V, W, or Y
  VARIANT 7: note = A, C, D, E, G, H, I, K, L, M, N, P, Q, R, S, T, or V
  VARIANT 10: note = A, C, D, E, F, G, H, I, K, L, M, N, P, Q, R, S, T, V, W, or Y
GXKQXSXALXRPVASDFEPQGL

SEQ ID NO: 61726 - protein, 22 aa, synthetic construct
  source 1..22: note = Seed: GFKQSSKALQRPVASDFEPQGL, Core: KALQRPVAS
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
GFKQSSXALXRXVAXDFEPQGL

SEQ ID NO: 61727 - protein, 22 aa, synthetic construct
  source 1..22: note = Seed: GFKQSSKALQRPVASDFEPQGL, Core: SKALQRPVA
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
GFKQSXKAXQXPVXSDFEPQGL

SEQ ID NO: 61728 - protein, 23 aa, synthetic construct
  source 1..23: note = Seed: GFKQSSKALQRPVASDFEPQGLS, Core: FKQSSKALQ
  VARIANT 2: note = F, I, L, M, V, W, or Y
  VARIANT 5: note = A, C, D, E, F, G, H, I, K, L, M, N, Q, R, S, T, V, W, or Y
  VARIANT 7: note = A, C, D, E, G, H, I, K, L, M, N, P, Q, R, S, T, or V
  VARIANT 10: note = A, C, D, E, F, G, H, I, K, L, M, N, P, Q, R, S, T, V, W, or Y
GXKQXSXALXRPVASDFEPQGLS

SEQ ID NO: 61729 - protein, 23 aa, synthetic construct
  source 1..23: note = Seed: GFKQSSKALQRPVASDFEPQGLS, Core: KALQRPVAS
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
GFKQSSXALXRXVAXDFEPQGLS

SEQ ID NO: 61730 - protein, 23 aa, synthetic construct
  source 1..23: note = Seed: GFKQSSKALQRPVASDFEPQGLS, Core: SKALQRPVA
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
GFKQSXKAXQXPVXSDFEPQGLS

SEQ ID NO: 61731 - protein, 24 aa, synthetic construct
  source 1..24: note = Seed: GFKQSSKALQRPVASDFEPQGLSE, Core: FKQSSKALQ
  VARIANT 2: note = F, I, L, M, V, W, or Y
  VARIANT 5: note = A, C, E, F, G, H, I, K, L, M, N, Q, R, S, T, V, W, or Y
  VARIANT 7: note = A, G, H, I, K, L, N, P, Q, R, S, T, or V
  VARIANT 10: note = A, C, D, E, G, H, I, L, M, N, P, Q, R, S, T, or V
GXKQXSXALXRPVASDFEPQGLSE

SEQ ID NO: 61732 - protein, 24 aa, synthetic construct
  source 1..24: note = Seed: GFKQSSKALQRPVASDFEPQGLSE, Core: KALQRPVAS
  VARIANT 7: note = A, C, D, E, F, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
GFKQSSXALXRXVAXDFEPQGLSE

SEQ ID NO: 61733 - protein, 24 aa, synthetic construct
  source 1..24: note = Seed: GFKQSSKALQRPVASDFEPQGLSE, Core: SKALQRPVA
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
GFKQSXKAXQXPVXSDFEPQGLSE

SEQ ID NO: 61734 - protein, 25 aa, synthetic construct
  source 1..25: note = Seed: GFKQSSKALQRPVASDFEPQGLSEA, Core: FKQSSKALQ
  VARIANT 2: note = F, I, L, M, V, W, or Y
  VARIANT 5: note = A, C, E, F, G, H, I, K, L, M, N, Q, R, S, T, V, W, or Y
  VARIANT 7: note = A, G, H, I, K, L, N, P, Q, R, S, T, or V
  VARIANT 10: note = A, C, D, E, G, H, I, L, M, N, P, Q, R, S, T, or V
GXKQXSXALXRPVASDFEPQGLSEA

SEQ ID NO: 61735 - protein, 25 aa, synthetic construct
  source 1..25: note = Seed: GFKQSSKALQRPVASDFEPQGLSEA, Core: KALQRPVAS
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
GFKQSSXALXRXVAXDFEPQGLSEA

SEQ ID NO: 61736 - protein, 25 aa, synthetic construct
  source 1..25: note = Seed: GFKQSSKALQRPVASDFEPQGLSEA, Core: SKALQRPVA
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
GFKQSXKAXQXPVXSDFEPQGLSEA

SEQ ID NO: 61737 - protein, 21 aa, synthetic construct
  source 1..21: note = Seed: GFLNVIVHSATGFKQSSKALQ, Core: FKQSSKALQ
  VARIANT 13: note = F, I, L, M, V, W, or Y
  VARIANT 16: note = A, C, E, F, G, H, I, K, L, M, N, Q, R, S, T, V, W, or Y
  VARIANT 18: note = A, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
GFLNVIVHSATGXKQXSXALX

SEQ ID NO: 61738 - protein, 22 aa, synthetic construct
  source 1..22: note = Seed: GFLNVIVHSATGFKQSSKALQR, Core: FKQSSKALQ
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
GFLNVIVHSATGXKQXSXALXR

SEQ ID NO: 61739 - protein, 23 aa, synthetic construct
  source 1..23: note = Seed: GFLNVIVHSATGFKQSSKALQRP, Core: FKQSSKALQ
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
GFLNVIVHSATGXKQXSXALXRP

SEQ ID NO: 61740 - protein, 24 aa, synthetic construct
  source 1..24: note = Seed: GFLNVIVHSATGFKQSSKALQRPV, Core: FKQSSKALQ
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
GFLNVIVHSATGXKQXSXALXRPV

SEQ ID NO: 61741 - protein, 25 aa, synthetic construct
  source 1..25: note = Seed: GFLNVIVHSATGFKQSSKALQRPVA, Core: FKQSSKALQ
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
GFLNVIVHSATGXKQXSXALXRPVA

SEQ ID NO: 61742 - protein, 25 aa, synthetic construct
  source 1..25: note = Seed: GFLNVIVHSATGFKQSSKALQRPVA, Core: KQSSKALQR
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
GFLNVIVHSATGFXQSXKXLQXPVA

SEQ ID NO: 61743 - protein, 24 aa, synthetic construct
  source 1..24: note = Seed: GLYGFLNVIVHSATGFKQSSKALQ, Core: FKQSSKALQ
  VARIANT 16: note = F, I, L, M, V, W, or Y
  VARIANT 19: note = A, C, D, E, F, G, H, I, K, L, M, N, Q, R, S, T, V, W, or Y
  VARIANT 21: note = A, C, D, E, F, G, H, I, K, L, M, N, P, Q, R, S, T, V, or Y
  VARIANT 24: note = A, C, D, E, F, G, H, I, K, L, M, N, P, Q, R, S, T, V, W, or Y
GLYGFLNVIVHSATGXKQXSXALX

SEQ ID NO: 61744 - protein, 25 aa, synthetic construct
  source 1..25: note = Seed: GLYGFLNVIVHSATGFKQSSKALQR, Core: FKQSSKALQ
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
  VARIANT 24: note = A, C, D, E, F, G, H, I, K, L, M, N, P, Q, R, S, T, V, W, or Y
GLYGFLNVIVHSATGXKQXSXALXR

SEQ ID NO: 61745 - protein, 14 aa, synthetic construct
  source 1..14: note = Seed: HSATGFKQSSKALQ, Core: FKQSSKALQ
  VARIANT 6: note = F, I, L, M, V, W, or Y
  VARIANT 9: note = A, C, E, F, G, H, I, K, L, M, N, Q, R, S, T, V, W, or Y
  VARIANT 11: note = A, G, H, I, K, L, N, P, Q, R, S, T, or V
  VARIANT 14: note = A, C, D, E, F, G, H, I, K, L, M, N, P, Q, R, S, T, V, W, or Y
HSATGXKQXSXALX

SEQ ID NO: 61746 - protein, 15 aa, synthetic construct
  source 1..15: note = Seed: HSATGFKQSSKALQR, Core: FKQSSKALQ
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXR

SEQ ID NO: 61747 - protein, 16 aa, synthetic construct
  source 1..16: note = Seed: HSATGFKQSSKALQRP, Core: FKQSSKALQ
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXRP

SEQ ID NO: 61748 - protein, 17 aa, synthetic construct
  source 1..17: note = Seed: HSATGFKQSSKALQRPV, Core: FKQSSKALQ
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXRPV

SEQ ID NO: 61749 - protein, 18 aa, synthetic construct
  source 1..18: note = Seed: HSATGFKQSSKALQRPVA, Core: FKQSSKALQ
  VARIANT 6: note = A, C, E, F, G, H, I, K, L, M, N, P, Q, R, S, T, V, W, or Y
  VARIANT 9: note = A, C, E, F, G, H, I, K, L, M, N, Q, R, S, T, V, W, or Y
  VARIANT 11: note = A, C, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXRPVA

SEQ ID NO: 61750 - protein, 19 aa, synthetic construct
  source 1..19: note = Seed: HSATGFKQSSKALQRPVAS, Core: FKQSSKALQ
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXRPVAS

SEQ ID NO: 61751 - protein, 19 aa, synthetic construct
  source 1..19: note = Seed: HSATGFKQSSKALQRPVAS, Core: KQSSKALQR
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSATGFXQSXKXLQXPVAS

SEQ ID NO: 61752 - protein, 20 aa, synthetic construct
  source 1..20: note = Seed: HSATGFKQSSKALQRPVASD, Core: FKQSSKALQ
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXRPVASD

SEQ ID NO: 61753 - protein, 20 aa, synthetic construct
  source 1..20: note = Seed: HSATGFKQSSKALQRPVASD, Core: KQSSKALQR
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSATGFXQSXKXLQXPVASD

SEQ ID NO: 61754 - protein, 21 aa, synthetic construct
  source 1..21: note = Seed: HSATGFKQSSKALQRPVASDF, Core: FKQSSKALQ
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXRPVASDF

SEQ ID NO: 61755 - protein, 21 aa, synthetic construct
  source 1..21: note = Seed: HSATGFKQSSKALQRPVASDF, Core: KALQRPVAS
  VARIANT 11: note = E, F, H, K, M, R, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, or Y
HSATGFKQSSXALXRXVAXDF

SEQ ID NO: 61756 - protein, 22 aa, synthetic construct
  source 1..22: note = Seed: HSATGFKQSSKALQRPVASDFE, Core: FKQSSKALQ
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXRPVASDFE

SEQ ID NO: 61757 - protein, 22 aa, synthetic construct
  source 1..22: note = Seed: HSATGFKQSSKALQRPVASDFE, Core: KALQRPVAS
  VARIANT 11: note = E, F, H, I, K, L, M, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
HSATGFKQSSXALXRXVAXDFE

SEQ ID NO: 61758 - protein, 23 aa, synthetic construct
  source 1..23: note = Seed: HSATGFKQSSKALQRPVASDFEP, Core: FKQSSKALQ
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXRPVASDFEP

SEQ ID NO: 61759 - protein, 23 aa, synthetic construct
  source 1..23: note = Seed: HSATGFKQSSKALQRPVASDFEP, Core: KALQRPVAS
  VARIANT 11: note = A, E, F, H, I, K, L, M, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
HSATGFKQSSXALXRXVAXDFEP

SEQ ID NO: 61760 - protein, 24 aa, synthetic construct
  source 1..24: note = Seed: HSATGFKQSSKALQRPVASDFEPQ, Core: FKQSSKALQ
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXRPVASDFEPQ

SEQ ID NO: 61761 - protein, 24 aa, synthetic construct
  source 1..24: note = Seed: HSATGFKQSSKALQRPVASDFEPQ, Core: KALQRPVAS
  VARIANT 11: note = A, E, F, H, I, K, L, M, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
HSATGFKQSSXALXRXVAXDFEPQ

SEQ ID NO: 61762 - protein, 25 aa, synthetic construct
  source 1..25: note = Seed: HSATGFKQSSKALQRPVASDFEPQG, Core: FKQSSKALQ
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
HSATGXKQXSXALXRPVASDFEPQG

SEQ ID NO: 61763 - protein, 25 aa, synthetic construct
  source 1..25: note = Seed: HSATGFKQSSKALQRPVASDFEPQG, Core: KALQRPVAS
  VARIANT 11: note = A, D, E, F, H, I, K, L, M, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
HSATGFKQSSXALXRXVAXDFEPQG

SEQ ID NO: 61764 - protein, 16 aa, synthetic construct
  source 1..16: note = Seed: IVHSATGFKQSSKALQ, Core: FKQSSKALQ
  VARIANT 8: note = A, C, F, H, I, K, L, M, Q, R, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
IVHSATGXKQXSXALX

SEQ ID NO: 61765 - protein, 17 aa, synthetic construct
  source 1..17: note = Seed: IVHSATGFKQSSKALQR, Core: FKQSSKALQ
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
IVHSATGXKQXSXALXR

SEQ ID NO: 61766 - protein, 18 aa, synthetic construct
  source 1..18: note = Seed: IVHSATGFKQSSKALQRP, Core: FKQSSKALQ
  VARIANT 8: note = F, I, L, M, V, W, or Y
  VARIANT 11: note = A, C, E, F, G, H, I, K, L, M, N, Q, R, S, T, V, W, or Y
  VARIANT 13: note = A, G, H, I, K, L, M, N, P, Q, R, S, T, or V
  VARIANT 16: note = A, C, D, E, F, G, H, I, K, L, M, N, P, Q, R, S, T, V, W, or Y
IVHSATGXKQXSXALXRP

SEQ ID NO: 61767 - protein, 19 aa, synthetic construct
  source 1..19: note = Seed: IVHSATGFKQSSKALQRPV, Core: FKQSSKALQ
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
IVHSATGXKQXSXALXRPV

SEQ ID NO: 61768 - protein, 20 aa, synthetic construct
  source 1..20: note = Seed: IVHSATGFKQSSKALQRPVA, Core: FKQSSKALQ
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
IVHSATGXKQXSXALXRPVA

SEQ ID NO: 61769 - protein, 20 aa, synthetic construct
  source 1..20: note = Seed: IVHSATGFKQSSKALQRPVA, Core: KQSSKALQR
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
IVHSATGFXQSXKXLQXPVA

SEQ ID NO: 61770 - protein, 21 aa, synthetic construct
  source 1..21: note = Seed: IVHSATGFKQSSKALQRPVAS, Core: FKQSSKALQ
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
IVHSATGXKQXSXALXRPVAS

SEQ ID NO: 61771 - protein, 22 aa, synthetic construct
  source 1..22: note = Seed: IVHSATGFKQSSKALQRPVASD, Core: FKQSSKALQ
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
IVHSATGXKQXSXALXRPVASD

SEQ ID NO: 61772 - protein, 23 aa, synthetic construct
  source 1..23: note = Seed: IVHSATGFKQSSKALQRPVASDF, Core: FKQSSKALQ
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
IVHSATGXKQXSXALXRPVASDF

SEQ ID NO: 61773 - protein, 23 aa, synthetic construct
  source 1..23: note = Seed: IVHSATGFKQSSKALQRPVASDF, Core: KALQRPVAS
  VARIANT 13: note = E, F, H, K, M, R, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, S, T, V, W, or Y
  VARIANT 21: note = A, C, D, E, F, G, H, I, K, L, M, N, P, Q, R, S, T, V, or Y
IVHSATGFKQSSXALXRXVAXDF

SEQ ID NO: 61774 - protein, 23 aa, synthetic construct
  source 1..23: note = Seed: IVHSATGFKQSSKALQRPVASDF, Core: KQSSKALQR
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
IVHSATGFXQSXKXLQXPVASDF

SEQ ID NO: 61775 - protein, 24 aa, synthetic construct
  source 1..24: note = Seed: IVHSATGFKQSSKALQRPVASDFE, Core: FKQSSKALQ
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
IVHSATGXKQXSXALXRPVASDFE

SEQ ID NO: 61776 - protein, 24 aa, synthetic construct
  source 1..24: note = Seed: IVHSATGFKQSSKALQRPVASDFE, Core: KALQRPVAS
  VARIANT 13: note = E, F, H, I, K, L, M, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
IVHSATGFKQSSXALXRXVAXDFE

SEQ ID NO: 61777 - protein, 24 aa, synthetic construct
  source 1..24: note = Seed: IVHSATGFKQSSKALQRPVASDFE, Core: KQSSKALQR
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
IVHSATGFXQSXKXLQXPVASDFE

SEQ ID NO: 61778 - protein, 25 aa, synthetic construct
  source 1..25: note = Seed: IVHSATGFKQSSKALQRPVASDFEP, Core: FKQSSKALQ
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
IVHSATGXKQXSXALXRPVASDFEP

SEQ ID NO: 61779 - protein, 25 aa, synthetic construct
  source 1..25: note = Seed: IVHSATGFKQSSKALQRPVASDFEP, Core: KALQRPVAS
  VARIANT 13: note = E, F, H, I, K, L, M, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
IVHSATGFKQSSXALXRXVAXDFEP

SEQ ID NO: 61780 - protein, 25 aa, synthetic construct
  source 1..25: note = Seed: IVHSATGFKQSSKALQRPVASDFEP, Core: KQSSKALQR
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
IVHSATGFXQSXKXLQXPVASDFEP

SEQ ID NO: 61781 - protein, 15 aa, synthetic construct
  source 1..15: note = Seed: KQSSKALQRPVASDF, Core: KALQRPVAS
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
KQSSXALXRXVAXDF

SEQ ID NO: 61782 - protein, 15 aa, synthetic construct
  source 1..15: note = Seed: KQSSKALQRPVASDF, Core: SKALQRPVA
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
KQSXKAXQXPVXSDF

SEQ ID NO: 61783 - protein, 16 aa, synthetic construct
  source 1..16: note = Seed: KQSSKALQRPVASDFE, Core: SKALQRPVA
  VARIANT 4: note = A, C, F, H, I, K, L, M, N, Q, R, S, T, V, W, or Y
  VARIANT 7: note = A, C, E, F, G, H, I, K, L, M, N, Q, R, S, T, V, W, or Y
  VARIANT 9: note = A, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
KQSXKAXQXPVXSDFE

SEQ ID NO: 61784 - protein, 17 aa, synthetic construct
  source 1..17: note = Seed: KQSSKALQRPVASDFEP, Core: KALQRPVAS
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
KQSSXALXRXVAXDFEP

SEQ ID NO: 61785 - protein, 17 aa, synthetic construct
  source 1..17: note = Seed: KQSSKALQRPVASDFEP, Core: SKALQRPVA
  VARIANT 4: note = A, C, F, G, H, I, K, L, M, N, Q, R, S, T, V, W, or Y
  VARIANT 7: note = A, C, D, E, F, G, H, I, K, L, M, N, Q, R, S, T, V, W, or Y
  VARIANT 9: note = A, C, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
KQSXKAXQXPVXSDFEP

SEQ ID NO: 61786 - protein, 20 aa, synthetic construct
  source 1..20: note = Seed: KQSSKALQRPVASDFEPQGL, Core: KALQRPVAS
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
KQSSXALXRXVAXDFEPQGL

SEQ ID NO: 61787 - protein, 20 aa, synthetic construct
  source 1..20: note = Seed: KQSSKALQRPVASDFEPQGL, Core: SKALQRPVA
  VARIANT 4: note = A, C, F, H, I, K, L, M, N, Q, R, S, T, V, W, or Y
  VARIANT 7: note = A, C, D, E, F, G, H, I, K, L, M, N, Q, R, S, T, V, W, or Y
  VARIANT 9: note = A, C, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
KQSXKAXQXPVXSDFEPQGL

SEQ ID NO: 61788 - protein, 21 aa, synthetic construct
  source 1..21: note = Seed: KQSSKALQRPVASDFEPQGLS, Core: SKALQRPVA
  VARIANT 4: note = A, C, F, H, I, K, L, M, N, Q, R, S, T, V, W, or Y
  VARIANT 7: note = A, C, E, F, G, H, I, K, L, M, N, Q, R, S, T, V, W, or Y
  VARIANT 9: note = A, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
KQSXKAXQXPVXSDFEPQGLS

SEQ ID NO: 61789 - protein, 22 aa, synthetic construct
  source 1..22: note = Seed: KQSSKALQRPVASDFEPQGLSE, Core: SKALQRPVA
  VARIANT 4: note = A, C, F, H, I, K, L, M, N, Q, S, T, V, W, or Y
  VARIANT 7: note = A, C, E, F, G, H, I, K, L, M, N, Q, R, S, T, V, W, or Y
  VARIANT 9: note = A, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
KQSXKAXQXPVXSDFEPQGLSE

SEQ ID NO: 61790 - protein, 25 aa, synthetic construct
  source 1..25: note = Seed: KQSSKALQRPVASDFEPQGLSEAAR, Core: SKALQRPVA
  VARIANT 4: note = A, C, F, H, I, K, L, M, N, Q, S, T, V, W, or Y
  VARIANT 7: note = A, C, D, E, F, G, H, I, K, L, M, N, Q, R, S, T, V, W, or Y
  VARIANT 9: note = A, C, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
KQSXKAXQXPVXSDFEPQGLSEAAR

SEQ ID NO: 61791 - protein, 19 aa, synthetic construct
  source 1..19: note = Seed: LNVIVHSATGFKQSSKALQ, Core: FKQSSKALQ
  VARIANT 11: note = F, I, L, M, V, W, or Y
  VARIANT 14: note = A, C, E, F, G, H, I, K, L, M, N, Q, R, S, T, V, W, or Y
  VARIANT 16: note = A, G, H, I, K, L, N, P, Q, R, S, T, or V
  VARIANT 19: note = A, C, D, E, F, G, H, I, K, L, M, N, P, Q, R, S, T, V, W, or Y
LNVIVHSATGXKQXSXALX

SEQ ID NO: 61792 - protein, 20 aa, synthetic construct
  source 1..20: note = Seed: LNVIVHSATGFKQSSKALQR, Core: FKQSSKALQ
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LNVIVHSATGXKQXSXALXR

SEQ ID NO: 61793 - protein, 21 aa, synthetic construct
  source 1..21: note = Seed: LNVIVHSATGFKQSSKALQRP, Core: FKQSSKALQ
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LNVIVHSATGXKQXSXALXRP

SEQ ID NO: 61794 - protein, 22 aa, synthetic construct
  source 1..22: note = Seed: LNVIVHSATGFKQSSKALQRPV, Core: FKQSSKALQ
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LNVIVHSATGXKQXSXALXRPV

SEQ ID NO: 61795 - protein, 23 aa, synthetic construct
  source 1..23: note = Seed: LNVIVHSATGFKQSSKALQRPVA, Core: FKQSSKALQ
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LNVIVHSATGXKQXSXALXRPVA

SEQ ID NO: 61796 - protein, 23 aa, synthetic construct
  source 1..23: note = Seed: LNVIVHSATGFKQSSKALQRPVA, Core: KQSSKALQR
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
LNVIVHSATGFXQSXKXLQXPVA

SEQ ID NO: 61797 - protein, 24 aa, synthetic construct
  source 1..24: note = Seed: LNVIVHSATGFKQSSKALQRPVAS, Core: FKQSSKALQ
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LNVIVHSATGXKQXSXALXRPVAS

SEQ ID NO: 61798 - protein, 24 aa, synthetic construct
  source 1..24: note = Seed: LNVIVHSATGFKQSSKALQRPVAS, Core: KQSSKALQR
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
LNVIVHSATGFXQSXKXLQXPVAS

SEQ ID NO: 61799 - protein, 25 aa, synthetic construct
  source 1..25: note = Seed: LNVIVHSATGFKQSSKALQRPVASD, Core: FKQSSKALQ
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LNVIVHSATGXKQXSXALXRPVASD

SEQ ID NO: 61800 - protein, 25 aa, synthetic construct
  source 1..25: note = Seed: LNVIVHSATGFKQSSKALQRPVASD, Core: KQSSKALQR
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
LNVIVHSATGFXQSXKXLQXPVASD

SEQ ID NO: 61801 - protein, 23 aa, synthetic construct
  source 1..23: note = Seed: LYGFLNVIVHSATGFKQSSKALQ, Core: FKQSSKALQ
  VARIANT 15: note = F, I, L, M, V, W, or Y
  VARIANT 18: note = A, C, D, E, F, G, H, I, K, L, M, N, Q, R, S, T, V, W, or Y
  VARIANT 20: note = A, C, D, E, F, G, H, I, K, L, M, N, P, Q, R, S, T, V, W, or Y
  VARIANT 23: note = A, C, D, E, F, G, H, I, K, L, M, N, P, Q, R, S, T, V, W, or Y
LYGFLNVIVHSATGXKQXSXALX

SEQ ID NO: 61802 - protein, 24 aa, synthetic construct
  source 1..24: note = Seed: LYGFLNVIVHSATGFKQSSKALQR, Core: FKQSSKALQ
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
  VARIANT 23: note = A, C, D, E, F, G, H, I, K, L, M, N, P, Q, R, S, T, V, W, or Y
LYGFLNVIVHSATGXKQXSXALXR

SEQ ID NO: 61803 - protein, 25 aa, synthetic construct
  source 1..25: note = Seed: LYGFLNVIVHSATGFKQSSKALQRP, Core: FKQSSKALQ
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
  VARIANT 23: note = A, C, D, E, F, G, H, I, K, L, M, N, P, Q, R, S, T, V, W, or Y
LYGFLNVIVHSATGXKQXSXALXRP

SEQ ID NO: 61804 - protein, 19 aa, synthetic construct
  source 1..19: note = Seed: NVIVHSATGFKQSSKALQR, Core: FKQSSKALQ
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
NVIVHSATGXKQXSXALXR

SEQ ID NO: 61805 - protein, 20 aa, synthetic construct
  source 1..20: note = Seed: NVIVHSATGFKQSSKALQRP, Core: FKQSSKALQ
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
NVIVHSATGXKQXSXALXRP

SEQ ID NO: 61806 - protein, 21 aa, synthetic construct
  source 1..21: note = Seed: NVIVHSATGFKQSSKALQRPV, Core: FKQSSKALQ
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
NVIVHSATGXKQXSXALXRPV

SEQ ID NO: 61807 - protein, 22 aa, synthetic construct
  source 1..22: note = Seed: NVIVHSATGFKQSSKALQRPVA, Core: FKQSSKALQ
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
NVIVHSATGXKQXSXALXRPVA

SEQ ID NO: 61808 - protein, 23 aa, synthetic construct
  source 1..23: note = Seed: NVIVHSATGFKQSSKALQRPVAS, Core: FKQSSKALQ
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
NVIVHSATGXKQXSXALXRPVAS

SEQ ID NO: 61809 - protein, 24 aa, synthetic construct
  source 1..24: note = Seed: NVIVHSATGFKQSSKALQRPVASD, Core: FKQSSKALQ
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
NVIVHSATGXKQXSXALXRPVASD

SEQ ID NO: 61810 - protein, 25 aa, synthetic construct
  source 1..25: note = Seed: NVIVHSATGFKQSSKALQRPVASDF, Core: FKQSSKALQ
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
NVIVHSATGXKQXSXALXRPVASDF

SEQ ID NO: 61811 - protein, 25 aa, synthetic construct
  source 1..25: note = Seed: NVIVHSATGFKQSSKALQRPVASDF, Core: KQSSKALQR
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
NVIVHSATGFXQSXKXLQXPVASDF

SEQ ID NO: 61812 - protein, 25 aa, synthetic construct
  source 1..25: note = Seed: PGLYGFLNVIVHSATGFKQSSKALQ, Core: FKQSSKALQ
  VARIANT 17: note = F, I, L, M, V, W, or Y
  VARIANT 20: note = A, C, D, E, F, G, H, I, K, L, M, N, Q, R, S, T, V, W, or Y
  VARIANT 22: note = A, C, D, E, F, G, H, I, K, L, M, N, P, Q, R, S, T, V, or Y
  VARIANT 25: note = A, C, D, E, F, G, H, I, K, L, M, N, P, Q, R, S, T, V, W, or Y
PGLYGFLNVIVHSATGXKQXSXALX

SEQ ID NO: 61813 - protein, 15 aa, synthetic construct
  source 1..15: note = Seed: QSSKALQRPVASDFE, Core: KALQRPVAS
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
QSSXALXRXVAXDFE

SEQ ID NO: 61814 - protein, 15 aa, synthetic construct
  source 1..15: note = Seed: QSSKALQRPVASDFE, Core: SKALQRPVA
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, Q, R, S, T, V, W, or Y
  VARIANT 8: note = A, C, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
QSXKAXQXPVXSDFE

SEQ ID NO: 61815 - protein, 20 aa, synthetic construct
  source 1..20: note = Seed: QSSKALQRPVASDFEPQGLS, Core: KALQRPVAS
  VARIANT 4: note = A, D, E, F, H, I, K, L, M, Q, R, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
QSSXALXRXVAXDFEPQGLS

SEQ ID NO: 61816 - protein, 14 aa, synthetic construct
  source 1..14: note = Seed: SATGFKQSSKALQR, Core: FKQSSKALQ
  VARIANT 5: note = A, C, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXR

SEQ ID NO: 61817 - protein, 15 aa, synthetic construct
  source 1..15: note = Seed: SATGFKQSSKALQRP, Core: FKQSSKALQ
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRP

SEQ ID NO: 61818 - protein, 16 aa, synthetic construct
  source 1..16: note = Seed: SATGFKQSSKALQRPV, Core: FKQSSKALQ
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRPV

SEQ ID NO: 61819 - protein, 17 aa, synthetic construct
  source 1..17: note = Seed: SATGFKQSSKALQRPVA, Core: FKQSSKALQ
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRPVA

SEQ ID NO: 61820 - protein, 17 aa, synthetic construct
  source 1..17: note = Seed: SATGFKQSSKALQRPVA, Core: KQSSKALQR
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SATGFXQSXKXLQXPVA

SEQ ID NO: 61821 - protein, 18 aa, synthetic construct
  source 1..18: note = Seed: SATGFKQSSKALQRPVAS, Core: FKQSSKALQ
  VARIANT 5: note = A, C, E, F, G, H, I, K, L, M, N, P, Q, R, S, T, V, W, or Y
  VARIANT 8: note = A, C, E, F, G, H, I, K, L, M, N, Q, R, S, T, V, W, or Y
  VARIANT 10: note = A, C, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRPVAS

SEQ ID NO: 61822 - protein, 19 aa, synthetic construct
  source 1..19: note = Seed: SATGFKQSSKALQRPVASD, Core: FKQSSKALQ
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRPVASD

SEQ ID NO: 61823 - protein, 19 aa, synthetic construct
  source 1..19: note = Seed: SATGFKQSSKALQRPVASD, Core: KQSSKALQR
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SATGFXQSXKXLQXPVASD

SEQ ID NO: 61824 - protein, 20 aa, synthetic construct
  source 1..20: note = Seed: SATGFKQSSKALQRPVASDF, Core: FKQSSKALQ
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRPVASDF

SEQ ID NO: 61825 - protein, 20 aa, synthetic construct
  source 1..20: note = Seed: SATGFKQSSKALQRPVASDF, Core: KALQRPVAS
  VARIANT 10: note = A, E, F, H, K, M, N, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, or Y
SATGFKQSSXALXRXVAXDF

SEQ ID NO: 61826 - protein, 20 aa, synthetic construct
  source 1..20: note = Seed: SATGFKQSSKALQRPVASDF, Core: KQSSKALQR
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SATGFXQSXKXLQXPVASDF

SEQ ID NO: 61827 - protein, 21 aa, synthetic construct
  source 1..21: note = Seed: SATGFKQSSKALQRPVASDFE, Core: FKQSSKALQ
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRPVASDFE

SEQ ID NO: 61828 - protein, 21 aa, synthetic construct
  source 1..21: note = Seed: SATGFKQSSKALQRPVASDFE, Core: KALQRPVAS
  VARIANT 10: note = E, F, H, I, K, L, M, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
SATGFKQSSXALXRXVAXDFE

SEQ ID NO: 61829 - protein, 22 aa, synthetic construct
  source 1..22: note = Seed: SATGFKQSSKALQRPVASDFEP, Core: FKQSSKALQ
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRPVASDFEP

SEQ ID NO: 61830 - protein, 22 aa, synthetic construct
  source 1..22: note = Seed: SATGFKQSSKALQRPVASDFEP, Core: KALQRPVAS
  VARIANT 10: note = A, C, D, E, F, G, H, I, K, L, M, N, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
SATGFKQSSXALXRXVAXDFEP

SEQ ID NO: 61831 - protein, 23 aa, synthetic construct
  source 1..23: note = Seed: SATGFKQSSKALQRPVASDFEPQ, Core: FKQSSKALQ
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRPVASDFEPQ

SEQ ID NO: 61832 - protein, 23 aa, synthetic construct
  source 1..23: note = Seed: SATGFKQSSKALQRPVASDFEPQ, Core: KALQRPVAS
  VARIANT 10: note = A, C, D, E, F, G, H, I, K, L, M, N, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
SATGFKQSSXALXRXVAXDFEPQ

SEQ ID NO: 61833 - protein, 24 aa, synthetic construct
  source 1..24: note = Seed: SATGFKQSSKALQRPVASDFEPQG, Core: FKQSSKALQ
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRPVASDFEPQG

SEQ ID NO: 61834 - protein, 24 aa, synthetic construct
  source 1..24: note = Seed: SATGFKQSSKALQRPVASDFEPQG, Core: KALQRPVAS
  VARIANT 10: note = A, C, D, E, F, G, H, I, K, L, M, N, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
SATGFKQSSXALXRXVAXDFEPQG

SEQ ID NO: 61835 - protein, 25 aa, synthetic construct
  source 1..25: note = Seed: SATGFKQSSKALQRPVASDFEPQGL, Core: FKQSSKALQ
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
SATGXKQXSXALXRPVASDFEPQGL

SEQ ID NO: 61836 - protein, 25 aa, synthetic construct
  source 1..25: note = Seed: SATGFKQSSKALQRPVASDFEPQGL, Core: KALQRPVAS
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
SATGFKQSSXALXRXVAXDFEPQGL

SEQ ID NO: 61837 - protein, 25 aa, synthetic construct
  source 1..25: note = Seed: SATGFKQSSKALQRPVASDFEPQGL, Core: KQSSKALQR
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SATGFXQSXKXLQXPVASDFEPQGL

SEQ ID NO: 61838 - protein, 15 aa, synthetic construct
  source 1..15: note = Seed: SSKALQRPVASDFEP, Core: KALQRPVAS
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
SSXALXRXVAXDFEP

SEQ ID NO: 61839 - protein, 13 aa, synthetic construct
  source 1..13: note = Seed: TGFKQSSKALQRP, Core: FKQSSKALQ
  VARIANT 3: note = F, I, L, M, V, W, or Y
  VARIANT 6: note = A, C, E, F, G, H, I, K, L, M, N, Q, R, S, T, V, W, or Y
  VARIANT 8: note = A, G, H, I, K, L, M, N, P, Q, R, S, T, or V
  VARIANT 11: note = A, C, D, E, F, G, H, I, K, L, M, N, P, Q, R, S, T, V, W, or Y
TGXKQXSXALXRP

SEQ ID NO: 61840 - protein, 14 aa, synthetic construct
  source 1..14: note = Seed: TGFKQSSKALQRPV, Core: FKQSSKALQ
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPV

SEQ ID NO: 61841 - protein, 14 aa, synthetic construct
  source 1..14: note = Seed: TGFKQSSKALQRPV, Core: KQSSKALQR
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
TGFXQSXKXLQXPV

SEQ ID NO: 61842 - protein, 15 aa, synthetic construct
  source 1..15: note = Seed: TGFKQSSKALQRPVA, Core: FKQSSKALQ
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPVA

SEQ ID NO: 61843 - protein, 15 aa, synthetic construct
  source 1..15: note = Seed: TGFKQSSKALQRPVA, Core: KQSSKALQR
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
TGFXQSXKXLQXPVA

SEQ ID NO: 61844 - protein, 16 aa, synthetic construct
  source 1..16: note = Seed: TGFKQSSKALQRPVAS, Core: FKQSSKALQ
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPVAS

SEQ ID NO: 61845 - protein, 16 aa, synthetic construct
  source 1..16: note = Seed: TGFKQSSKALQRPVAS, Core: KQSSKALQR
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
TGFXQSXKXLQXPVAS

SEQ ID NO: 61846 - protein, 17 aa, synthetic construct
  source 1..17: note = Seed: TGFKQSSKALQRPVASD, Core: FKQSSKALQ
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPVASD

SEQ ID NO: 61847 - protein, 17 aa, synthetic construct
  source 1..17: note = Seed: TGFKQSSKALQRPVASD, Core: KALQRPVAS
  VARIANT 8: note = E, F, H, K, M, Q, R, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, or Y
TGFKQSSXALXRXVAXD

SEQ ID NO: 61848 - protein, 17 aa, synthetic construct
  source 1..17: note = Seed: TGFKQSSKALQRPVASD, Core: KQSSKALQR
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
TGFXQSXKXLQXPVASD

SEQ ID NO: 61849 - protein, 17 aa, synthetic construct
  source 1..17: note = Seed: TGFKQSSKALQRPVASD, Core: SSKALQRPV
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
TGFKQXSKXLXRPXASD

SEQ ID NO: 61850 - protein, 18 aa, synthetic construct
  source 1..18: note = Seed: TGFKQSSKALQRPVASDF, Core: FKQSSKALQ
  VARIANT 3: note = F, I, L, M, V, W, or Y
  VARIANT 6: note = A, C, E, F, G, H, I, K, L, M, N, Q, R, S, T, V, W, or Y
  VARIANT 8: note = A, G, H, I, K, L, M, N, P, Q, R, S, T, or V
  VARIANT 11: note = A, C, D, E, F, G, H, I, K, L, M, N, P, Q, R, S, T, V, W, or Y
TGXKQXSXALXRPVASDF

SEQ ID NO: 61851 - protein, 19 aa, synthetic construct
  source 1..19: note = Seed: TGFKQSSKALQRPVASDFE, Core: FKQSSKALQ
  VARIANT 3: note = A, C, D, E, F, G, H, I, K, L, M, N, P, Q, R, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPVASDFE

SEQ ID NO: 61852 - protein, 19 aa, synthetic construct
  source 1..19: note = Seed: TGFKQSSKALQRPVASDFE, Core: KALQRPVAS
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
TGFKQSSXALXRXVAXDFE

SEQ ID NO: 61853 - protein, 19 aa, synthetic construct
  source 1..19: note = Seed: TGFKQSSKALQRPVASDFE, Core: KQSSKALQR
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, S, T, V, W, or Y
  VARIANT 12: note = A, C, D, E, F, G, H, I, K, L, M, N, P, Q, R, S, T, V, W, or Y
TGFXQSXKXLQXPVASDFE

SEQ ID NO: 61854 - protein, 20 aa, synthetic construct
  source 1..20: note = Seed: TGFKQSSKALQRPVASDFEP, Core: FKQSSKALQ
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPVASDFEP

SEQ ID NO: 61855 - protein, 20 aa, synthetic construct
  source 1..20: note = Seed: TGFKQSSKALQRPVASDFEP, Core: KALQRPVAS
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
TGFKQSSXALXRXVAXDFEP

SEQ ID NO: 61856 - protein, 20 aa, synthetic construct
  source 1..20: note = Seed: TGFKQSSKALQRPVASDFEP, Core: KQSSKALQR
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
TGFXQSXKXLQXPVASDFEP

SEQ ID NO: 61857 - protein, 20 aa, synthetic construct
  source 1..20: note = Seed: TGFKQSSKALQRPVASDFEP, Core: SSKALQRPV
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
TGFKQXSKXLXRPXASDFEP

SEQ ID NO: 61858 - protein, 21 aa, synthetic construct
  source 1..21: note = Seed: TGFKQSSKALQRPVASDFEPQ, Core: FKQSSKALQ
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPVASDFEPQ

SEQ ID NO: 61859 - protein, 21 aa, synthetic construct
  source 1..21: note = Seed: TGFKQSSKALQRPVASDFEPQ, Core: KALQRPVAS
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
TGFKQSSXALXRXVAXDFEPQ

SEQ ID NO: 61860 - protein, 21 aa, synthetic construct
  source 1..21: note = Seed: TGFKQSSKALQRPVASDFEPQ, Core: KQSSKALQR
  VARIANT 4: note = A, C, E, F, H, I, K, L, M, N, P, Q, R, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, S, T, V, W, or Y
  VARIANT 12: note = A, C, D, E, F, G, H, I, K, L, M, N, P, Q, R, S, T, V, W, or Y
TGFXQSXKXLQXPVASDFEPQ

SEQ ID NO: 61861 - protein, 22 aa, synthetic construct
  source 1..22: note = Seed: TGFKQSSKALQRPVASDFEPQG, Core: FKQSSKALQ
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPVASDFEPQG

SEQ ID NO: 61862 - protein, 22 aa, synthetic construct
  source 1..22: note = Seed: TGFKQSSKALQRPVASDFEPQG, Core: KALQRPVAS
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
TGFKQSSXALXRXVAXDFEPQG

SEQ ID NO: 61863 - protein, 22 aa, synthetic construct
  source 1..22: note = Seed: TGFKQSSKALQRPVASDFEPQG, Core: KQSSKALQR
  VARIANT 4: note = A, E, F, H, I, K, L, M, N, P, Q, R, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, S, T, V, W, or Y
  VARIANT 12: note = A, C, D, E, F, G, H, I, K, L, M, N, P, Q, R, S, T, V, W, or Y
TGFXQSXKXLQXPVASDFEPQG

SEQ ID NO: 61864 - protein, 23 aa, synthetic construct
  source 1..23: note = Seed: TGFKQSSKALQRPVASDFEPQGL, Core: FKQSSKALQ
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPVASDFEPQGL

SEQ ID NO: 61865 - protein, 23 aa, synthetic construct
  source 1..23: note = Seed: TGFKQSSKALQRPVASDFEPQGL, Core: KALQRPVAS
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
TGFKQSSXALXRXVAXDFEPQGL

SEQ ID NO: 61866 - protein, 23 aa, synthetic construct
  source 1..23: note = Seed: TGFKQSSKALQRPVASDFEPQGL, Core: KQSSKALQR
  VARIANT 4: note = A, E, F, H, I, K, L, M, N, P, Q, R, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, S, T, V, W, or Y
  VARIANT 12: note = A, C, D, E, F, G, H, I, K, L, M, N, P, Q, R, S, T, V, W, or Y
TGFXQSXKXLQXPVASDFEPQGL

SEQ ID NO: 61867 - protein, 24 aa, synthetic construct
  source 1..24: note = Seed: TGFKQSSKALQRPVASDFEPQGLS, Core: FKQSSKALQ
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPVASDFEPQGLS

SEQ ID NO: 61868 - protein, 24 aa, synthetic construct
  source 1..24: note = Seed: TGFKQSSKALQRPVASDFEPQGLS, Core: KALQRPVAS
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
TGFKQSSXALXRXVAXDFEPQGLS

SEQ ID NO: 61869 - protein, 24 aa, synthetic construct
  source 1..24: note = Seed: TGFKQSSKALQRPVASDFEPQGLS, Core: KQSSKALQR
  VARIANT 4: note = A, D, E, F, H, I, K, L, M, N, P, Q, R, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, S, T, V, W, or Y
  VARIANT 12: note = A, C, D, E, F, G, H, I, K, L, M, N, P, Q, R, S, T, V, W, or Y
TGFXQSXKXLQXPVASDFEPQGLS

SEQ ID NO: 61870 - protein, 25 aa, synthetic construct
  source 1..25: note = Seed: TGFKQSSKALQRPVASDFEPQGLSE, Core: FKQSSKALQ
  VARIANT 3: note = A, C, D, F, G, H, I, L, M, P, Q, R, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
TGXKQXSXALXRPVASDFEPQGLSE

SEQ ID NO: 61871 - protein, 25 aa, synthetic construct
  source 1..25: note = Seed: TGFKQSSKALQRPVASDFEPQGLSE, Core: KALQRPVAS
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
TGFKQSSXALXRXVAXDFEPQGLSE

SEQ ID NO: 61872 - protein, 25 aa, synthetic construct
  source 1..25: note = Seed: TGFKQSSKALQRPVASDFEPQGLSE, Core: KQSSKALQR
  VARIANT 4: note = A, D, E, F, H, I, K, L, M, N, P, Q, R, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, S, T, V, W, or Y
  VARIANT 12: note = A, C, D, E, F, G, H, I, K, L, M, N, P, Q, R, S, T, V, W, or Y
TGFXQSXKXLQXPVASDFEPQGLSE

SEQ ID NO: 61873 - protein, 15 aa, synthetic construct
  source 1..15: note = Seed: VHSATGFKQSSKALQ, Core: FKQSSKALQ
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALX

SEQ ID NO: 61874 - protein, 16 aa, synthetic construct
  source 1..16: note = Seed: VHSATGFKQSSKALQR, Core: FKQSSKALQ
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALXR

SEQ ID NO: 61875 - protein, 17 aa, synthetic construct
  source 1..17: note = Seed: VHSATGFKQSSKALQRP, Core: FKQSSKALQ
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALXRP

SEQ ID NO: 61876 - protein, 18 aa, synthetic construct
  source 1..18: note = Seed: VHSATGFKQSSKALQRPV, Core: FKQSSKALQ
  VARIANT 7: note = C, F, H, I, K, L, M, R, V, W, or Y
  VARIANT 10: note = A, C, E, F, G, H, I, K, L, M, N, Q, R, S, T, V, W, or Y
  VARIANT 12: note = A, C, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALXRPV

SEQ ID NO: 61877 - protein, 19 aa, synthetic construct
  source 1..19: note = Seed: VHSATGFKQSSKALQRPVA, Core: FKQSSKALQ
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALXRPVA

SEQ ID NO: 61878 - protein, 19 aa, synthetic construct
  source 1..19: note = Seed: VHSATGFKQSSKALQRPVA, Core: KQSSKALQR
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSATGFXQSXKXLQXPVA

SEQ ID NO: 61879 - protein, 20 aa, synthetic construct
  source 1..20: note = Seed: VHSATGFKQSSKALQRPVAS, Core: FKQSSKALQ
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALXRPVAS

SEQ ID NO: 61880 - protein, 20 aa, synthetic construct
  source 1..20: note = Seed: VHSATGFKQSSKALQRPVAS, Core: KQSSKALQR
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSATGFXQSXKXLQXPVAS

SEQ ID NO: 61881 - protein, 21 aa, synthetic construct
  source 1..21: note = Seed: VHSATGFKQSSKALQRPVASD, Core: FKQSSKALQ
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALXRPVASD

SEQ ID NO: 61882 - protein, 22 aa, synthetic construct
  source 1..22: note = Seed: VHSATGFKQSSKALQRPVASDF, Core: FKQSSKALQ
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALXRPVASDF

SEQ ID NO: 61883 - protein, 22 aa, synthetic construct
  source 1..22: note = Seed: VHSATGFKQSSKALQRPVASDF, Core: KALQRPVAS
  VARIANT 12: note = E, F, H, K, M, R, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, S, T, V, W, or Y
  VARIANT 20: note = A, C, D, E, F, G, H, I, K, L, M, N, P, Q, R, S, T, V, or Y
VHSATGFKQSSXALXRXVAXDF

SEQ ID NO: 61884 - protein, 23 aa, synthetic construct
  source 1..23: note = Seed: VHSATGFKQSSKALQRPVASDFE, Core: FKQSSKALQ
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALXRPVASDFE

SEQ ID NO: 61885 - protein, 23 aa, synthetic construct
  source 1..23: note = Seed: VHSATGFKQSSKALQRPVASDFE, Core: KALQRPVAS
  VARIANT 12: note = E, F, H, I, K, L, M, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
VHSATGFKQSSXALXRXVAXDFE

SEQ ID NO: 61886 - protein, 23 aa, synthetic construct
  source 1..23: note = Seed: VHSATGFKQSSKALQRPVASDFE, Core: KQSSKALQR
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSATGFXQSXKXLQXPVASDFE

SEQ ID NO: 61887 - protein, 24 aa, synthetic construct
  source 1..24: note = Seed: VHSATGFKQSSKALQRPVASDFEP, Core: FKQSSKALQ
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALXRPVASDFEP

SEQ ID NO: 61888 - protein, 24 aa, synthetic construct
  source 1..24: note = Seed: VHSATGFKQSSKALQRPVASDFEP, Core: KALQRPVAS
  VARIANT 12: note = E, F, H, I, K, L, M, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
VHSATGFKQSSXALXRXVAXDFEP

SEQ ID NO: 61889 - protein, 24 aa, synthetic construct
  source 1..24: note = Seed: VHSATGFKQSSKALQRPVASDFEP, Core: KQSSKALQR
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSATGFXQSXKXLQXPVASDFEP

SEQ ID NO: 61890 - protein, 25 aa, synthetic construct
  source 1..25: note = Seed: VHSATGFKQSSKALQRPVASDFEPQ, Core: FKQSSKALQ
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
VHSATGXKQXSXALXRPVASDFEPQ

SEQ ID NO: 61891 - protein, 25 aa, synthetic construct
  source 1..25: note = Seed: VHSATGFKQSSKALQRPVASDFEPQ, Core: KALQRPVAS
  VARIANT 12: note = A, E, F, H, I, K, L, M, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
VHSATGFKQSSXALXRXVAXDFEPQ

SEQ ID NO: 61892 - protein, 25 aa, synthetic construct
  source 1..25: note = Seed: VHSATGFKQSSKALQRPVASDFEPQ, Core: KQSSKALQR
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSATGFXQSXKXLQXPVASDFEPQ

SEQ ID NO: 61893 - protein, 17 aa, synthetic construct
  source 1..17: note = Seed: VIVHSATGFKQSSKALQ, Core: FKQSSKALQ
  VARIANT 9: note = A, C, F, G, H, I, K, L, M, N, Q, R, S, T, V, W, or Y
  VARIANT 12: note = A, C, D, E, F, G, H, I, K, L, M, N, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
VIVHSATGXKQXSXALX

SEQ ID NO: 61894 - protein, 18 aa, synthetic construct
  source 1..18: note = Seed: VIVHSATGFKQSSKALQR, Core: FKQSSKALQ
  VARIANT 9: note = C, F, I, L, M, V, W, or Y
  VARIANT 12: note = A, C, E, F, G, H, I, K, L, M, N, Q, R, S, T, V, W, or Y
  VARIANT 14: note = A, G, H, I, K, L, M, N, P, Q, R, S, T, or V
  VARIANT 17: note = A, C, D, E, F, G, H, I, K, L, M, N, P, Q, R, S, T, V, W, or Y
VIVHSATGXKQXSXALXR

SEQ ID NO: 61895 - protein, 19 aa, synthetic construct
  source 1..19: note = Seed: VIVHSATGFKQSSKALQRP, Core: FKQSSKALQ
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
VIVHSATGXKQXSXALXRP

SEQ ID NO: 61896 - protein, 20 aa, synthetic construct
  source 1..20: note = Seed: VIVHSATGFKQSSKALQRPV, Core: FKQSSKALQ
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
VIVHSATGXKQXSXALXRPV

SEQ ID NO: 61897 - protein, 21 aa, synthetic construct
  source 1..21: note = Seed: VIVHSATGFKQSSKALQRPVA, Core: FKQSSKALQ
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
VIVHSATGXKQXSXALXRPVA

SEQ ID NO: 61898 - protein, 22 aa, synthetic construct
  source 1..22: note = Seed: VIVHSATGFKQSSKALQRPVAS, Core: FKQSSKALQ
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
VIVHSATGXKQXSXALXRPVAS

SEQ ID NO: 61899 - protein, 23 aa, synthetic construct
  source 1..23: note = Seed: VIVHSATGFKQSSKALQRPVASD, Core: FKQSSKALQ
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
VIVHSATGXKQXSXALXRPVASD

SEQ ID NO: 61900 - protein, 24 aa, synthetic construct
  source 1..24: note = Seed: VIVHSATGFKQSSKALQRPVASDF, Core: FKQSSKALQ
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
VIVHSATGXKQXSXALXRPVASDF

SEQ ID NO: 61901 - protein, 25 aa, synthetic construct
  source 1..25: note = Seed: VIVHSATGFKQSSKALQRPVASDFE, Core: FKQSSKALQ
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
VIVHSATGXKQXSXALXRPVASDFE

SEQ ID NO: 61902 - protein, 25 aa, synthetic construct
  source 1..25: note = Seed: VIVHSATGFKQSSKALQRPVASDFE, Core: KALQRPVAS
  VARIANT 14: note = E, F, H, I, K, L, M, Q, R, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
VIVHSATGFKQSSXALXRXVAXDFE

SEQ ID NO: 61903 - protein, 22 aa, synthetic construct
  source 1..22: note = Seed: YGFLNVIVHSATGFKQSSKALQ, Core: FKQSSKALQ
  VARIANT 14: note = F, I, L, M, V, W, or Y
  VARIANT 17: note = A, C, D, E, F, G, H, I, K, L, M, N, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
YGFLNVIVHSATGXKQXSXALX

SEQ ID NO: 61904 - protein, 23 aa, synthetic construct
  source 1..23: note = Seed: YGFLNVIVHSATGFKQSSKALQR, Core: FKQSSKALQ
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
YGFLNVIVHSATGXKQXSXALXR

SEQ ID NO: 61905 - protein, 24 aa, synthetic construct
  source 1..24: note = Seed: YGFLNVIVHSATGFKQSSKALQRP, Core: FKQSSKALQ
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
YGFLNVIVHSATGXKQXSXALXRP

SEQ ID NO: 61906 - protein, 25 aa, synthetic construct
  source 1..25: note = Seed: YGFLNVIVHSATGFKQSSKALQRPV, Core: FKQSSKALQ
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
YGFLNVIVHSATGXKQXSXALXRPV

SEQ ID NO: 61907 - protein, 20 aa, synthetic construct
  source 1..20: note = Seed: CVKLQTVHSIPLTINKEEAL, Core: LTINKEEAL
  VARIANT 12: note = A, C, D, E, F, I, L, M, P, T, V, W, or Y
  VARIANT 15: note = A, C, D, E, F, G, H, I, K, L, M, N, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
CVKLQTVHSIPXTIXKXEAX

SEQ ID NO: 61908 - protein, 21 aa, synthetic construct
  source 1..21: note = Seed: CVKLQTVHSIPLTINKEEALQ, Core: LTINKEEAL
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
CVKLQTVHSIPXTIXKXEAXQ

SEQ ID NO: 61909 - protein, 22 aa, synthetic construct
  source 1..22: note = Seed: CVKLQTVHSIPLTINKEEALQR, Core: LTINKEEAL
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
CVKLQTVHSIPXTIXKXEAXQR

SEQ ID NO: 61910 - protein, 22 aa, synthetic construct
  source 1..22: note = Seed: CVKLQTVHSIPLTINKEEALQR, Core: PLTINKEEA
  VARIANT 11: note = C, F, I, L, M, P, V, W, or Y
  VARIANT 14: note = A, C, E, F, I, L, M, Q, T, V, W, or Y
  VARIANT 16: note = A, C, D, E, G, I, K, M, N, P, S, T, or V
  VARIANT 19: note = A, C, D, E, F, G, H, I, L, M, N, Q, R, S, T, V, W, or Y
CVKLQTVHSIXLTXNXEEXLQR

SEQ ID NO: 61911 - protein, 23 aa, synthetic construct
  source 1..23: note = Seed: CVKLQTVHSIPLTINKEEALQRP, Core: INKEEALQR
  VARIANT 14: note = A, C, F, H, I, L, M, R, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
CVKLQTVHSIPLTXNKXEXLQXP

SEQ ID NO: 61912 - protein, 23 aa, synthetic construct
  source 1..23: note = Seed: CVKLQTVHSIPLTINKEEALQRP, Core: LTINKEEAL
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
CVKLQTVHSIPXTIXKXEAXQRP

SEQ ID NO: 61913 - protein, 24 aa, synthetic construct
  source 1..24: note = Seed: CVKLQTVHSIPLTINKEEALQRPV, Core: INKEEALQR
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
CVKLQTVHSIPLTXNKXEXLQXPV

SEQ ID NO: 61914 - protein, 24 aa, synthetic construct
  source 1..24: note = Seed: CVKLQTVHSIPLTINKEEALQRPV, Core: LTINKEEAL
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
CVKLQTVHSIPXTIXKXEAXQRPV

SEQ ID NO: 61915 - protein, 25 aa, synthetic construct
  source 1..25: note = Seed: CVKLQTVHSIPLTINKEEALQRPVA, Core: INKEEALQR
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
CVKLQTVHSIPLTXNKXEXLQXPVA

SEQ ID NO: 61916 - protein, 25 aa, synthetic construct
  source 1..25: note = Seed: CVKLQTVHSIPLTINKEEALQRPVA, Core: LTINKEEAL
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
CVKLQTVHSIPXTIXKXEAXQRPVA

SEQ ID NO: 61917 - protein, 14 aa, synthetic construct
  source 1..14: note = Seed: HSIPLTINKEEALQ, Core: LTINKEEAL
  VARIANT 5: note = A, C, F, I, L, M, N, V, W, or Y
  VARIANT 8: note = A, C, D, E, F, G, H, I, K, L, M, N, Q, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQ

SEQ ID NO: 61918 - protein, 15 aa, synthetic construct
  source 1..15: note = Seed: HSIPLTINKEEALQR, Core: INKEEALQR
  VARIANT 7: note = F, I, L, M, V, W, or Y
  VARIANT 10: note = C, D, E, N, or S
  VARIANT 12: note = A, C, D, E, G, H, I, K, L, M, N, P, Q, R, S, T, or V
  VARIANT 15: note = A, C, D, E, F, G, H, I, K, L, M, N, P, Q, R, S, T, V, W, or Y
HSIPLTXNKXEXLQX

SEQ ID NO: 61919 - protein, 15 aa, synthetic construct
  source 1..15: note = Seed: HSIPLTINKEEALQR, Core: LTINKEEAL
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQR

SEQ ID NO: 61920 - protein, 16 aa, synthetic construct
  source 1..16: note = Seed: HSIPLTINKEEALQRP, Core: INKEEALQR
  VARIANT 7: note = F, I, L, M, V, W, or Y
  VARIANT 10: note = A, C, D, E, F, I, L, M, N, Q, S, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSIPLTXNKXEXLQXP

SEQ ID NO: 61921 - protein, 16 aa, synthetic construct
  source 1..16: note = Seed: HSIPLTINKEEALQRP, Core: LTINKEEAL
  VARIANT 5: note = A, C, F, G, H, I, K, L, M, N, P, Q, R, T, V, W, or Y
  VARIANT 8: note = A, C, D, E, F, G, H, I, K, L, M, N, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQRP

SEQ ID NO: 61922 - protein, 17 aa, synthetic construct
  source 1..17: note = Seed: HSIPLTINKEEALQRPV, Core: INKEEALQR
  VARIANT 7: note = A, C, F, I, L, M, T, V, W, or Y
  VARIANT 10: note = A, C, D, E, F, G, H, I, L, M, N, Q, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSIPLTXNKXEXLQXPV

SEQ ID NO: 61923 - protein, 17 aa, synthetic construct
  source 1..17: note = Seed: HSIPLTINKEEALQRPV, Core: LTINKEEAL
  VARIANT 5: note = A, C, F, H, I, K, L, M, N, Q, T, V, W, or Y
  VARIANT 8: note = A, C, D, E, F, G, H, I, K, L, M, N, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQRPV

SEQ ID NO: 61924 - protein, 19 aa, synthetic construct
  source 1..19: note = Seed: HSIPLTINKEEALQRPVAS, Core: INKEEALQR
  VARIANT 7: note = A, C, F, I, L, M, V, W, or Y
  VARIANT 10: note = A, C, D, E, F, G, H, I, L, M, N, Q, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSIPLTXNKXEXLQXPVAS

SEQ ID NO: 61925 - protein, 19 aa, synthetic construct
  source 1..19: note = Seed: HSIPLTINKEEALQRPVAS, Core: LTINKEEAL
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQRPVAS

SEQ ID NO: 61926 - protein, 20 aa, synthetic construct
  source 1..20: note = Seed: HSIPLTINKEEALQRPVASD, Core: INKEEALQR
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSIPLTXNKXEXLQXPVASD

SEQ ID NO: 61927 - protein, 20 aa, synthetic construct
  source 1..20: note = Seed: HSIPLTINKEEALQRPVASD, Core: LTINKEEAL
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQRPVASD

SEQ ID NO: 61928 - protein, 21 aa, synthetic construct
  source 1..21: note = Seed: HSIPLTINKEEALQRPVASDF, Core: INKEEALQR
  VARIANT 7: note = A, C, D, F, G, H, I, K, L, M, N, P, Q, S, T, V, W, or Y
  VARIANT 10: note = A, C, D, E, F, G, H, I, K, L, M, N, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSIPLTXNKXEXLQXPVASDF

SEQ ID NO: 61929 - protein, 21 aa, synthetic construct
  source 1..21: note = Seed: HSIPLTINKEEALQRPVASDF, Core: LTINKEEAL
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQRPVASDF

SEQ ID NO: 61930 - protein, 22 aa, synthetic construct
  source 1..22: note = Seed: HSIPLTINKEEALQRPVASDFE, Core: INKEEALQR
  VARIANT 7: note = A, C, D, F, G, H, I, K, L, M, N, P, Q, S, T, V, W, or Y
  VARIANT 10: note = A, C, D, E, F, G, H, I, K, L, M, N, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSIPLTXNKXEXLQXPVASDFE

SEQ ID NO: 61931 - protein, 22 aa, synthetic construct
  source 1..22: note = Seed: HSIPLTINKEEALQRPVASDFE, Core: LTINKEEAL
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQRPVASDFE

SEQ ID NO: 61932 - protein, 23 aa, synthetic construct
  source 1..23: note = Seed: HSIPLTINKEEALQRPVASDFEP, Core: INKEEALQR
  VARIANT 7: note = A, C, D, F, G, H, I, K, L, M, N, P, Q, S, T, V, W, or Y
  VARIANT 10: note = A, C, D, E, F, G, H, I, K, L, M, N, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSIPLTXNKXEXLQXPVASDFEP

SEQ ID NO: 61933 - protein, 23 aa, synthetic construct
  source 1..23: note = Seed: HSIPLTINKEEALQRPVASDFEP, Core: LTINKEEAL
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQRPVASDFEP

SEQ ID NO: 61934 - protein, 24 aa, synthetic construct
  source 1..24: note = Seed: HSIPLTINKEEALQRPVASDFEPQ, Core: INKEEALQR
  VARIANT 7: note = A, C, D, F, G, H, I, K, L, M, N, P, Q, S, T, V, W, or Y
  VARIANT 10: note = A, C, D, E, F, G, H, I, K, L, M, N, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSIPLTXNKXEXLQXPVASDFEPQ

SEQ ID NO: 61935 - protein, 24 aa, synthetic construct
  source 1..24: note = Seed: HSIPLTINKEEALQRPVASDFEPQ, Core: LTINKEEAL
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQRPVASDFEPQ

SEQ ID NO: 61936 - protein, 25 aa, synthetic construct
  source 1..25: note = Seed: HSIPLTINKEEALQRPVASDFEPQG, Core: INKEEALQR
  VARIANT 7: note = A, C, D, F, G, H, I, K, L, M, N, P, Q, S, T, V, W, or Y
  VARIANT 10: note = A, C, D, E, F, G, H, I, K, L, M, N, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
HSIPLTXNKXEXLQXPVASDFEPQG

SEQ ID NO: 61937 - protein, 25 aa, synthetic construct
  source 1..25: note = Seed: HSIPLTINKEEALQRPVASDFEPQG, Core: LTINKEEAL
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
HSIPXTIXKXEAXQRPVASDFEPQG

SEQ ID NO: 61938 - protein, 13 aa, synthetic construct
  source 1..13: note = Seed: IPLTINKEEALQR, Core: LTINKEEAL
  VARIANT 3: note = C, F, I, L, M, V, W, or Y
  VARIANT 6: note = A, C, D, E, F, G, H, I, K, L, M, N, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
IPXTIXKXEAXQR

SEQ ID NO: 61939 - protein, 14 aa, synthetic construct
  source 1..14: note = Seed: IPLTINKEEALQRP, Core: INKEEALQR
  VARIANT 5: note = C, F, I, L, M, V, W, or Y
  VARIANT 8: note = A, D, E, N, S, or T
  VARIANT 10: note = A, C, D, E, F, G, H, I, K, L, M, N, P, Q, R, S, T, V, or Y
  VARIANT 13: note = A, C, D, E, F, G, H, I, K, L, M, N, P, Q, R, S, T, V, W, or Y
IPLTXNKXEXLQXP

SEQ ID NO: 61940 - protein, 14 aa, synthetic construct
  source 1..14: note = Seed: IPLTINKEEALQRP, Core: LTINKEEAL
  VARIANT 3: note = A, C, F, I, L, M, T, V, W, or Y
  VARIANT 6: note = A, C, D, E, F, G, H, I, K, L, M, N, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
IPXTIXKXEAXQRP

SEQ ID NO: 61941 - protein, 15 aa, synthetic construct
  source 1..15: note = Seed: IPLTINKEEALQRPV, Core: INKEEALQR
  VARIANT 5: note = A, C, D, E, F, G, H, I, K, L, M, N, P, Q, R, S, T, V, W, or Y
  VARIANT 8: note = A, C, D, E, F, G, H, I, K, L, M, N, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
IPLTXNKXEXLQXPV

SEQ ID NO: 61942 - protein, 15 aa, synthetic construct
  source 1..15: note = Seed: IPLTINKEEALQRPV, Core: LTINKEEAL
  VARIANT 3: note = A, C, F, I, K, L, M, Q, T, V, W, or Y
  VARIANT 6: note = A, C, D, E, F, G, H, I, K, L, M, N, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
IPXTIXKXEAXQRPV

SEQ ID NO: 61943 - protein, 16 aa, synthetic construct
  source 1..16: note = Seed: IPLTINKEEALQRPVA, Core: INKEEALQR
  VARIANT 5: note = A, C, F, G, H, I, L, M, P, S, T, V, W, or Y
  VARIANT 8: note = A, C, D, E, F, G, H, I, K, L, M, N, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
IPLTXNKXEXLQXPVA

SEQ ID NO: 61944 - protein, 16 aa, synthetic construct
  source 1..16: note = Seed: IPLTINKEEALQRPVA, Core: LTINKEEAL
  VARIANT 3: note = C, F, I, L, M, V, W, or Y
  VARIANT 6: note = A, C, D, E, F, G, H, I, K, L, M, N, Q, R, S, T, V, W, or Y
  VARIANT 8: note = A, C, D, E, F, G, H, I, K, L, M, N, P, Q, R, S, T, V, or Y
  VARIANT 11: note = A, C, D, E, F, G, H, I, K, L, M, N, P, Q, R, S, T, V, W, or Y
IPXTIXKXEAXQRPVA

SEQ ID NO: 61945 - protein, 17 aa, synthetic construct
  source 1..17: note = Seed: IPLTINKEEALQRPVAS, Core: INKEEALQR
  VARIANT 5: note = A, C, F, H, I, L, M, Q, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
IPLTXNKXEXLQXPVAS

SEQ ID NO: 61946 - protein, 17 aa, synthetic construct
  source 1..17: note = Seed: IPLTINKEEALQRPVAS, Core: LTINKEEAL
  VARIANT 3: note = C, F, I, L, M, V, W, or Y
  VARIANT 6: note = A, C, D, E, F, G, H, I, K, L, M, N, Q, R, S, T, V, W, or Y
  VARIANT 8: note = A, C, D, E, F, G, H, I, K, L, M, N, P, Q, R, S, T, V, or Y
  VARIANT 11: note = A, C, D, E, F, G, H, I, K, L, M, N, P, Q, R, S, T, V, W, or Y
IPXTIXKXEAXQRPVAS

SEQ ID NO: 61947 - protein, 19 aa, synthetic construct
  source 1..19: note = Seed: IPLTINKEEALQRPVASDF, Core: INKEEALQR
  VARIANT 5: note = C, F, I, L, M, V, W, or Y
  VARIANT 8: note = A, C, D, E, F, G, H, I, K, L, M, N, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
IPLTXNKXEXLQXPVASDF

SEQ ID NO: 61948 - protein, 19 aa, synthetic construct
  source 1..19: note = Seed: IPLTINKEEALQRPVASDF, Core: LTINKEEAL
  VARIANT 3: note = C, F, I, L, M, V, W, or Y
  VARIANT 6: note = A, C, D, E, F, G, H, I, K, L, M, N, Q, R, S, T, V, W, or Y
  VARIANT 8: note = A, C, D, E, G, H, I, K, L, M, N, P, Q, R, S, T, or V
  VARIANT 11: note = A, C, D, E, F, G, H, I, K, L, M, N, P, Q, R, S, T, V, W, or Y
IPXTIXKXEAXQRPVASDF

SEQ ID NO: 61949 - protein, 20 aa, synthetic construct
  source 1..20: note = Seed: IPLTINKEEALQRPVASDFE, Core: INKEEALQR
  VARIANT 5: note = A, C, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
IPLTXNKXEXLQXPVASDFE

SEQ ID NO: 61950 - protein, 20 aa, synthetic construct
  source 1..20: note = Seed: IPLTINKEEALQRPVASDFE, Core: LTINKEEAL
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
IPXTIXKXEAXQRPVASDFE

SEQ ID NO: 61951 - protein, 21 aa, synthetic construct
  source 1..21: note = Seed: IPLTINKEEALQRPVASDFEP, Core: INKEEALQR
  VARIANT 5: note = A, C, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
IPLTXNKXEXLQXPVASDFEP

SEQ ID NO: 61952 - protein, 21 aa, synthetic construct
  source 1..21: note = Seed: IPLTINKEEALQRPVASDFEP, Core: LTINKEEAL
  VARIANT 3: note = A, C, F, I, L, M, V, W, or Y
  VARIANT 6: note = A, C, D, E, F, G, H, I, K, L, M, N, Q, R, S, T, V, W, or Y
  VARIANT 8: note = A, C, D, E, G, H, I, K, L, M, N, P, Q, R, S, T, or V
  VARIANT 11: note = A, C, D, E, F, G, H, I, K, L, M, N, P, Q, R, S, T, V, W, or Y
IPXTIXKXEAXQRPVASDFEP

SEQ ID NO: 61953 - protein, 22 aa, synthetic construct
  source 1..22: note = Seed: IPLTINKEEALQRPVASDFEPQ, Core: INKEEALQR
  VARIANT 5: note = A, C, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
IPLTXNKXEXLQXPVASDFEPQ

SEQ ID NO: 61954 - protein, 22 aa, synthetic construct
  source 1..22: note = Seed: IPLTINKEEALQRPVASDFEPQ, Core: LTINKEEAL
  VARIANT 3: note = A, C, E, F, H, I, K, L, M, P, Q, R, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
IPXTIXKXEAXQRPVASDFEPQ

SEQ ID NO: 61955 - protein, 23 aa, synthetic construct
  source 1..23: note = Seed: IPLTINKEEALQRPVASDFEPQG, Core: INKEEALQR
  VARIANT 5: note = A, C, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
IPLTXNKXEXLQXPVASDFEPQG

SEQ ID NO: 61956 - protein, 23 aa, synthetic construct
  source 1..23: note = Seed: IPLTINKEEALQRPVASDFEPQG, Core: LTINKEEAL
  VARIANT 3: note = A, C, E, F, H, I, K, L, M, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
IPXTIXKXEAXQRPVASDFEPQG

SEQ ID NO: 61957 - protein, 24 aa, synthetic construct
  source 1..24: note = Seed: IPLTINKEEALQRPVASDFEPQGL, Core: INKEEALQR
  VARIANT 5: note = A, C, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
IPLTXNKXEXLQXPVASDFEPQGL

SEQ ID NO: 61958 - protein, 24 aa, synthetic construct
  source 1..24: note = Seed: IPLTINKEEALQRPVASDFEPQGL, Core: LTINKEEAL
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
IPXTIXKXEAXQRPVASDFEPQGL

SEQ ID NO: 61959 - protein, 25 aa, synthetic construct
  source 1..25: note = Seed: IPLTINKEEALQRPVASDFEPQGLS, Core: INKEEALQR
  VARIANT 5: note = A, C, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
IPLTXNKXEXLQXPVASDFEPQGLS

SEQ ID NO: 61960 - protein, 25 aa, synthetic construct
  source 1..25: note = Seed: IPLTINKEEALQRPVASDFEPQGLS, Core: LTINKEEAL
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
IPXTIXKXEAXQRPVASDFEPQGLS

SEQ ID NO: 61961 - protein, 18 aa, synthetic construct
  source 1..18: note = Seed: KLQTVHSIPLTINKEEAL, Core: LTINKEEAL
  VARIANT 10: note = F, I, L, M, V, W, or Y
  VARIANT 13: note = A, C, D, E, F, G, H, I, K, L, M, N, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
KLQTVHSIPXTIXKXEAX

SEQ ID NO: 61962 - protein, 19 aa, synthetic construct
  source 1..19: note = Seed: KLQTVHSIPLTINKEEALQ, Core: LTINKEEAL
  VARIANT 10: note = A, C, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
KLQTVHSIPXTIXKXEAXQ

SEQ ID NO: 61963 - protein, 20 aa, synthetic construct
  source 1..20: note = Seed: KLQTVHSIPLTINKEEALQR, Core: LTINKEEAL
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
KLQTVHSIPXTIXKXEAXQR

SEQ ID NO: 61964 - protein, 20 aa, synthetic construct
  source 1..20: note = Seed: KLQTVHSIPLTINKEEALQR, Core: PLTINKEEA
  VARIANT 9: note = C, F, I, L, M, P, V, W, or Y
  VARIANT 12: note = A, C, E, F, I, L, M, Q, S, T, V, W, or Y
  VARIANT 14: note = A, C, D, E, G, I, K, L, N, P, Q, S, T, or V
  VARIANT 17: note = A, C, D, E, F, G, H, I, L, M, N, Q, R, S, T, V, W, or Y
KLQTVHSIXLTXNXEEXLQR

SEQ ID NO: 61965 - protein, 21 aa, synthetic construct
  source 1..21: note = Seed: KLQTVHSIPLTINKEEALQRP, Core: INKEEALQR
  VARIANT 12: note = A, C, F, H, I, K, L, M, R, V, W, or Y
  VARIANT 15: note = A, C, D, E, G, H, I, K, L, M, N, P, Q, R, S, T, V, or W
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
KLQTVHSIPLTXNKXEXLQXP

SEQ ID NO: 61966 - protein, 21 aa, synthetic construct
  source 1..21: note = Seed: KLQTVHSIPLTINKEEALQRP, Core: LTINKEEAL
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
KLQTVHSIPXTIXKXEAXQRP

SEQ ID NO: 61967 - protein, 22 aa, synthetic construct
  source 1..22: note = Seed: KLQTVHSIPLTINKEEALQRPV, Core: INKEEALQR
  VARIANT 12: note = A, C, E, F, H, I, K, L, M, N, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
KLQTVHSIPLTXNKXEXLQXPV

SEQ ID NO: 61968 - protein, 22 aa, synthetic construct
  source 1..22: note = Seed: KLQTVHSIPLTINKEEALQRPV, Core: LTINKEEAL
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
KLQTVHSIPXTIXKXEAXQRPV

SEQ ID NO: 61969 - protein, 23 aa, synthetic construct
  source 1..23: note = Seed: KLQTVHSIPLTINKEEALQRPVA, Core: INKEEALQR
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
KLQTVHSIPLTXNKXEXLQXPVA

SEQ ID NO: 61970 - protein, 23 aa, synthetic construct
  source 1..23: note = Seed: KLQTVHSIPLTINKEEALQRPVA, Core: LTINKEEAL
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
KLQTVHSIPXTIXKXEAXQRPVA

SEQ ID NO: 61971 - protein, 24 aa, synthetic construct
  source 1..24: note = Seed: KLQTVHSIPLTINKEEALQRPVAS, Core: INKEEALQR
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
KLQTVHSIPLTXNKXEXLQXPVAS

SEQ ID NO: 61972 - protein, 24 aa, synthetic construct
  source 1..24: note = Seed: KLQTVHSIPLTINKEEALQRPVAS, Core: LTINKEEAL
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
KLQTVHSIPXTIXKXEAXQRPVAS

SEQ ID NO: 61973 - protein, 25 aa, synthetic construct
  source 1..25: note = Seed: KLQTVHSIPLTINKEEALQRPVASD, Core: INKEEALQR
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
KLQTVHSIPLTXNKXEXLQXPVASD

SEQ ID NO: 61974 - protein, 25 aa, synthetic construct
  source 1..25: note = Seed: KLQTVHSIPLTINKEEALQRPVASD, Core: LTINKEEAL
  VARIANT 10: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
KLQTVHSIPXTIXKXEAXQRPVASD

SEQ ID NO: 61975 - protein, 17 aa, synthetic construct
  source 1..17: note = Seed: LQTVHSIPLTINKEEAL, Core: LTINKEEAL
  VARIANT 9: note = A, C, F, I, L, M, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
LQTVHSIPXTIXKXEAX

SEQ ID NO: 61976 - protein, 19 aa, synthetic construct
  source 1..19: note = Seed: LQTVHSIPLTINKEEALQR, Core: LTINKEEAL
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
LQTVHSIPXTIXKXEAXQR

SEQ ID NO: 61977 - protein, 20 aa, synthetic construct
  source 1..20: note = Seed: LQTVHSIPLTINKEEALQRP, Core: INKEEALQR
  VARIANT 11: note = A, C, E, F, H, I, K, L, M, Q, R, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LQTVHSIPLTXNKXEXLQXP

SEQ ID NO: 61978 - protein, 20 aa, synthetic construct
  source 1..20: note = Seed: LQTVHSIPLTINKEEALQRP, Core: LTINKEEAL
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
LQTVHSIPXTIXKXEAXQRP

SEQ ID NO: 61979 - protein, 21 aa, synthetic construct
  source 1..21: note = Seed: LQTVHSIPLTINKEEALQRPV, Core: INKEEALQR
  VARIANT 11: note = A, C, F, I, L, M, Q, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LQTVHSIPLTXNKXEXLQXPV

SEQ ID NO: 61980 - protein, 21 aa, synthetic construct
  source 1..21: note = Seed: LQTVHSIPLTINKEEALQRPV, Core: LTINKEEAL
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
LQTVHSIPXTIXKXEAXQRPV

SEQ ID NO: 61981 - protein, 22 aa, synthetic construct
  source 1..22: note = Seed: LQTVHSIPLTINKEEALQRPVA, Core: INKEEALQR
  VARIANT 11: note = A, C, D, E, F, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LQTVHSIPLTXNKXEXLQXPVA

SEQ ID NO: 61982 - protein, 22 aa, synthetic construct
  source 1..22: note = Seed: LQTVHSIPLTINKEEALQRPVA, Core: LTINKEEAL
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
LQTVHSIPXTIXKXEAXQRPVA

SEQ ID NO: 61983 - protein, 23 aa, synthetic construct
  source 1..23: note = Seed: LQTVHSIPLTINKEEALQRPVAS, Core: INKEEALQR
  VARIANT 11: note = A, C, D, E, F, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LQTVHSIPLTXNKXEXLQXPVAS

SEQ ID NO: 61984 - protein, 23 aa, synthetic construct
  source 1..23: note = Seed: LQTVHSIPLTINKEEALQRPVAS, Core: LTINKEEAL
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
LQTVHSIPXTIXKXEAXQRPVAS

SEQ ID NO: 61985 - protein, 24 aa, synthetic construct
  source 1..24: note = Seed: LQTVHSIPLTINKEEALQRPVASD, Core: INKEEALQR
  VARIANT 11: note = A, C, D, E, F, G, H, I, K, L, M, N, P, Q, R, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LQTVHSIPLTXNKXEXLQXPVASD

SEQ ID NO: 61986 - protein, 24 aa, synthetic construct
  source 1..24: note = Seed: LQTVHSIPLTINKEEALQRPVASD, Core: LTINKEEAL
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
LQTVHSIPXTIXKXEAXQRPVASD

SEQ ID NO: 61987 - protein, 25 aa, synthetic construct
  source 1..25: note = Seed: LQTVHSIPLTINKEEALQRPVASDF, Core: INKEEALQR
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
LQTVHSIPLTXNKXEXLQXPVASDF

SEQ ID NO: 61988 - protein, 25 aa, synthetic construct
  source 1..25: note = Seed: LQTVHSIPLTINKEEALQRPVASDF, Core: LTINKEEAL
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
LQTVHSIPXTIXKXEAXQRPVASDF

SEQ ID NO: 61989 - protein, 14 aa, synthetic construct
  source 1..14: note = Seed: LTINKEEALQRPVA, Core: INKEEALQR
  VARIANT 3: note = C, F, I, L, M, V, W, or Y
  VARIANT 6: note = A, D, E, N, or S
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
LTXNKXEXLQXPVA

SEQ ID NO: 61990 - protein, 15 aa, synthetic construct
  source 1..15: note = Seed: LTINKEEALQRPVAS, Core: INKEEALQR
  VARIANT 3: note = A, C, D, E, F, G, H, I, K, L, M, N, P, Q, R, S, T, V, W, or Y
  VARIANT 6: note = A, C, D, E, F, G, H, I, K, L, M, N, P, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
LTXNKXEXLQXPVAS

SEQ ID NO: 61991 - protein, 16 aa, synthetic construct
  source 1..16: note = Seed: LTINKEEALQRPVASD, Core: INKEEALQR
  VARIANT 3: note = C, F, I, L, M, V, W, or Y
  VARIANT 6: note = A, C, D, E, F, G, H, I, K, L, M, N, Q, R, S, T, V, or W
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
LTXNKXEXLQXPVASD

SEQ ID NO: 61992 - protein, 17 aa, synthetic construct
  source 1..17: note = Seed: LTINKEEALQRPVASDF, Core: INKEEALQR
  VARIANT 3: note = C, F, I, L, M, V, W, or Y
  VARIANT 6: note = A, C, D, E, F, G, H, I, K, L, M, N, Q, R, S, T, V, W, or Y
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
LTXNKXEXLQXPVASDF

SEQ ID NO: 61993 - protein, 20 aa, synthetic construct
  source 1..20: note = Seed: LTINKEEALQRPVASDFEPQ, Core: EALQRPVAS
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
LTINKEXALXRXVAXDFEPQ

SEQ ID NO: 61994 - protein, 20 aa, synthetic construct
  source 1..20: note = Seed: LTINKEEALQRPVASDFEPQ, Core: INKEEALQR
  VARIANT 3: note = F, I, L, M, V, W, or Y
  VARIANT 6: note = A, C, D, E, F, G, H, I, K, L, M, N, Q, R, S, T, or V
  VARIANT 8: note = A, C, D, E, G, H, I, K, L, M, N, P, Q, R, S, T, V, W, or Y
  VARIANT 11: note = A, C, D, E, F, G, H, I, K, L, M, N, P, Q, R, S, T, V, W, or Y
LTXNKXEXLQXPVASDFEPQ

SEQ ID NO: 61995 - protein, 21 aa, synthetic construct
  source 1..21: note = Seed: LTINKEEALQRPVASDFEPQG, Core: INKEEALQR
  VARIANT 3: note = F, I, L, M, V, W, or Y
  VARIANT 6: note = D, E, N, or S
  VARIANT 8: note = A, C, D, E, G, H, I, K, L, M, N, P, Q, R, S, T, or V
  VARIANT 11: note = A, C, D, E, F, G, H, I, K, L, M, N, P, Q, R, S, T, V, W, or Y
LTXNKXEXLQXPVASDFEPQG

SEQ ID NO: 61996 - protein, 22 aa, synthetic construct
  source 1..22: note = Seed: LTINKEEALQRPVASDFEPQGL, Core: INKEEALQR
  VARIANT 3: note = F, I, L, M, V, W, or Y
  VARIANT 6: note = A, C, D, E, F, H, I, K, L, M, N, Q, S, T, or V
  VARIANT 8: note = A, C, D, E, G, H, I, K, L, M, N, P, Q, R, S, T, V, or W
  VARIANT 11: note = A, C, D, E, F, G, H, I, K, L, M, N, P, Q, R, S, T, V, W, or Y
LTXNKXEXLQXPVASDFEPQGL

SEQ ID NO: 61997 - protein, 23 aa, synthetic construct
  source 1..23: note = Seed: LTINKEEALQRPVASDFEPQGLS, Core: INKEEALQR
  VARIANT 3: note = F, I, L, M, V, W, or Y
  VARIANT 6: note = A, C, D, E, F, H, I, K, L, M, N, Q, S, T, or V
  VARIANT 8: note = A, C, D, E, G, H, I, K, L, M, N, P, Q, R, S, T, V, or W
  VARIANT 11: note = A, C, D, E, F, G, H, I, K, L, M, N, P, Q, R, S, T, V, W, or Y
LTXNKXEXLQXPVASDFEPQGLS

SEQ ID NO: 61998 - protein, 24 aa, synthetic construct
  source 1..24: note = Seed: LTINKEEALQRPVASDFEPQGLSE, Core: INKEEALQR
  VARIANT 3: note = F, I, L, M, or V
  VARIANT 6: note = A, D, E, F, H, I, L, M, N, Q, S, T, or V
  VARIANT 8: note = A, H, K, N, P, R, S, T, or V
  VARIANT 11: note = A, C, F, G, H, I, L, M, N, Q, R, S, T, V, or Y
LTXNKXEXLQXPVASDFEPQGLSE

SEQ ID NO: 61999 - protein, 25 aa, synthetic construct
  source 1..25: note = Seed: LTINKEEALQRPVASDFEPQGLSEA, Core: INKEEALQR
  VARIANT 3: note = F, I, L, or V
  VARIANT 6: note = A, D, E, F, H, I, L, M, N, Q, S, T, or V
  VARIANT 8: note = A, H, K, N, P, R, S, T, or V
  VARIANT 11: note = A, C, F, G, H, I, L, M, N, Q, R, S, T, V, or Y
LTXNKXEXLQXPVASDFEPQGLSEA

SEQ ID NO: 62000 - protein, 25 aa, synthetic construct
  source 1..25: note = Seed: LTNSCVKLQTVHSIPLTINKEEALQ, Core: LTINKEEAL
  VARIANT 16: note = A, C, D, E, F, G, H, I, L, M, N, P, Q, S, T, V, W, or Y
  VARIANT 19: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
  VARIANT 24: note = A, C, D, E, F, G, H, I, K, L, M, N, P, Q, R, S, T, V, W, or Y
LTNSCVKLQTVHSIPXTIXKXEAXQ

SEQ ID NO: 62001 - protein, 22 aa, synthetic construct
  source 1..22: note = Seed: NSCVKLQTVHSIPLTINKEEAL, Core: LTINKEEAL
  VARIANT 14: note = C, F, I, L, M, V, W, or Y
  VARIANT 17: note = A, C, D, E, F, H, I, K, L, M, N, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
NSCVKLQTVHSIPXTIXKXEAX

SEQ ID NO: 62002 - protein, 23 aa, synthetic construct
  source 1..23: note = Seed: NSCVKLQTVHSIPLTINKEEALQ, Core: LTINKEEAL
  VARIANT 14: note = A, C, D, E, F, G, H, I, L, M, N, P, Q, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
NSCVKLQTVHSIPXTIXKXEAXQ

SEQ ID NO: 62003 - protein, 24 aa, synthetic construct
  source 1..24: note = Seed: NSCVKLQTVHSIPLTINKEEALQR, Core: LTINKEEAL
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
NSCVKLQTVHSIPXTIXKXEAXQR

SEQ ID NO: 62004 - protein, 25 aa, synthetic construct
  source 1..25: note = Seed: NSCVKLQTVHSIPLTINKEEALQRP, Core: INKEEALQR
  VARIANT 16: note = A, C, F, H, I, L, M, V, W, or Y
  VARIANT 19: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
  VARIANT 24: note = A, C, D, E, F, G, H, I, K, L, M, N, P, Q, R, S, T, V, W, or Y
NSCVKLQTVHSIPLTXNKXEXLQXP

SEQ ID NO: 62005 - protein, 25 aa, synthetic construct
  source 1..25: note = Seed: NSCVKLQTVHSIPLTINKEEALQRP, Core: LTINKEEAL
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
NSCVKLQTVHSIPXTIXKXEAXQRP

SEQ ID NO: 62006 - protein, 14 aa, synthetic construct
  source 1..14: note = Seed: PLTINKEEALQRPV, Core: INKEEALQR
  VARIANT 4: note = C, F, I, L, M, V, W, or Y
  VARIANT 7: note = A, D, E, N, or S
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPV

SEQ ID NO: 62007 - protein, 15 aa, synthetic construct
  source 1..15: note = Seed: PLTINKEEALQRPVA, Core: INKEEALQR
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPVA

SEQ ID NO: 62008 - protein, 16 aa, synthetic construct
  source 1..16: note = Seed: PLTINKEEALQRPVAS, Core: INKEEALQR
  VARIANT 4: note = C, F, I, L, M, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPVAS

SEQ ID NO: 62009 - protein, 17 aa, synthetic construct
  source 1..17: note = Seed: PLTINKEEALQRPVASD, Core: INKEEALQR
  VARIANT 4: note = A, C, F, I, L, M, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPVASD

SEQ ID NO: 62010 - protein, 19 aa, synthetic construct
  source 1..19: note = Seed: PLTINKEEALQRPVASDFE, Core: INKEEALQR
  VARIANT 4: note = F, I, L, M, V, W, or Y
  VARIANT 7: note = A, C, D, E, F, G, H, I, K, L, M, N, Q, R, S, T, V, or W
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPVASDFE

SEQ ID NO: 62011 - protein, 20 aa, synthetic construct
  source 1..20: note = Seed: PLTINKEEALQRPVASDFEP, Core: INKEEALQR
  VARIANT 4: note = A, C, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPVASDFEP

SEQ ID NO: 62012 - protein, 20 aa, synthetic construct
  source 1..20: note = Seed: PLTINKEEALQRPVASDFEP, Core: LTINKEEAL
  VARIANT 2: note = A, C, D, E, F, G, H, I, K, L, M, N, P, Q, R, S, T, V, W, or Y
  VARIANT 5: note = A, C, D, E, F, G, H, I, K, L, M, N, Q, R, S, T, V, W, or Y
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
PXTIXKXEAXQRPVASDFEP

SEQ ID NO: 62013 - protein, 21 aa, synthetic construct
  source 1..21: note = Seed: PLTINKEEALQRPVASDFEPQ, Core: INKEEALQR
  VARIANT 4: note = C, F, I, L, M, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPVASDFEPQ

SEQ ID NO: 62014 - protein, 22 aa, synthetic construct
  source 1..22: note = Seed: PLTINKEEALQRPVASDFEPQG, Core: INKEEALQR
  VARIANT 4: note = C, F, I, L, M, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPVASDFEPQG

SEQ ID NO: 62015 - protein, 23 aa, synthetic construct
  source 1..23: note = Seed: PLTINKEEALQRPVASDFEPQGL, Core: INKEEALQR
  VARIANT 4: note = C, F, I, L, M, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPVASDFEPQGL

SEQ ID NO: 62016 - protein, 24 aa, synthetic construct
  source 1..24: note = Seed: PLTINKEEALQRPVASDFEPQGLS, Core: INKEEALQR
  VARIANT 4: note = C, F, I, L, M, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPVASDFEPQGLS

SEQ ID NO: 62017 - protein, 25 aa, synthetic construct
  source 1..25: note = Seed: PLTINKEEALQRPVASDFEPQGLSE, Core: INKEEALQR
  VARIANT 4: note = F, I, L, M, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
PLTXNKXEXLQXPVASDFEPQGLSE

SEQ ID NO: 62018 - protein, 16 aa, synthetic construct
  source 1..16: note = Seed: QTVHSIPLTINKEEAL, Core: LTINKEEAL
  VARIANT 8: note = C, F, I, L, M, V, W, or Y
  VARIANT 11: note = A, C, D, E, F, G, H, I, K, L, M, N, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
QTVHSIPXTIXKXEAX

SEQ ID NO: 62019 - protein, 17 aa, synthetic construct
  source 1..17: note = Seed: QTVHSIPLTINKEEALQ, Core: LTINKEEAL
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
QTVHSIPXTIXKXEAXQ

SEQ ID NO: 62020 - protein, 19 aa, synthetic construct
  source 1..19: note = Seed: QTVHSIPLTINKEEALQRP, Core: LTINKEEAL
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
QTVHSIPXTIXKXEAXQRP

SEQ ID NO: 62021 - protein, 20 aa, synthetic construct
  source 1..20: note = Seed: QTVHSIPLTINKEEALQRPV, Core: INKEEALQR
  VARIANT 10: note = A, C, E, F, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
QTVHSIPLTXNKXEXLQXPV

SEQ ID NO: 62022 - protein, 20 aa, synthetic construct
  source 1..20: note = Seed: QTVHSIPLTINKEEALQRPV, Core: LTINKEEAL
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
QTVHSIPXTIXKXEAXQRPV

SEQ ID NO: 62023 - protein, 21 aa, synthetic construct
  source 1..21: note = Seed: QTVHSIPLTINKEEALQRPVA, Core: INKEEALQR
  VARIANT 10: note = A, C, E, F, H, I, K, L, M, P, Q, R, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
QTVHSIPLTXNKXEXLQXPVA

SEQ ID NO: 62024 - protein, 21 aa, synthetic construct
  source 1..21: note = Seed: QTVHSIPLTINKEEALQRPVA, Core: LTINKEEAL
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
QTVHSIPXTIXKXEAXQRPVA

SEQ ID NO: 62025 - protein, 22 aa, synthetic construct
  source 1..22: note = Seed: QTVHSIPLTINKEEALQRPVAS, Core: INKEEALQR
  VARIANT 10: note = A, C, D, E, F, H, I, K, L, M, N, P, Q, R, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
QTVHSIPLTXNKXEXLQXPVAS

SEQ ID NO: 62026 - protein, 22 aa, synthetic construct
  source 1..22: note = Seed: QTVHSIPLTINKEEALQRPVAS, Core: LTINKEEAL
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
QTVHSIPXTIXKXEAXQRPVAS

SEQ ID NO: 62027 - protein, 23 aa, synthetic construct
  source 1..23: note = Seed: QTVHSIPLTINKEEALQRPVASD, Core: INKEEALQR
  VARIANT 10: note = A, C, D, E, F, G, H, I, K, L, M, N, Q, R, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
QTVHSIPLTXNKXEXLQXPVASD

SEQ ID NO: 62028 - protein, 23 aa, synthetic construct
  source 1..23: note = Seed: QTVHSIPLTINKEEALQRPVASD, Core: LTINKEEAL
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
QTVHSIPXTIXKXEAXQRPVASD

SEQ ID NO: 62029 - protein, 24 aa, synthetic construct
  source 1..24: note = Seed: QTVHSIPLTINKEEALQRPVASDF, Core: INKEEALQR
  VARIANT 10: note = A, C, D, E, F, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
QTVHSIPLTXNKXEXLQXPVASDF

SEQ ID NO: 62030 - protein, 24 aa, synthetic construct
  source 1..24: note = Seed: QTVHSIPLTINKEEALQRPVASDF, Core: LTINKEEAL
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
QTVHSIPXTIXKXEAXQRPVASDF

SEQ ID NO: 62031 - protein, 25 aa, synthetic construct
  source 1..25: note = Seed: QTVHSIPLTINKEEALQRPVASDFE, Core: EALQRPVAS
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
  VARIANT 22: note = A, C, D, E, F, G, H, I, K, L, M, N, P, Q, R, S, T, V, W, or Y
QTVHSIPLTINKEXALXRXVAXDFE

SEQ ID NO: 62032 - protein, 25 aa, synthetic construct
  source 1..25: note = Seed: QTVHSIPLTINKEEALQRPVASDFE, Core: INKEEALQR
  VARIANT 10: note = A, C, E, F, H, I, K, L, M, P, Q, R, T, V, W, or Y
  VARIANT 13: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
QTVHSIPLTXNKXEXLQXPVASDFE

SEQ ID NO: 62033 - protein, 25 aa, synthetic construct
  source 1..25: note = Seed: QTVHSIPLTINKEEALQRPVASDFE, Core: LTINKEEAL
  VARIANT 8: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
QTVHSIPXTIXKXEAXQRPVASDFE

SEQ ID NO: 62034 - protein, 21 aa, synthetic construct
  source 1..21: note = Seed: SCVKLQTVHSIPLTINKEEAL, Core: LTINKEEAL
  VARIANT 13: note = C, F, I, L, M, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
SCVKLQTVHSIPXTIXKXEAX

SEQ ID NO: 62035 - protein, 22 aa, synthetic construct
  source 1..22: note = Seed: SCVKLQTVHSIPLTINKEEALQ, Core: LTINKEEAL
  VARIANT 13: note = A, C, D, E, F, G, H, I, K, L, M, N, P, Q, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
SCVKLQTVHSIPXTIXKXEAXQ

SEQ ID NO: 62036 - protein, 23 aa, synthetic construct
  source 1..23: note = Seed: SCVKLQTVHSIPLTINKEEALQR, Core: LTINKEEAL
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
SCVKLQTVHSIPXTIXKXEAXQR

SEQ ID NO: 62037 - protein, 24 aa, synthetic construct
  source 1..24: note = Seed: SCVKLQTVHSIPLTINKEEALQRP, Core: INKEEALQR
  VARIANT 15: note = A, C, F, H, I, L, M, V, W, or Y
  VARIANT 18: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
  VARIANT 23: note = A, C, D, E, F, G, H, I, K, L, M, N, P, Q, R, S, T, V, W, or Y
SCVKLQTVHSIPLTXNKXEXLQXP

SEQ ID NO: 62038 - protein, 24 aa, synthetic construct
  source 1..24: note = Seed: SCVKLQTVHSIPLTINKEEALQRP, Core: LTINKEEAL
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
SCVKLQTVHSIPXTIXKXEAXQRP

SEQ ID NO: 62039 - protein, 25 aa, synthetic construct
  source 1..25: note = Seed: SCVKLQTVHSIPLTINKEEALQRPV, Core: INKEEALQR
  VARIANT 15: note = A, C, E, F, G, H, I, L, M, N, P, Q, R, S, T, V, W, or Y
  VARIANT 18: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
  VARIANT 23: note = A, C, D, E, F, G, H, I, K, L, M, N, P, Q, R, S, T, V, W, or Y
SCVKLQTVHSIPLTXNKXEXLQXPV

SEQ ID NO: 62040 - protein, 25 aa, synthetic construct
  source 1..25: note = Seed: SCVKLQTVHSIPLTINKEEALQRPV, Core: LTINKEEAL
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
SCVKLQTVHSIPXTIXKXEAXQRPV

SEQ ID NO: 62041 - protein, 14 aa, synthetic construct
  source 1..14: note = Seed: SIPLTINKEEALQR, Core: LTINKEEAL
  VARIANT 4: note = A, C, F, H, I, K, L, M, N, Q, R, T, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
SIPXTIXKXEAXQR

SEQ ID NO: 62042 - protein, 15 aa, synthetic construct
  source 1..15: note = Seed: SIPLTINKEEALQRP, Core: INKEEALQR
  VARIANT 6: note = A, C, F, H, I, L, M, P, Q, T, V, W, or Y
  VARIANT 9: note = A, C, D, E, F, G, H, I, K, L, M, N, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SIPLTXNKXEXLQXP

SEQ ID NO: 62043 - protein, 15 aa, synthetic construct
  source 1..15: note = Seed: SIPLTINKEEALQRP, Core: LTINKEEAL
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
SIPXTIXKXEAXQRP

SEQ ID NO: 62044 - protein, 16 aa, synthetic construct
  source 1..16: note = Seed: SIPLTINKEEALQRPV, Core: INKEEALQR
  VARIANT 6: note = A, C, F, I, L, M, V, W, or Y
  VARIANT 9: note = A, C, D, E, F, G, I, L, M, N, Q, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SIPLTXNKXEXLQXPV

SEQ ID NO: 62045 - protein, 16 aa, synthetic construct
  source 1..16: note = Seed: SIPLTINKEEALQRPV, Core: LTINKEEAL
  VARIANT 4: note = A, C, F, H, I, K, L, M, N, P, Q, T, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
SIPXTIXKXEAXQRPV

SEQ ID NO: 62046 - protein, 17 aa, synthetic construct
  source 1..17: note = Seed: SIPLTINKEEALQRPVA, Core: INKEEALQR
  VARIANT 6: note = A, C, F, G, H, I, L, M, N, P, Q, S, T, V, W, or Y
  VARIANT 9: note = A, C, D, E, F, G, H, I, K, L, M, N, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SIPLTXNKXEXLQXPVA

SEQ ID NO: 62047 - protein, 17 aa, synthetic construct
  source 1..17: note = Seed: SIPLTINKEEALQRPVA, Core: LTINKEEAL
  VARIANT 4: note = A, C, F, I, L, M, T, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
SIPXTIXKXEAXQRPVA

SEQ ID NO: 62048 - protein, 19 aa, synthetic construct
  source 1..19: note = Seed: SIPLTINKEEALQRPVASD, Core: INKEEALQR
  VARIANT 6: note = C, F, I, L, M, V, W, or Y
  VARIANT 9: note = A, C, D, E, F, G, H, I, L, M, N, Q, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SIPLTXNKXEXLQXPVASD

SEQ ID NO: 62049 - protein, 19 aa, synthetic construct
  source 1..19: note = Seed: SIPLTINKEEALQRPVASD, Core: LTINKEEAL
  VARIANT 4: note = A, C, F, I, K, L, M, Q, T, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
SIPXTIXKXEAXQRPVASD

SEQ ID NO: 62050 - protein, 20 aa, synthetic construct
  source 1..20: note = Seed: SIPLTINKEEALQRPVASDF, Core: INKEEALQR
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SIPLTXNKXEXLQXPVASDF

SEQ ID NO: 62051 - protein, 20 aa, synthetic construct
  source 1..20: note = Seed: SIPLTINKEEALQRPVASDF, Core: LTINKEEAL
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
SIPXTIXKXEAXQRPVASDF

SEQ ID NO: 62052 - protein, 21 aa, synthetic construct
  source 1..21: note = Seed: SIPLTINKEEALQRPVASDFE, Core: INKEEALQR
  VARIANT 6: note = A, C, E, F, G, H, I, K, L, M, N, P, Q, S, T, V, W, or Y
  VARIANT 9: note = A, C, D, E, F, G, H, I, K, L, M, N, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SIPLTXNKXEXLQXPVASDFE

SEQ ID NO: 62053 - protein, 21 aa, synthetic construct
  source 1..21: note = Seed: SIPLTINKEEALQRPVASDFE, Core: LTINKEEAL
  VARIANT 4: note = A, C, F, H, I, K, L, M, N, P, Q, T, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
SIPXTIXKXEAXQRPVASDFE

SEQ ID NO: 62054 - protein, 22 aa, synthetic construct
  source 1..22: note = Seed: SIPLTINKEEALQRPVASDFEP, Core: INKEEALQR
  VARIANT 6: note = A, C, E, F, G, H, I, K, L, M, N, P, Q, S, T, V, W, or Y
  VARIANT 9: note = A, C, D, E, F, G, H, I, K, L, M, N, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SIPLTXNKXEXLQXPVASDFEP

SEQ ID NO: 62055 - protein, 22 aa, synthetic construct
  source 1..22: note = Seed: SIPLTINKEEALQRPVASDFEP, Core: LTINKEEAL
  VARIANT 4: note = A, C, F, H, I, K, L, M, N, P, Q, T, V, W, or Y
  VARIANT 7: note = A, C, D, E, F, G, H, I, K, L, M, N, Q, R, S, T, V, W, or Y
  VARIANT 9: note = A, C, D, E, F, G, H, I, K, L, M, N, P, Q, R, S, T, V, or Y
  VARIANT 12: note = A, C, D, E, F, G, H, I, K, L, M, N, P, Q, R, S, T, V, W, or Y
SIPXTIXKXEAXQRPVASDFEP

SEQ ID NO: 62056 - protein, 23 aa, synthetic construct
  source 1..23: note = Seed: SIPLTINKEEALQRPVASDFEPQ, Core: INKEEALQR
  VARIANT 6: note = A, C, E, F, G, H, I, K, L, M, N, P, Q, S, T, V, W, or Y
  VARIANT 9: note = A, C, D, E, F, G, H, I, K, L, M, N, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SIPLTXNKXEXLQXPVASDFEPQ

SEQ ID NO: 62057 - protein, 23 aa, synthetic construct
  source 1..23: note = Seed: SIPLTINKEEALQRPVASDFEPQ, Core: LTINKEEAL
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
SIPXTIXKXEAXQRPVASDFEPQ

SEQ ID NO: 62058 - protein, 24 aa, synthetic construct
  source 1..24: note = Seed: SIPLTINKEEALQRPVASDFEPQG, Core: INKEEALQR
  VARIANT 6: note = A, C, D, F, G, H, I, K, L, M, N, P, Q, S, T, V, W, or Y
  VARIANT 9: note = A, C, D, E, F, G, H, I, K, L, M, N, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SIPLTXNKXEXLQXPVASDFEPQG

SEQ ID NO: 62059 - protein, 24 aa, synthetic construct
  source 1..24: note = Seed: SIPLTINKEEALQRPVASDFEPQG, Core: LTINKEEAL
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
SIPXTIXKXEAXQRPVASDFEPQG

SEQ ID NO: 62060 - protein, 25 aa, synthetic construct
  source 1..25: note = Seed: SIPLTINKEEALQRPVASDFEPQGL, Core: INKEEALQR
  VARIANT 6: note = A, C, D, F, G, H, I, K, L, M, N, P, Q, S, T, V, W, or Y
  VARIANT 9: note = A, C, D, E, F, G, H, I, K, L, M, N, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
SIPLTXNKXEXLQXPVASDFEPQGL

SEQ ID NO: 62061 - protein, 25 aa, synthetic construct
  source 1..25: note = Seed: SIPLTINKEEALQRPVASDFEPQGL, Core: LTINKEEAL
  VARIANT 4: note = A, C, D, E, F, G, H, I, K, L, M, N, P, Q, R, S, T, V, W, or Y
  VARIANT 7: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
SIPXTIXKXEAXQRPVASDFEPQGL

SEQ ID NO: 62062 - protein, 15 aa, synthetic construct
  source 1..15: note = Seed: TINKEEALQRPVASD, Core: INKEEALQR
  VARIANT 2: note = A, C, F, I, L, M, T, V, W, or Y
  VARIANT 5: note = A, C, D, E, F, G, H, I, K, L, M, N, Q, R, S, T, V, W, or Y
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
TXNKXEXLQXPVASD

SEQ ID NO: 62063 - protein, 23 aa, synthetic construct
  source 1..23: note = Seed: TNSCVKLQTVHSIPLTINKEEAL, Core: LTINKEEAL
  VARIANT 15: note = C, F, I, L, M, V, W, or Y
  VARIANT 18: note = A, C, D, E, F, H, I, K, L, M, N, Q, R, S, T, V, W, or Y
  VARIANT 20: note = A, C, D, E, F, G, H, I, K, L, M, N, P, Q, R, S, T, V, W, or Y
  VARIANT 23: note = A, C, D, E, F, G, H, I, K, L, M, N, P, Q, R, S, T, V, W, or Y
TNSCVKLQTVHSIPXTIXKXEAX

SEQ ID NO: 62064 - protein, 24 aa, synthetic construct
  source 1..24: note = Seed: TNSCVKLQTVHSIPLTINKEEALQ, Core: LTINKEEAL
  VARIANT 15: note = A, C, D, E, F, G, H, I, L, M, N, P, Q, S, T, V, W, or Y
  VARIANT 18: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
  VARIANT 23: note = A, C, D, E, F, G, H, I, K, L, M, N, P, Q, R, S, T, V, W, or Y
TNSCVKLQTVHSIPXTIXKXEAXQ

SEQ ID NO: 62065 - protein, 25 aa, synthetic construct
  source 1..25: note = Seed: TNSCVKLQTVHSIPLTINKEEALQR, Core: LTINKEEAL
  VARIANT 15: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 20: note = A, C, D, E, F, G, H, I, K, L, M, N, P, Q, R, S, T, V, W, or Y
  VARIANT 23: note = A, C, D, E, F, G, H, I, K, L, M, N, P, Q, R, S, T, V, W, or Y
TNSCVKLQTVHSIPXTIXKXEAXQR

SEQ ID NO: 62066 - protein, 15 aa, synthetic construct
  source 1..15: note = Seed: TVHSIPLTINKEEAL, Core: LTINKEEAL
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
TVHSIPXTIXKXEAX

SEQ ID NO: 62067 - protein, 16 aa, synthetic construct
  source 1..16: note = Seed: TVHSIPLTINKEEALQ, Core: LTINKEEAL
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
TVHSIPXTIXKXEAXQ

SEQ ID NO: 62068 - protein, 17 aa, synthetic construct
  source 1..17: note = Seed: TVHSIPLTINKEEALQR, Core: LTINKEEAL
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
TVHSIPXTIXKXEAXQR

SEQ ID NO: 62069 - protein, 19 aa, synthetic construct
  source 1..19: note = Seed: TVHSIPLTINKEEALQRPV, Core: INKEEALQR
  VARIANT 9: note = C, E, F, H, I, K, L, M, Q, R, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
TVHSIPLTXNKXEXLQXPV

SEQ ID NO: 62070 - protein, 19 aa, synthetic construct
  source 1..19: note = Seed: TVHSIPLTINKEEALQRPV, Core: LTINKEEAL
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
TVHSIPXTIXKXEAXQRPV

SEQ ID NO: 62071 - protein, 20 aa, synthetic construct
  source 1..20: note = Seed: TVHSIPLTINKEEALQRPVA, Core: INKEEALQR
  VARIANT 9: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
TVHSIPLTXNKXEXLQXPVA

SEQ ID NO: 62072 - protein, 20 aa, synthetic construct
  source 1..20: note = Seed: TVHSIPLTINKEEALQRPVA, Core: LTINKEEAL
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
TVHSIPXTIXKXEAXQRPVA

SEQ ID NO: 62073 - protein, 21 aa, synthetic construct
  source 1..21: note = Seed: TVHSIPLTINKEEALQRPVAS, Core: INKEEALQR
  VARIANT 9: note = A, C, F, H, I, L, M, P, Q, T, V, W, or Y
  VARIANT 12: note = A, C, D, E, F, G, H, I, K, L, M, N, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
TVHSIPLTXNKXEXLQXPVAS

SEQ ID NO: 62074 - protein, 21 aa, synthetic construct
  source 1..21: note = Seed: TVHSIPLTINKEEALQRPVAS, Core: LTINKEEAL
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
TVHSIPXTIXKXEAXQRPVAS

SEQ ID NO: 62075 - protein, 22 aa, synthetic construct
  source 1..22: note = Seed: TVHSIPLTINKEEALQRPVASD, Core: INKEEALQR
  VARIANT 9: note = A, C, D, E, F, G, H, I, K, L, M, N, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
TVHSIPLTXNKXEXLQXPVASD

SEQ ID NO: 62076 - protein, 22 aa, synthetic construct
  source 1..22: note = Seed: TVHSIPLTINKEEALQRPVASD, Core: LTINKEEAL
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
TVHSIPXTIXKXEAXQRPVASD

SEQ ID NO: 62077 - protein, 23 aa, synthetic construct
  source 1..23: note = Seed: TVHSIPLTINKEEALQRPVASDF, Core: INKEEALQR
  VARIANT 9: note = A, C, D, E, F, H, I, K, L, M, N, Q, R, S, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
TVHSIPLTXNKXEXLQXPVASDF

SEQ ID NO: 62078 - protein, 23 aa, synthetic construct
  source 1..23: note = Seed: TVHSIPLTINKEEALQRPVASDF, Core: LTINKEEAL
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
TVHSIPXTIXKXEAXQRPVASDF

SEQ ID NO: 62079 - protein, 24 aa, synthetic construct
  source 1..24: note = Seed: TVHSIPLTINKEEALQRPVASDFE, Core: INKEEALQR
  VARIANT 9: note = A, C, E, F, H, I, K, L, M, Q, R, T, V, W, or Y
  VARIANT 12: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
TVHSIPLTXNKXEXLQXPVASDFE

SEQ ID NO: 62080 - protein, 24 aa, synthetic construct
  source 1..24: note = Seed: TVHSIPLTINKEEALQRPVASDFE, Core: LTINKEEAL
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
TVHSIPXTIXKXEAXQRPVASDFE

SEQ ID NO: 62081 - protein, 25 aa, synthetic construct
  source 1..25: note = Seed: TVHSIPLTINKEEALQRPVASDFEP, Core: INKEEALQR
  VARIANT 9: note = A, C, F, H, I, K, L, M, Q, R, T, V, W, or Y
  VARIANT 12: note = A, C, D, E, F, G, H, I, K, L, M, N, Q, R, S, T, V, W, or Y
  VARIANT 14: note = A, C, D, E, F, G, H, I, K, L, M, N, P, Q, R, S, T, V, W, or Y
  VARIANT 17: note = A, C, D, E, F, G, H, I, K, L, M, N, P, Q, R, S, T, V, W, or Y
TVHSIPLTXNKXEXLQXPVASDFEP

SEQ ID NO: 62082 - protein, 25 aa, synthetic construct
  source 1..25: note = Seed: TVHSIPLTINKEEALQRPVASDFEP, Core: LTINKEEAL
  VARIANT 7: note = A, C, D, E, F, G, H, I, K, L, M, N, P, Q, R, S, T, V, W, or Y
  VARIANT 10: note = A, C, D, E, F, G, H, I, K, L, M, N, P, Q, R, S, T, V, W, or Y
  VARIANT 12: note = A, C, D, E, F, G, H, I, K, L, M, N, P, Q, R, S, T, V, W, or Y
  VARIANT 15: note = A, C, D, E, F, G, H, I, K, L, M, N, P, Q, R, S, T, V, W, or Y
TVHSIPXTIXKXEAXQRPVASDFEP

SEQ ID NO: 62083 - protein, 15 aa, synthetic construct
  source 1..15: note = Seed: VHSIPLTINKEEALQ, Core: LTINKEEAL
  VARIANT 6: note = A, C, D, F, H, I, K, L, M, N, P, Q, R, S, T, V, W, or Y
  VARIANT 9: note = A, C, D, E, F, G, H, I, K, L, M, N, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
VHSIPXTIXKXEAXQ

SEQ ID NO: 62084 - protein, 16 aa, synthetic construct
  source 1..16: note = Seed: VHSIPLTINKEEALQR, Core: LTINKEEAL
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
VHSIPXTIXKXEAXQR

SEQ ID NO: 62085 - protein, 17 aa, synthetic construct
  source 1..17: note = Seed: VHSIPLTINKEEALQRP, Core: INKEEALQR
  VARIANT 8: note = F, I, L, M, V, W, or Y
  VARIANT 11: note = A, C, D, E, F, I, L, M, N, Q, S, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSIPLTXNKXEXLQXP

SEQ ID NO: 62086 - protein, 17 aa, synthetic construct
  source 1..17: note = Seed: VHSIPLTINKEEALQRP, Core: LTINKEEAL
  VARIANT 6: note = A, C, F, H, I, K, L, M, N, Q, R, T, V, W, or Y
  VARIANT 9: note = A, C, D, E, F, G, H, I, K, L, M, N, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
VHSIPXTIXKXEAXQRP

SEQ ID NO: 62087 - protein, 19 aa, synthetic construct
  source 1..19: note = Seed: VHSIPLTINKEEALQRPVA, Core: INKEEALQR
  VARIANT 8: note = A, C, F, I, L, M, V, W, or Y
  VARIANT 11: note = A, C, D, E, F, G, H, I, L, M, N, Q, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSIPLTXNKXEXLQXPVA

SEQ ID NO: 62088 - protein, 19 aa, synthetic construct
  source 1..19: note = Seed: VHSIPLTINKEEALQRPVA, Core: LTINKEEAL
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
VHSIPXTIXKXEAXQRPVA

SEQ ID NO: 62089 - protein, 20 aa, synthetic construct
  source 1..20: note = Seed: VHSIPLTINKEEALQRPVAS, Core: INKEEALQR
  VARIANT 8: note = A, C, D, E, F, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSIPLTXNKXEXLQXPVAS

SEQ ID NO: 62090 - protein, 20 aa, synthetic construct
  source 1..20: note = Seed: VHSIPLTINKEEALQRPVAS, Core: LTINKEEAL
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
VHSIPXTIXKXEAXQRPVAS

SEQ ID NO: 62091 - protein, 21 aa, synthetic construct
  source 1..21: note = Seed: VHSIPLTINKEEALQRPVASD, Core: INKEEALQR
  VARIANT 8: note = A, C, F, H, I, L, M, T, V, W, or Y
  VARIANT 11: note = A, C, D, E, F, G, H, I, K, L, M, N, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSIPLTXNKXEXLQXPVASD

SEQ ID NO: 62092 - protein, 21 aa, synthetic construct
  source 1..21: note = Seed: VHSIPLTINKEEALQRPVASD, Core: LTINKEEAL
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
VHSIPXTIXKXEAXQRPVASD

SEQ ID NO: 62093 - protein, 22 aa, synthetic construct
  source 1..22: note = Seed: VHSIPLTINKEEALQRPVASDF, Core: INKEEALQR
  VARIANT 8: note = A, C, F, H, I, L, M, T, V, W, or Y
  VARIANT 11: note = A, C, D, E, F, G, H, I, K, L, M, N, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSIPLTXNKXEXLQXPVASDF

SEQ ID NO: 62094 - protein, 22 aa, synthetic construct
  source 1..22: note = Seed: VHSIPLTINKEEALQRPVASDF, Core: LTINKEEAL
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
VHSIPXTIXKXEAXQRPVASDF

SEQ ID NO: 62095 - protein, 23 aa, synthetic construct
  source 1..23: note = Seed: VHSIPLTINKEEALQRPVASDFE, Core: INKEEALQR
  VARIANT 8: note = A, C, F, H, I, L, M, Q, R, T, V, W, or Y
  VARIANT 11: note = A, C, D, E, F, G, H, I, K, L, M, N, P, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSIPLTXNKXEXLQXPVASDFE

SEQ ID NO: 62096 - protein, 23 aa, synthetic construct
  source 1..23: note = Seed: VHSIPLTINKEEALQRPVASDFE, Core: LTINKEEAL
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
VHSIPXTIXKXEAXQRPVASDFE

SEQ ID NO: 62097 - protein, 24 aa, synthetic construct
  source 1..24: note = Seed: VHSIPLTINKEEALQRPVASDFEP, Core: INKEEALQR
  VARIANT 8: note = A, C, F, H, I, L, M, T, V, W, or Y
  VARIANT 11: note = A, C, D, E, F, G, H, I, K, L, M, N, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSIPLTXNKXEXLQXPVASDFEP

SEQ ID NO: 62098 - protein, 24 aa, synthetic construct
  source 1..24: note = Seed: VHSIPLTINKEEALQRPVASDFEP, Core: LTINKEEAL
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
VHSIPXTIXKXEAXQRPVASDFEP

SEQ ID NO: 62099 - protein, 25 aa, synthetic construct
  source 1..25: note = Seed: VHSIPLTINKEEALQRPVASDFEPQ, Core: INKEEALQR
  VARIANT 8: note = A, C, F, H, I, L, M, T, V, W, or Y
  VARIANT 11: note = A, C, D, E, F, G, H, I, K, L, M, N, Q, R, S, T, V, W, or Y
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
VHSIPLTXNKXEXLQXPVASDFEPQ

SEQ ID NO: 62100 - protein, 25 aa, synthetic construct
  source 1..25: note = Seed: VHSIPLTINKEEALQRPVASDFEPQ, Core: LTINKEEAL
  VARIANT 6: note = A, C, D, E, F, G, H, I, K, L, M, N, P, Q, R, S, T, V, W, or Y
  VARIANT 9: note = A, C, D, E, F, G, H, I, K, L, M, N, P, Q, R, S, T, V, W, or Y
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
VHSIPXTIXKXEAXQRPVASDFEPQ

SEQ ID NO: 62101 - protein, 19 aa, synthetic construct
  source 1..19: note = Seed: VKLQTVHSIPLTINKEEAL, Core: LTINKEEAL
  VARIANT 11: note = A, C, F, I, L, M, Q, T, V, W, or Y
  VARIANT 14: note = A, C, D, E, F, G, H, I, K, L, M, N, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
VKLQTVHSIPXTIXKXEAX

SEQ ID NO: 62102 - protein, 20 aa, synthetic construct
  source 1..20: note = Seed: VKLQTVHSIPLTINKEEALQ, Core: LTINKEEAL
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
VKLQTVHSIPXTIXKXEAXQ

SEQ ID NO: 62103 - protein, 21 aa, synthetic construct
  source 1..21: note = Seed: VKLQTVHSIPLTINKEEALQR, Core: LTINKEEAL
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
VKLQTVHSIPXTIXKXEAXQR

SEQ ID NO: 62104 - protein, 21 aa, synthetic construct
  source 1..21: note = Seed: VKLQTVHSIPLTINKEEALQR, Core: PLTINKEEA
  VARIANT 10: note = C, F, I, L, M, P, V, W, or Y
  VARIANT 13: note = A, C, E, F, I, L, M, Q, T, V, W, or Y
  VARIANT 15: note = A, C, D, E, G, I, K, M, N, P, S, T, or V
  VARIANT 18: note = A, C, D, E, F, G, H, I, L, M, N, Q, R, S, T, V, W, or Y
VKLQTVHSIXLTXNXEEXLQR

SEQ ID NO: 62105 - protein, 22 aa, synthetic construct
  source 1..22: note = Seed: VKLQTVHSIPLTINKEEALQRP, Core: INKEEALQR
  VARIANT 13: note = A, C, E, F, H, I, K, L, M, R, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
VKLQTVHSIPLTXNKXEXLQXP

SEQ ID NO: 62106 - protein, 22 aa, synthetic construct
  source 1..22: note = Seed: VKLQTVHSIPLTINKEEALQRP, Core: LTINKEEAL
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
VKLQTVHSIPXTIXKXEAXQRP

SEQ ID NO: 62107 - protein, 23 aa, synthetic construct
  source 1..23: note = Seed: VKLQTVHSIPLTINKEEALQRPV, Core: INKEEALQR
  VARIANT 13: note = A, C, D, E, F, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
VKLQTVHSIPLTXNKXEXLQXPV

SEQ ID NO: 62108 - protein, 23 aa, synthetic construct
  source 1..23: note = Seed: VKLQTVHSIPLTINKEEALQRPV, Core: LTINKEEAL
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
VKLQTVHSIPXTIXKXEAXQRPV

SEQ ID NO: 62109 - protein, 24 aa, synthetic construct
  source 1..24: note = Seed: VKLQTVHSIPLTINKEEALQRPVA, Core: INKEEALQR
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
VKLQTVHSIPLTXNKXEXLQXPVA

SEQ ID NO: 62110 - protein, 24 aa, synthetic construct
  source 1..24: note = Seed: VKLQTVHSIPLTINKEEALQRPVA, Core: LTINKEEAL
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
VKLQTVHSIPXTIXKXEAXQRPVA

SEQ ID NO: 62111 - protein, 25 aa, synthetic construct
  source 1..25: note = Seed: VKLQTVHSIPLTINKEEALQRPVAS, Core: INKEEALQR
  VARIANT 13: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 18: note = A, C, D, E, F, G, H, I, K, L, M, N, P, Q, R, S, T, V, W, or Y
  VARIANT 21: note = A, C, D, E, F, G, H, I, K, L, M, N, P, Q, R, S, T, V, W, or Y
VKLQTVHSIPLTXNKXEXLQXPVAS

SEQ ID NO: 62112 - protein, 25 aa, synthetic construct
  source 1..25: note = Seed: VKLQTVHSIPLTINKEEALQRPVAS, Core: LTINKEEAL
  VARIANT 11: note = A, C, D, E, F, G, H, I, K, L, M, N, P, Q, R, S, T, V, W, or Y
  VARIANT 14: note = A, C, D, E, F, G, H, I, K, L, M, N, P, Q, R, S, T, V, W, or Y
  VARIANT 16: note = A, C, D, E, F, G, H, I, K, L, M, N, P, Q, R, S, T, V, W, or Y
  VARIANT 19: note = A, C, D, E, F, G, H, I, K, L, M, N, P, Q, R, S, T, V, W, or Y
VKLQTVHSIPXTIXKXEAXQRPVAS

SEQ ID NO: 62113 - protein, 607 aa, synthetic construct
MRVTAPRTLILLLSGALALTETWAGSGGSGGGGSGGAMGFKQSSKGGSGGGGSGGGYKQSSKAMGGSGGGGSGGKQLQRPVASDYGGSGGGGSGGKTLQRPVASDWGGSGGGGSGGKYSSKALQRGGSGGGGSGGSAKALQRPMGGSGGGGSGGSAKALQRPYGGSGGGGSGGSTKALQRPLGGSGGGGSGGSTTGFKQSSKGGSGGGGSGGSTTGFKQSSRGGSGGGGSGGLNVIVHSATGIKQISAALIRPVASDGGSGGGGSGGLNVIVHSATGIKQISSALIRPVASDGGSGGGGSGGSATGFFQSKKFLQVPVASDFGGSGGGGSGGSATGFKQFSIALRRPVASDFGGSGGGGSGGSATGFKQISRALSRPVASDFGGSGGGGSGGSATGFKQSSFALIRPVASDFGGSGGGGSGGSATGFKQSSRALSRAVANDFGGSGGGGSGGSATGFNQSAKVLQAPVASDFGGSGGGGSGGYGFLNVIVHSATGFKQTSFALNRPVGGSGGGGSGGYGFLNVIVHSATGIKQASNALARPVGGSLGGGGSGIVGIVAGLAVLAVVVIGAVVATVMCRRKSSGGKGGSYSQAASSDSAQGSDVSLTA
